US012509736B2

(12) United States Patent
Dietrich et al.

(10) Patent No.: US 12,509,736 B2
(45) Date of Patent: Dec. 30, 2025

(54) GENETIC LOCI ASSOCIATED WITH DISEASE RESISTANCE IN SOYBEANS

(71) Applicant: Syngenta Participations AG, Basel (CH)

(72) Inventors: Robert Arthur Dietrich, Durham, NC (US); Thomas Joseph Curley, Durham, NC (US); Becky Welsh Breitinger, Durham, NC (US); John Luther Dawson, Durham, NC (US); John Daniel Hipskind, Durham, NC (US); Qingli Liu, Durham, NC (US)

(73) Assignee: Syngenta Crop Protection AG, Basel (CH)

( * ) Notice: Subject to any disclaimer, the term of this patent is extended or adjusted under 35 U.S.C. 154(b) by 26 days.

(21) Appl. No.: 18/046,021

(22) Filed: Oct. 12, 2022

(65) Prior Publication Data

US 2023/0147114 A1 May 11, 2023

Related U.S. Application Data

(62) Division of application No. 16/095,032, filed as application No. PCT/US2017/036712 on Jun. 9, 2017, now abandoned.

(60) Provisional application No. 62/347,945, filed on Jun. 9, 2016.

(51) Int. Cl.

| | |
|---|---|
| ***C12Q 1/68*** | (2018.01) |
| ***A01H 1/04*** | (2006.01) |
| ***A01H 5/10*** | (2018.01) |
| ***A01H 6/54*** | (2018.01) |
| ***C12N 15/82*** | (2006.01) |
| ***C12Q 1/6895*** | (2018.01) |

(52) U.S. Cl.

CPC ........... *C12Q 1/6895* (2013.01); *A01H 1/045* (2021.01); *A01H 5/10* (2013.01); *A01H 6/542* (2018.05); *C12N 15/8282* (2013.01)

(58) Field of Classification Search

None

See application file for complete search history.

(56) References Cited

U.S. PATENT DOCUMENTS

| | | | | |
|---|---|---|---|---|
| 7,842,850 | B2 | 11/2010 | Singh | |
| 8,759,607 | B2 * | 6/2014 | Harada | A01H 5/10 800/312 |
| 2007/0261139 | A1 | 11/2007 | Singh | |
| 2010/0263094 | A1 | 10/2010 | Singh | |
| 2011/0083234 | A1 | 4/2011 | Nguyen | |
| 2014/0255932 | A1 | 9/2014 | Harada et al. | |
| 2015/0135359 | A1 | 5/2015 | Baley et al. | |
| 2016/0073598 | A1 | 3/2016 | Yu et al. | |

OTHER PUBLICATIONS

Akpertey, A., Genetic introgression from Glycine Tomentella to soybean to increase seed yield., Dissertation submitted in the Graduate College of the University of Illinois at Urbana-Champaign, 2015.

International Search Report for International Patent Application No. PCT/US2017/036712 mailed Dec. 27, 2017.

Extended ESR for EP17815926.5, mailed on Oct. 25, 2019.

Singh, R.J. et al: "Intersubgeneric hybridization between Glycine maxandG. tomentella: production of FI, amphidiploid, BCI, BC2, BC3, and fertile soybean plants", in: Theoretical and Applied Genetics; International Journal of Plant Breeding Research. Springer. Berlin. DE., vol. 128. No. 6. Apr. 3, 2015, pp. 1117-1136. XP035502554. ISSN: 0040-5752. DOI: 10.1007/S00122-015-2494-0.

Langenbach, Caspar et al: "Fighting Asian Soybean Rust", in: Frontiers in Plant Science, vol. 7. No. 797. Jun. 7, 2016, pp. 1-13. XP055287670. DOI: 10.3389/fpls.2016.0079.

Soria-Guerra, Ruth Elena et al: "Transcriptome analysis of resistant and susceptible genotypes of Glycine tomentella during Phakopsora pachyrhizi infection reveals novel rust resistance genes", in: Theoretical and Applied Genetics; International Journal of Plant Breeding Research. Springer. Berlin. DE. vol 120. No. 7. Jan. 8, 2010, pp. 1315-1333. XP019797010. ISSN: 1432-2242.

Patzoldt, M.E. et al: "Soybean rust resistance derived from Glycine tomentella in amphiploid hybrid lines", in: Crop Science. Crop Science Society of America. US. vol 47. No. 1. Jan. 1, 2007, pp. 158-161. XP009102209. ISSN: 0011-183X. DOI. 10.2135/CROPSCI2006.05.0328.

Varala et al., "Rapid Genotyping of Soybean Cultivars Using High Throughput Sequencing," Department of Crop Sciences, University of Illinois, (PLoS ONE) Sep. 2011, vol. 6, Issue 9, e24811.

Derek Shih-Shun Shiao: "Characterizing soybean rust resistance within populatins of glycine tomentella and the inheritance and characterization of soybean aphid resistance in PI 587663, PI 587677, PI 587685, and PI 594592", Jan. 1, 2012, 51 pages.

* cited by examiner

*Primary Examiner* — Medina A Ibrahim
(74) *Attorney, Agent, or Firm* — Suparna Kanjilal

(57) ABSTRACT

The present invention relates to methods and compositions for identifying, selecting and/or producing a Disease resistant soybean plant or germplasm using markers, genes and chromosomal intervals derived from *Glycine tomentella* PI441001, PI441008, PI446958, PI509501, PI583970, or PI483224. A soybean plant or germplasm that has been identified, selected and/or produced by any of the methods of the present invention is also provided. Disease resistant soybean seeds, plants and germplasms are also provided.

4 Claims, 11 Drawing Sheets

Specification includes a Sequence Listing.

**Figure. 1 Depiction of *Glycine tomentella* SNPs Associated with ASR Resistance (i.e. each dot equals 1 SNP that associates with ASR resistance)**
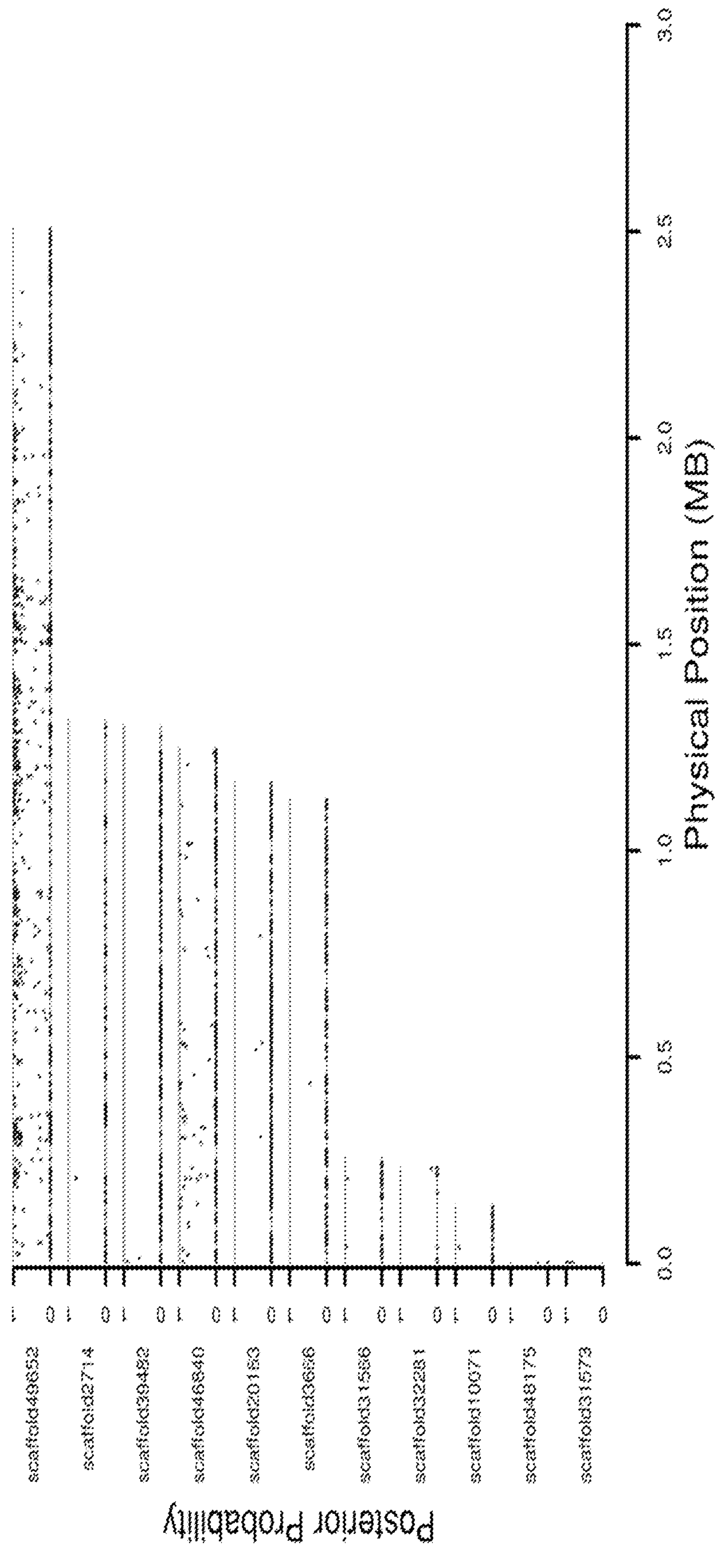

Figure. 2: Mapping Interval Discovery for Scaffold 49652
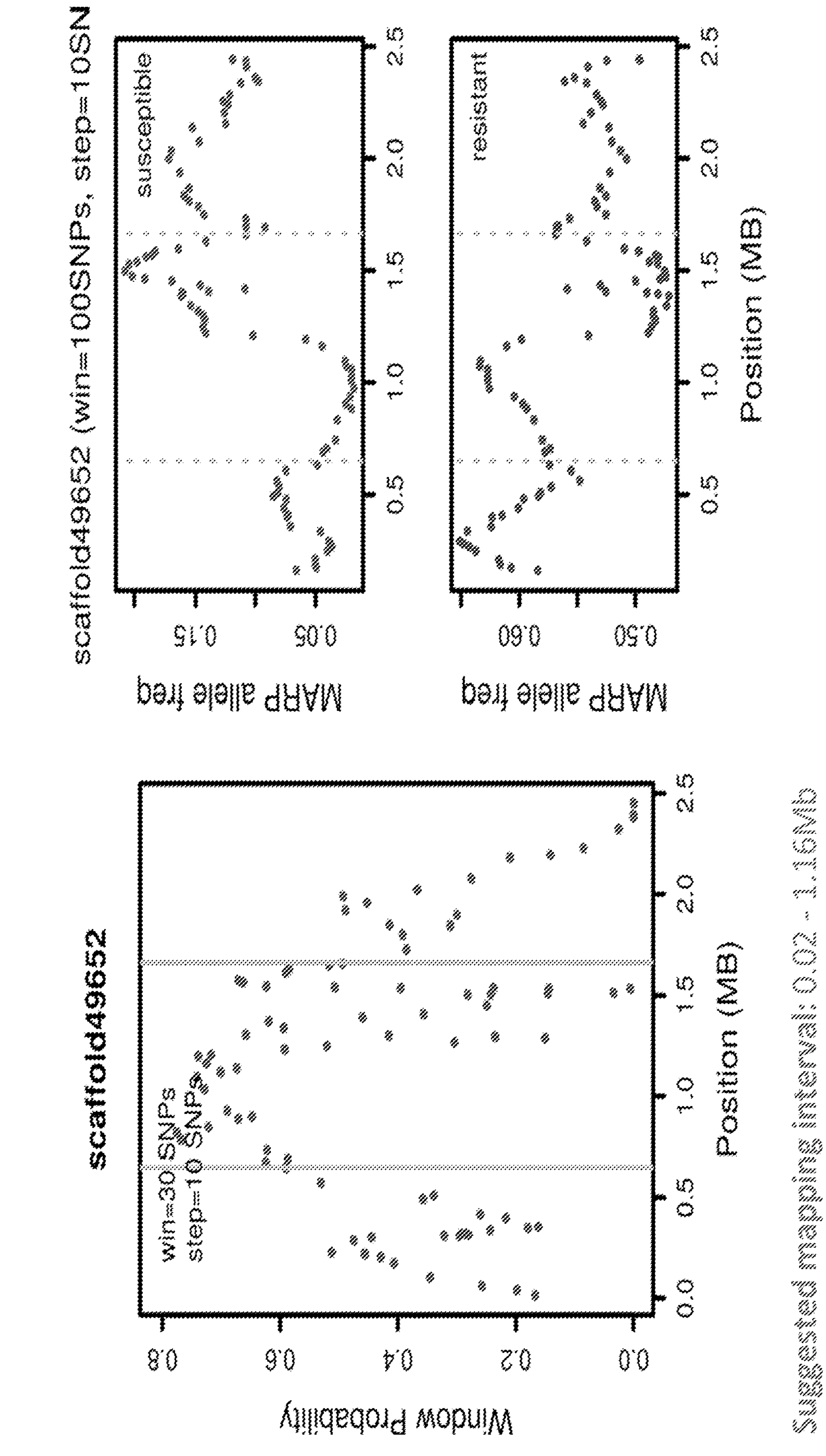

Figure. 3: Mapping Interval Discovery for Scaffold 46840
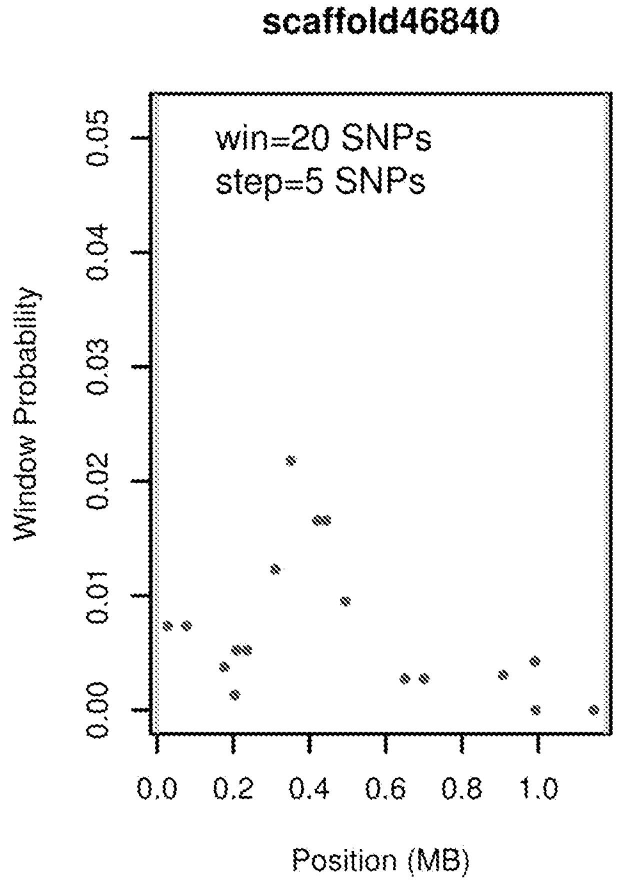
Suggested mapping interval: 0.02 - 1.19Mb

**Figure 4: Marker Association Mapping for *Glycine tomentella* PI 441001**
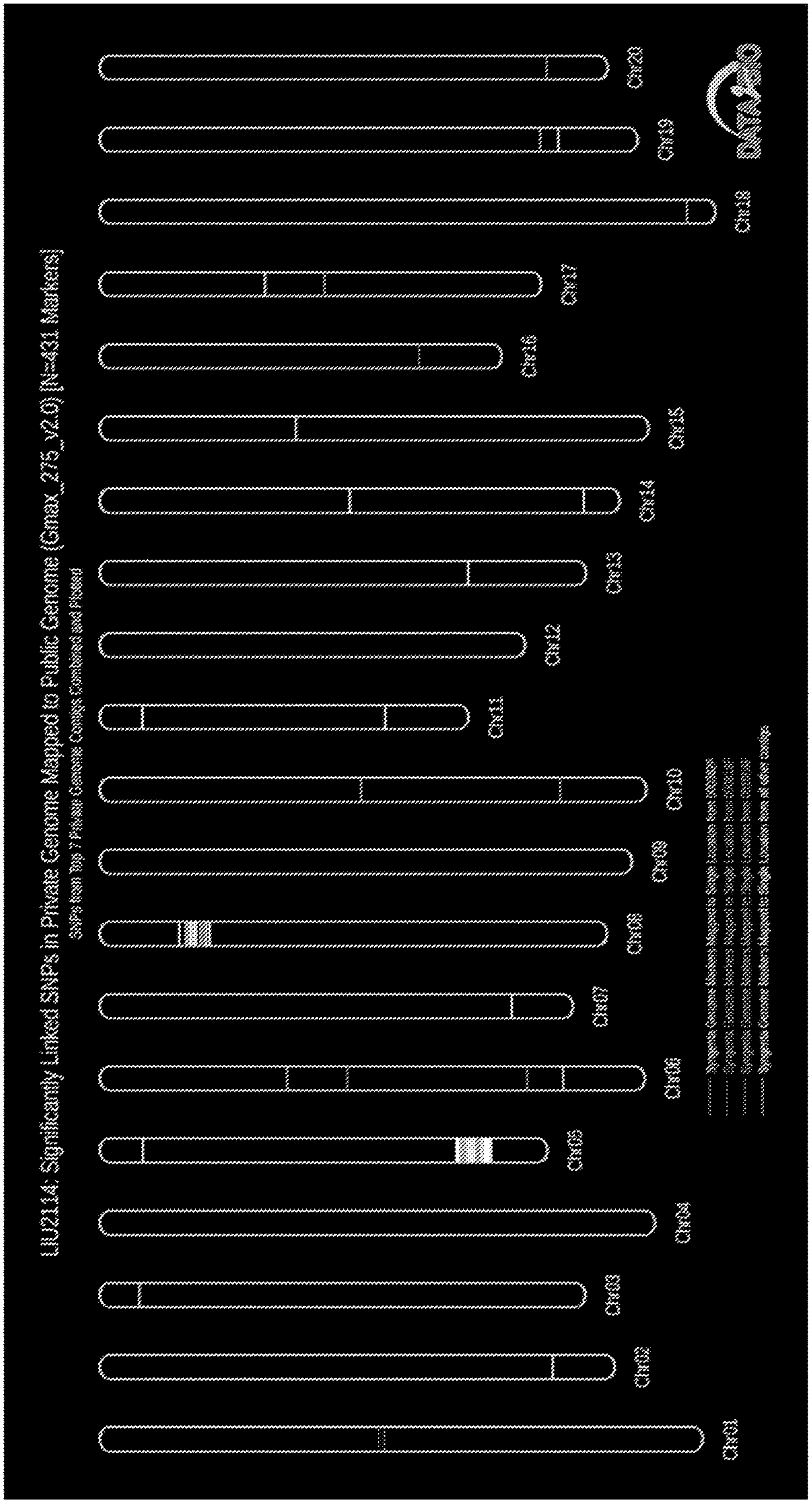

Figure 5: Scale used to rate rust resistance in *Glycine tomentella* lines

| RB0-NSP | No reaction to infection, or extremely small flecks/lesions |
|---|---|
| RB1-2-NSP | Necrotic or chlorotic flecks only, no sporulation |
| | Large or dense necrotic or chlorotic flecks only, no sporulation |
| RB3-NSP | minute uredia, large necrotic or chlorotic zones, few spores |
| RB4-SP | Small uredia with some associated necrotic or chlorotic tissues |
| TAN1-5-SP | large profusely sporulating uredia, little/no necrosis or chlorosis,1-5 is the level of sporulations, density and severity |

**Figure 6: Mapping result for *Glycine tomentella* PI583970**
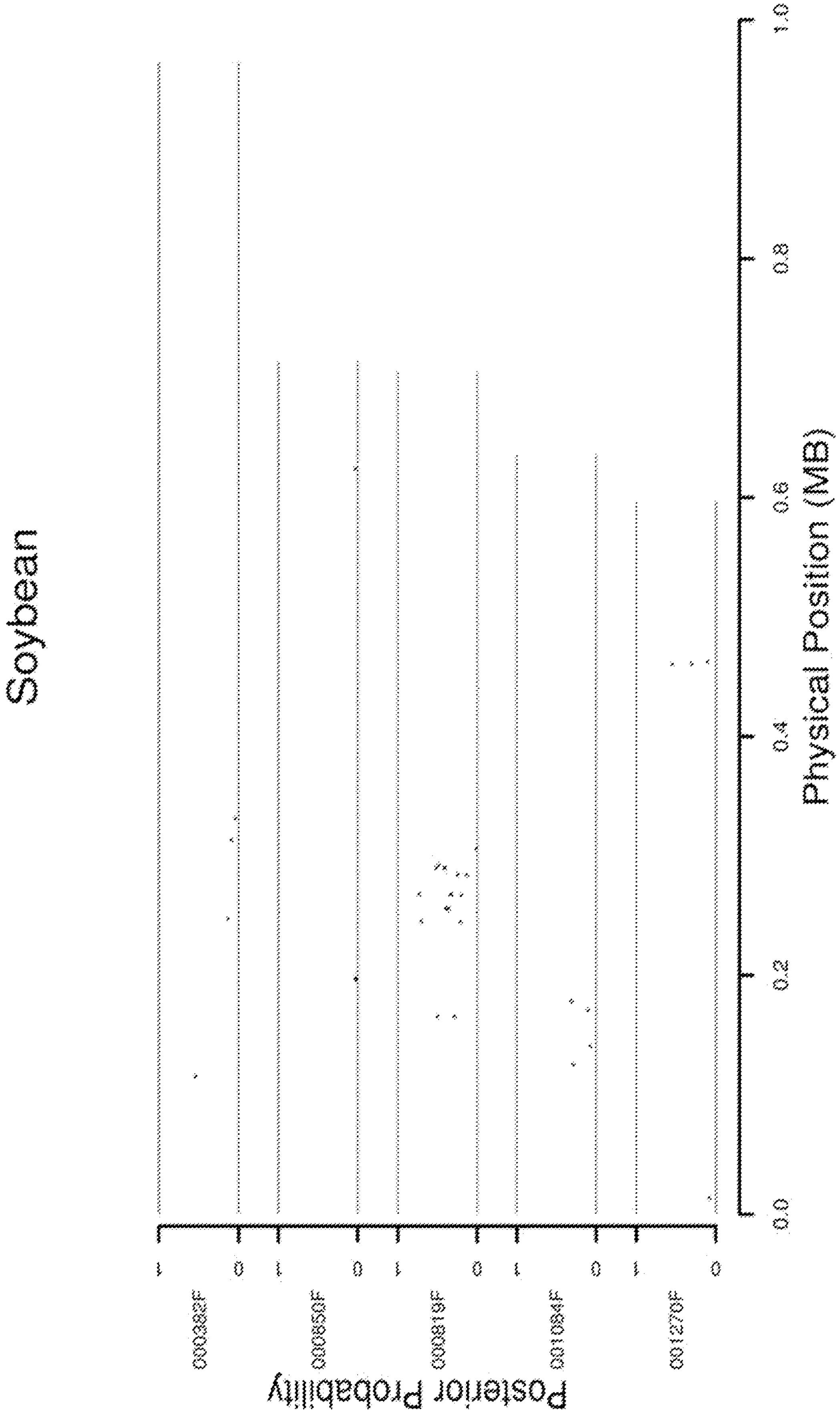

Figure 7: *Glycine tomentella* PI583970 Loci Associated with ASR Resistance mapped to *Glycine max* genome
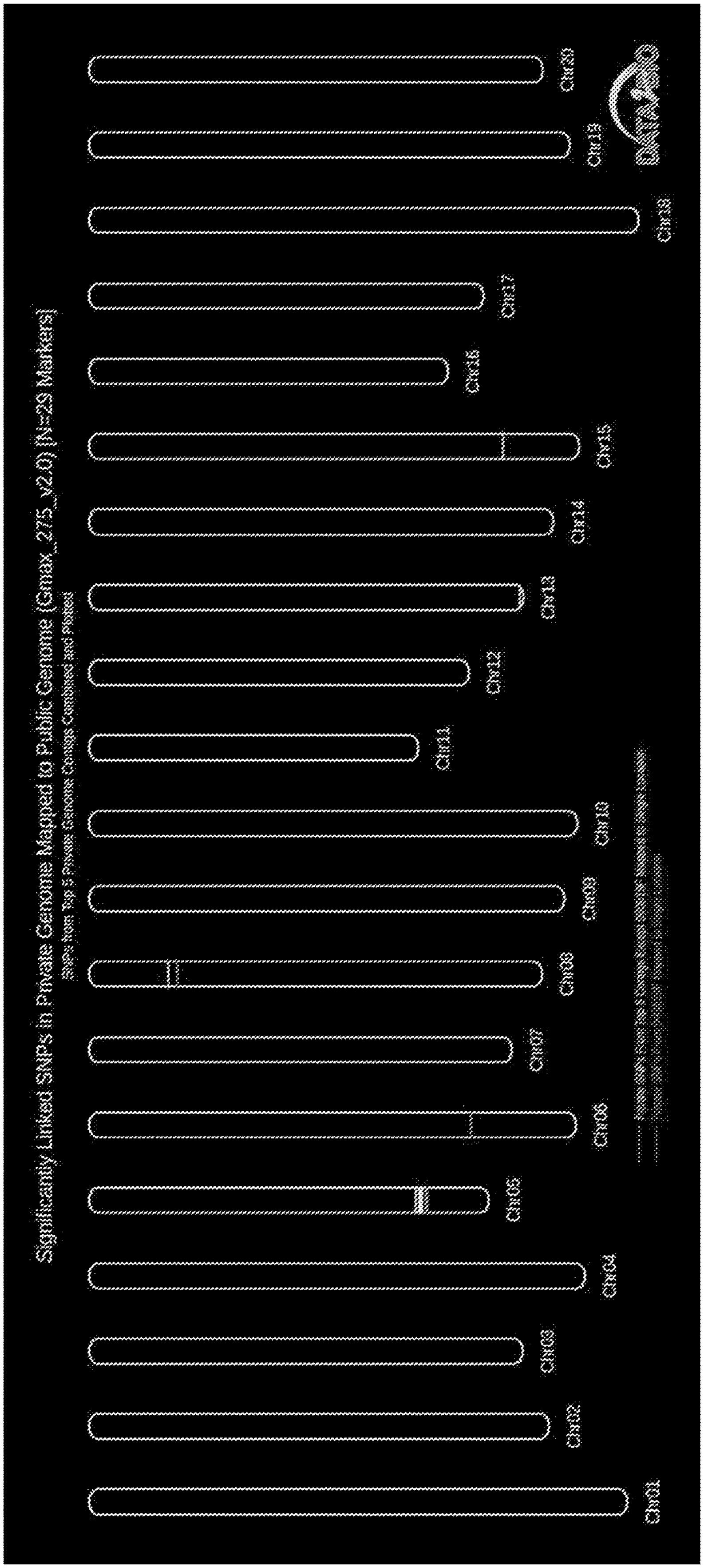

Figure 8: *Glycine tomentella* PI583970 Loci Associated with ASR Resistance to *Glycine max* genome (in relation to scaffold 001084F or SEQ ID NO: 4)
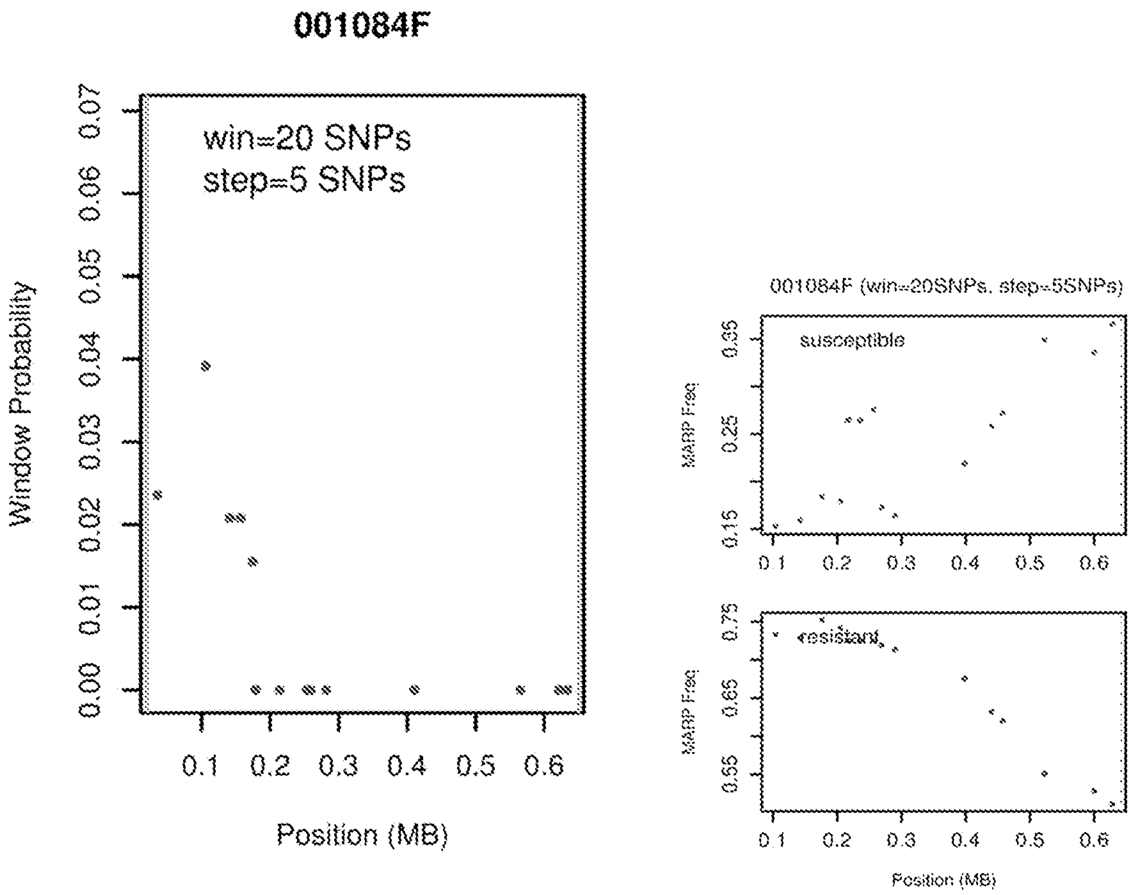

Figure 9: *Glycine tomentella* PI483224 Genomic Loci Associated with ASR Resistance
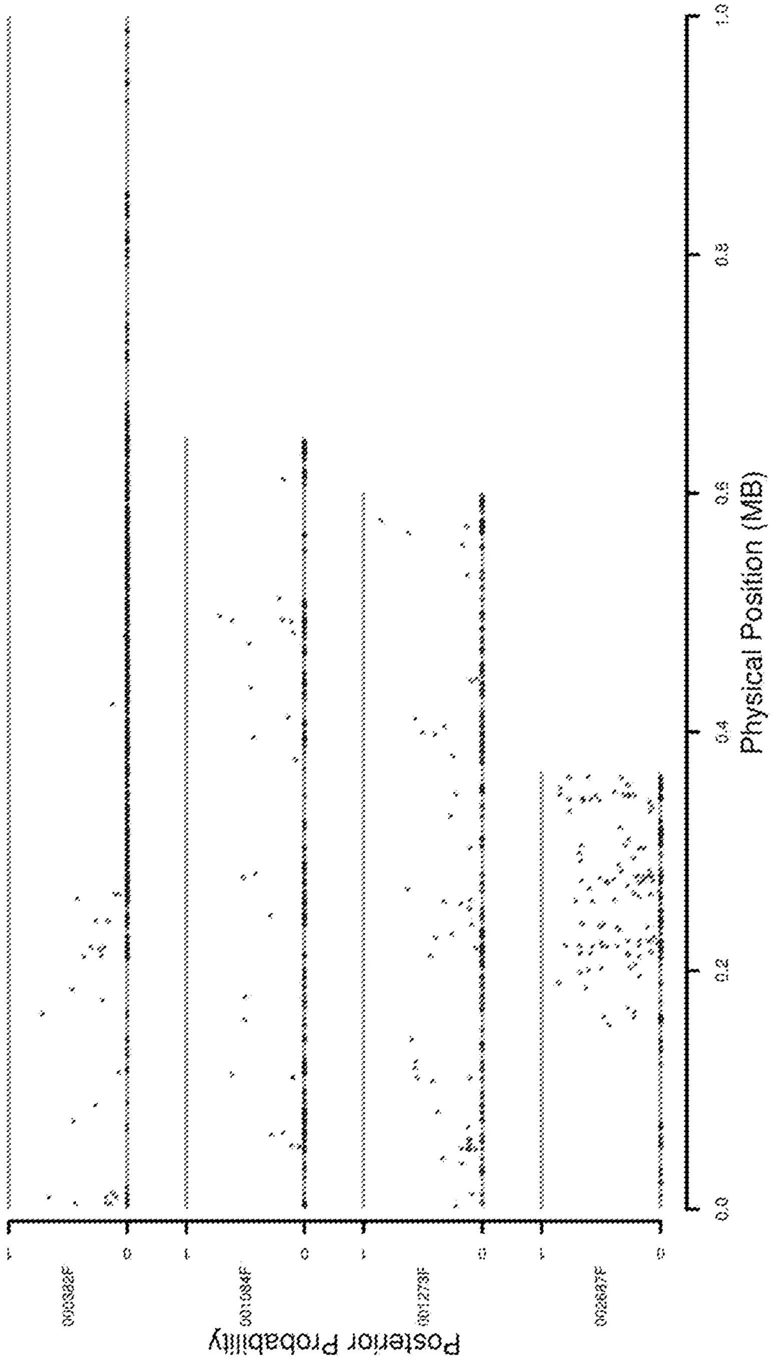

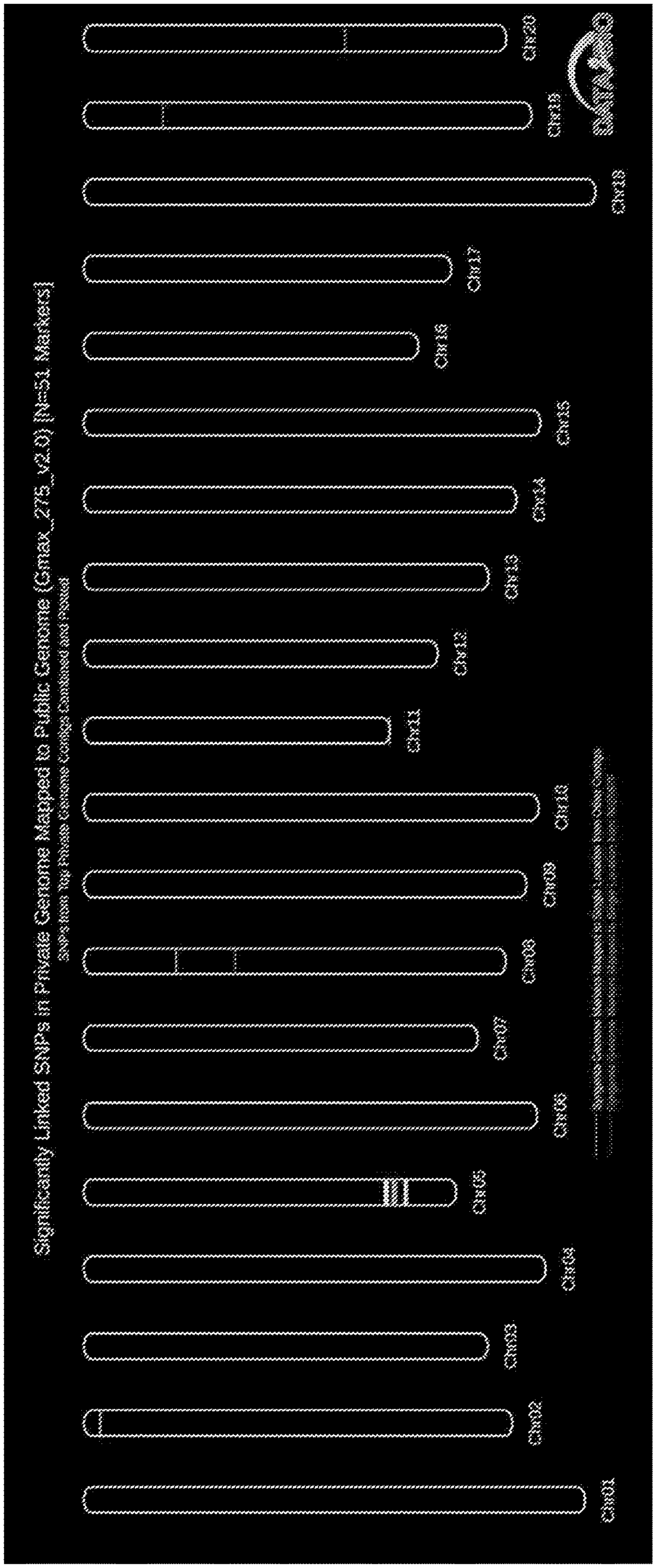
Figure 10: *Glycine tomentella* PI483224 Loci Associated with ASR Resistance mapped to *Glycine max* genome

Figure 11: *Glycine tomentella* PI483224 Loci Associated with ASR Resistance to *Glycine max* genome (in relation to scaffold 002687F or SEQ ID NO: 3)
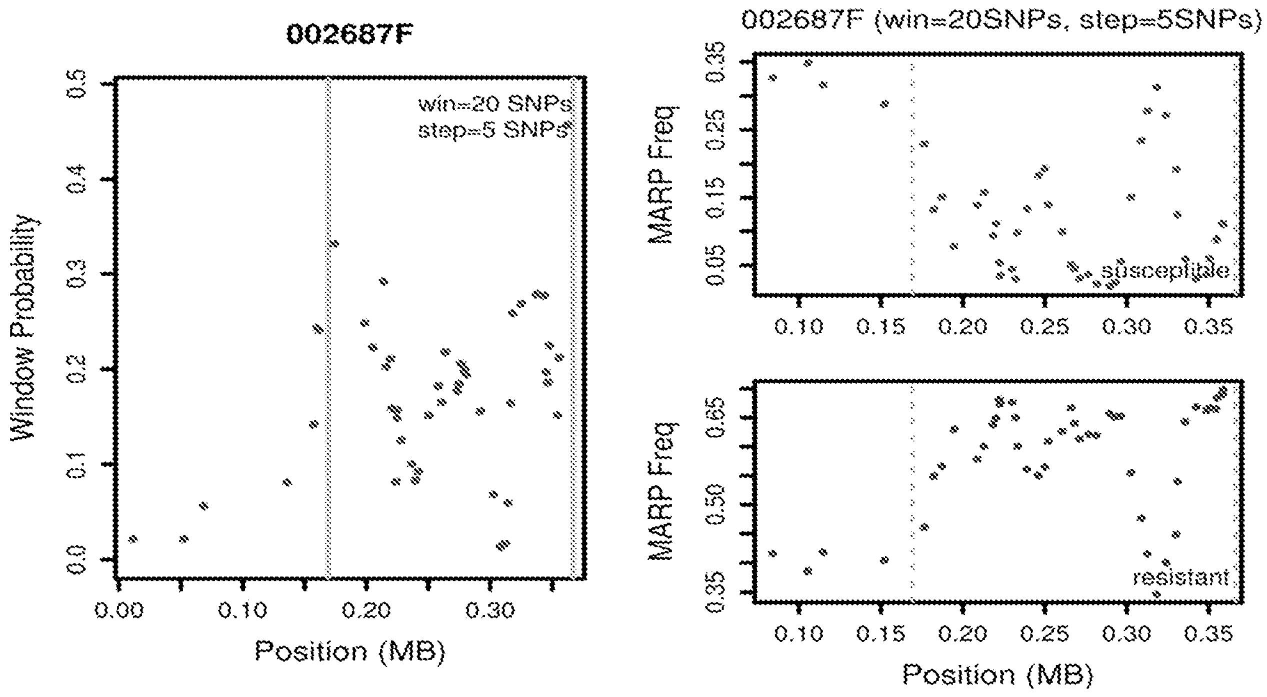

GENETIC LOCI ASSOCIATED WITH DISEASE RESISTANCE IN SOYBEANS

RELATED APPLICATIONS

This application is a divisional application of application Ser. No. 16/095,032 filed Oct. 19, 2018, which is a U.S. 371 of international application PCT/US2017/036712 filed Jun. 9, 2017, the benefit of U.S. Provisional Patent Application No. 62/347,945 filed Jun. 9, 2016, the contents of which are incorporated herein by reference in their entirety.

STATEMENT REGARDING ELECTRONIC FILING OF A SEQUENCE LISTING

A Sequence Listing in ST26 xml format, is submitted, entitled 81045.xml and 5.52 MB in size, generated on Oct. 5, 2022 and an electronic sequence listing is filed in conjunction with this application. This Sequence Listing is hereby incorporated by reference into the specification for its disclosures.

FIELD OF THE INVENTION

The present invention relates to compositions and methods for identifying, selecting and producing enhanced disease and/or pathogen resistant soybean plants.

BACKGROUND

Plant pathogens are known to cause considerable damage to important crops, resulting in significant agricultural losses with widespread consequences for both the food supply and other industries that rely on plant materials. As such, there is a long felt need to reduce the incidence and/or impact of agricultural pathogens on crop production.

Several pathogens have been associated with damage to soybeans, which individually and collectively have the potential to cause significant yield losses in the United States and throughout the world. Exemplary pathogens include, but are not limited to fungi (e.g., genus *Phytophthora* and Asian Soybean rust *Phakopsora pachyrhizi*), nematodes (e.g., genus *Meloidogyne*, particularly, *Meloidogyne javanica*), and soybean stem canker. Given the significant threat to global food supplies that these pathogens present as well as the time and expense associated with treating soybean crops to prevent yield loss, new methods for producing pathogen resistant soybean cultivars are needed. What is needed is novel resistance genes (herein, "R-Genes") that can be introduced into commercial soybean plants to control soybean pathogens

SUMMARY OF THE INVENTION

This summary lists several embodiments of the presently disclosed subject matter, and in many cases lists variations and permutations of these embodiments.

Thus, it is an object of the presently disclosed subject matter to provide methods for conveying pathogen resistance into non-resistant soybean germplasm or plant lines. Further the presently disclosed subject matter provides novel *Glycine max* lines comprising in its genome a chromosome interval, loci, and/or gene that is derived from *Glycine tomentella* and further confers Asian soybean rust resistance (herein, 'ASR') in said novel *Glycine max* line.

BRIEF DESCRIPTION OF THE SEQUENCE LISTING

SEQ ID NOs: 1 & 2 are chromosomal intervals derived from *Glycine tomentella* line accession PI441001 referred to herein as "Scaffold 46840" and "Scaffold 49652" respectively. Scaffold 49652 has been mapped to *G. tomentella* chromosome 5 and Scaffold 46840 has been mapped to *G. tomentella* chromosome 5. SEQ ID NO. 3 is a chromosomal interval derived from *Glycine tomentella* line accession PI 483224 referred to herein as "Scaffold 002687F". Scaffold 002687F has been mapped to *G. tomentella* chromosome 5. SEQ ID NO. 4 is a chromosomal interval derived from *Glycine tomentella* line accession PI 583970 referred to herein as "Scaffold 001084F". Scaffold 001084F has been mapped to *G. tomentella* chromosome 5. SEQ ID NO: 5 is a chromosomal interval derived from *Glycine tomentella* line accession PI583970 herein referred to "Scaffold 000819F". Scaffold 000819F has been mapped to *G. tomentella* chromosome 5. Genetic population mapping studies for PI441001, PI483224 and PI 583970 indicate that *Glycine tomentella* Chromosome 5 contains chromosomal intervals highly associated with ASR resistance (e.g. as corresponding to SEQ ID NOs: 1-5). Tentative data, not to be limited by theory, also indicates that *Glycine tomentella* accessions PI446958 and/or PI483224 can be used as a source for said chromosomal intervals corresponding to SEQ ID NOs 1-5. These chromosomal intervals or portions thereof may be introduced (i.e. introgressed through use of embryo rescue & marker assisted breeding (MAB)) into *Glycine max* lines to create *Glycine max* lines resistant to various diseases such as ASR. Tables 1-5 indicate single nucleotide polymorphisms (SNP) within SEQ ID NOs 1-5 that are associated with ASR resistance. Table 1 displays SNP associations for SEQ ID NO: 1 (Scaffold 46840) and Table 2 displays SNP associations for SEQ ID NO: 2 (Scaffold 49652). Table 3 displays SNP associations for SEQ ID NO: 3 (Scaffold 002687F). Table 4 displays SNP association for SEQ ID NO. 4 (Scaffold 001084F). Table 5 displays SNP associations for SEQ ID NO: 5 (Scaffold 000819F). All alleles for the SNPs identified in Tables 1-5 were determined to be significantly linked with resistance or susceptibility ($p<0.05$) to ASR.

TABLE 1

SNP Positions within SEQ ID NO: 1 that are associated with increased resistance to ASR

| SNP Name | Position | Favorable Allele (Rust Resistant) | Unfavorable Allele (Rust Susceptible) |
|---|---|---|---|
| scaffold46840_1828_SNP | 1828 | T | C |
| scaffold46840_3854_SNP | 3854 | A | T |
| scaffold46840_4596_SNP | 4596 | G | C |
| scaffold46840_7871_SNP | 7871 | G | T |
| scaffold46840_16578_SNP | 16578 | A | C |
| scaffold46840_19339_SNP | 19339 | T | A |
| scaffold46840_19702_SNP | 19702 | C | T |
| scaffold46840_19733_SNP | 19733 | A | G |
| scaffold46840_21388_SNP | 21388 | G | T |
| scaffold46840_21389_SNP | 21389 | G | A |
| scaffold46840_21402_SNP | 21402 | A | G |
| scaffold46840_21518_SNP | 21518 | A | G |
| scaffold46840_21519_SNP | 21519 | A | T |
| scaffold46840_23199_SNP | 23199 | T | C |
| scaffold46840_27734_SNP | 27734 | A | C |
| scaffold46840_28944_SNP | 28944 | C | A |
| scaffold46840_31424_SNP | 31424 | A | G |
| scaffold46840_33107_SNP | 33107 | G | A |

TABLE 1-continued

SNP Positions within SEQ ID NO: 1 that are associated with increased resistance to ASR

| SNP Name | Position | Favorable Allele (Rust Resistant) | Unfavorable Allele (Rust Susceptible) |
|---|---|---|---|
| scaffold46840__34009__SNP | 34009 | C | T |
| scaffold46840__53166__SNP | 53166 | C | T |
| scaffold46840__53469__SNP | 53469 | C | T |
| scaffold46840__53908__SNP | 53908 | A | C |
| scaffold46840__54203__SNP | 54203 | T | C |
| scaffold46840__56034__SNP | 56034 | T | G |
| scaffold46840__88414__SNP | 88414 | G | T |
| scaffold46840__98917__SNP | 98917 | T | G |
| scaffold46840__104913__SNP | 104913 | C | G |
| scaffold46840__106826__SNP | 106826 | T | C |
| scaffold46840__106962__SNP | 106962 | A | T |
| scaffold46840__107712__SNP | 107712 | T | A |
| scaffold46840__133407__SNP | 133407 | T | C |
| scaffold46840__135237__SNP | 135237 | A | T |
| scaffold46840__138711__SNP | 138711 | C | T |
| scaffold46840__143396__SNP | 143396 | G | A |
| scaffold46840__143399__SNP | 143399 | T | C |
| scaffold46840__144469__SNP | 144469 | A | G |
| scaffold46840__155153__SNP | 155153 | T | C |
| scaffold46840__156265__SNP | 156265 | C | T |
| scaffold46840__156445__SNP | 156445 | G | A |
| scaffold46840__157487__SNP | 157487 | A | G |
| scaffold46840__160570__SNP | 160570 | A | G |
| scaffold46840__173047__SNP | 173047 | C | T |
| scaffold46840__173086__SNP | 173086 | C | T |
| scaffold46840__175324__SNP | 175324 | T | C |
| scaffold46840__176807__SNP | 176807 | A | T |
| scaffold46840__183058__SNP | 183058 | G | A |
| scaffold46840__185660__SNP | 185660 | T | A |
| scaffold46840__187500__SNP | 187500 | A | G |
| scaffold46840__189638__SNP | 189638 | G | A |
| scaffold46840__193666__SNP | 193666 | A | G |
| scaffold46840__194620__SNP | 194620 | G | A |
| scaffold46840__195623__SNP | 195623 | A | G |
| scaffold46840__199643__SNP | 199643 | C | A |
| scaffold46840__203247__SNP | 203247 | T | C |
| scaffold46840__204613__SNP | 204613 | A | G |
| scaffold46840__205887__SNP | 205887 | C | T |
| scaffold46840__206645__SNP | 206645 | T | C |
| scaffold46840__206670__SNP | 206670 | A | T |
| scaffold46840__207999__SNP | 207999 | A | G |
| scaffold46840__208069__SNP | 208069 | T | G |
| scaffold46840__210361__SNP | 210361 | G | C |
| scaffold46840__210610__SNP | 210610 | T | C |
| scaffold46840__211145__SNP | 211145 | A | C |
| scaffold46840__213594__SNP | 213594 | A | G |
| scaffold46840__213644__SNP | 213644 | G | A |
| scaffold46840__228760__SNP | 228760 | T | G |
| scaffold46840__232915__SNP | 232915 | G | T |
| scaffold46840__244091__SNP | 244091 | T | A |
| scaffold46840__247995__SNP | 247995 | C | T |
| scaffold46840__252031__SNP | 252031 | A | G |
| scaffold46840__252294__SNP | 252294 | G | A |
| scaffold46840__265245__SNP | 265245 | C | G |
| scaffold46840__266739__SNP | 266739 | G | T |
| scaffold46840__292109__SNP | 292109 | C | T |
| scaffold46840__301218__SNP | 301218 | T | A |
| scaffold46840__305019__SNP | 305019 | A | G |
| scaffold46840__305252__SNP | 305252 | A | G |
| scaffold46840__306327__SNP | 306327 | T | C |
| scaffold46840__306369__SNP | 306369 | C | T |
| scaffold46840__308096__SNP | 308096 | T | C |
| scaffold46840__309679__SNP | 309679 | A | T |
| scaffold46840__310247__SNP | 310247 | C | A |
| scaffold46840__310792__SNP | 310792 | A | T |
| scaffold46840__312460__SNP | 312460 | C | A |
| scaffold46840__313406__SNP | 313406 | A | C |
| scaffold46840__329689__SNP | 329689 | G | A |
| scaffold46840__330435__SNP | 330435 | G | C |
| scaffold46840__331328__SNP | 331328 | G | A |
| scaffold46840__337919__SNP | 337919 | C | A |
| scaffold46840__350957__SNP | 350957 | A | T |

TABLE 1-continued

SNP Positions within SEQ ID NO: 1 that are associated with increased resistance to ASR

| SNP Name | Position | Favorable Allele (Rust Resistant) | Unfavorable Allele (Rust Susceptible) |
|---|---|---|---|
| scaffold46840__354267__SNP | 354267 | A | G |
| scaffold46840__355661__SNP | 355661 | T | C |
| scaffold46840__356478__SNP | 356478 | T | C |
| scaffold46840__358994__SNP | 358994 | T | C |
| scaffold46840__363408__SNP | 363408 | A | G |
| scaffold46840__367504__SNP | 367504 | G | C |
| scaffold46840__368441__SNP | 368441 | A | T |
| scaffold46840__371665__SNP | 371665 | C | T |
| scaffold46840__372390__SNP | 372390 | C | A |
| scaffold46840__372415__SNP | 372415 | T | A |
| scaffold46840__380899__SNP | 380899 | C | T |
| scaffold46840__381701__SNP | 381701 | T | G |
| scaffold46840__382539__SNP | 382539 | A | G |
| scaffold46840__384909__SNP | 384909 | A | T |
| scaffold46840__386383__SNP | 386383 | G | A |
| scaffold46840__386883__SNP | 386883 | G | C |
| scaffold46840__387699__SNP | 387699 | A | G |
| scaffold46840__388192__SNP | 388192 | C | G |
| scaffold46840__401306__SNP | 401306 | G | C |
| scaffold46840__402205__SNP | 402205 | C | T |
| scaffold46840__419063__SNP | 419063 | A | C |
| scaffold46840__419121__SNP | 419121 | C | T |
| scaffold46840__419259__SNP | 419259 | G | A |
| scaffold46840__420963__SNP | 420963 | C | G |
| scaffold46840__421037__SNP | 421037 | C | T |
| scaffold46840__421906__SNP | 421906 | T | C |
| scaffold46840__424476__SNP | 424476 | C | T |
| scaffold46840__426504__SNP | 426504 | T | C |
| scaffold46840__426550__SNP | 426550 | C | T |
| scaffold46840__433738__SNP | 433738 | C | A |
| scaffold46840__435442__SNP | 435442 | C | T |
| scaffold46840__435446__SNP | 435446 | T | C |
| scaffold46840__435456__SNP | 435456 | G | A |
| scaffold46840__436445__SNP | 436445 | G | T |
| scaffold46840__436844__SNP | 436844 | T | G |
| scaffold46840__437526__SNP | 437526 | G | T |
| scaffold46840__438692__SNP | 438692 | C | A |
| scaffold46840__440329__SNP | 440329 | G | A |
| scaffold46840__441638__SNP | 441638 | T | C |
| scaffold46840__442882__SNP | 442882 | C | T |
| scaffold46840__444624__SNP | 444624 | C | T |
| scaffold46840__444829__SNP | 444829 | G | T |
| scaffold46840__444833__SNP | 444833 | C | T |
| scaffold46840__445506__SNP | 445506 | T | C |
| scaffold46840__451845__SNP | 451845 | A | G |
| scaffold46840__455083__SNP | 455083 | G | A |
| scaffold46840__455349__SNP | 455349 | G | C |
| scaffold46840__456838__SNP | 456838 | C | T |
| scaffold46840__456840__SNP | 456840 | C | T |
| scaffold46840__456888__SNP | 456888 | G | A |
| scaffold46840__457510__SNP | 457510 | G | A |
| scaffold46840__459924__SNP | 459924 | A | T |
| scaffold46840__493769__SNP | 493769 | G | A |
| scaffold46840__493863__SNP | 493863 | T | C |
| scaffold46840__495644__SNP | 495644 | G | A |
| scaffold46840__498269__SNP | 498269 | G | C |
| scaffold46840__500187__SNP | 500187 | C | T |
| scaffold46840__524750__SNP | 524750 | G | A |
| scaffold46840__531774__SNP | 531774 | G | C |
| scaffold46840__532217__SNP | 532217 | A | G |
| scaffold46840__532460__SNP | 532460 | C | A |
| scaffold46840__532849__SNP | 532849 | C | T |
| scaffold46840__533165__SNP | 533165 | T | G |
| scaffold46840__534674__SNP | 534674 | A | G |
| scaffold46840__534815__SNP | 534815 | T | C |
| scaffold46840__541100__SNP | 541100 | T | C |
| scaffold46840__547800__SNP | 547800 | A | G |
| scaffold46840__548096__SNP | 548096 | A | T |
| scaffold46840__548651__SNP | 548651 | A | G |
| scaffold46840__548909__SNP | 548909 | C | A |
| scaffold46840__550359__SNP | 550359 | A | G |
| scaffold46840__554136__SNP | 554136 | T | C |

TABLE 1-continued

SNP Positions within SEQ ID NO: 1 that are associated with increased resistance to ASR

| SNP Name | Position | Favorable Allele (Rust Resistant) | Unfavorable Allele (Rust Susceptible) |
|---|---|---|---|
| scaffold46840_557231_SNP | 557231 | G | C |
| scaffold46840_557476_SNP | 557476 | T | C |
| scaffold46840_559239_SNP | 559239 | G | T |
| scaffold46840_566877_SNP | 566877 | G | T |
| scaffold46840_573263_SNP | 573263 | C | G |
| scaffold46840_576344_SNP | 576344 | G | A |
| scaffold46840_576937_SNP | 576937 | T | A |
| scaffold46840_581793_SNP | 581793 | T | C |
| scaffold46840_631321_SNP | 631321 | T | A |
| scaffold46840_632437_SNP | 632437 | T | C |
| scaffold46840_644135_SNP | 644135 | G | A |
| scaffold46840_646516_SNP | 646516 | A | C |
| scaffold46840_646661_SNP | 646661 | C | T |
| scaffold46840_650395_SNP | 650395 | C | G |
| scaffold46840_650533_SNP | 650533 | T | G |
| scaffold46840_650883_SNP | 650883 | T | C |
| scaffold46840_680820_SNP | 680820 | T | C |
| scaffold46840_700296_SNP | 700296 | G | T |
| scaffold46840_709091_SNP | 709091 | T | C |
| scaffold46840_717250_SNP | 717250 | A | G |
| scaffold46840_717919_SNP | 717919 | C | T |
| scaffold46840_723204_SNP | 723204 | A | G |
| scaffold46840_737847_SNP | 737847 | A | C |
| scaffold46840_742854_SNP | 742854 | G | C |
| scaffold46840_761047_SNP | 761047 | C | T |
| scaffold46840_763626_SNP | 763626 | G | A |
| scaffold46840_767022_SNP | 767022 | A | T |
| scaffold46840_773124_SNP | 773124 | G | A |
| scaffold46840_795852_SNP | 795852 | G | A |
| scaffold46840_844662_SNP | 844662 | A | T |
| scaffold46840_856241_SNP | 856241 | C | T |
| scaffold46840_864819_SNP | 864819 | A | C |
| scaffold46840_868404_SNP | 868404 | T | A |
| scaffold46840_881483_SNP | 881483 | G | A |
| scaffold46840_881687_SNP | 881687 | G | A |
| scaffold46840_948734_SNP | 948734 | C | G |
| scaffold46840_951580_SNP | 951580 | C | A |
| scaffold46840_979277_SNP | 979277 | C | A |
| scaffold46840_984144_SNP | 984144 | A | G |
| scaffold46840_985119_SNP | 985119 | A | G |
| scaffold46840_990969_SNP | 990969 | T | G |
| scaffold46840_991246_SNP | 991246 | G | A |
| scaffold46840_996069_SNP | 996069 | A | T |
| scaffold46840_996617_SNP | 996617 | T | C |
| scaffold46840_1005071_SNP | 1005071 | G | T |
| scaffold46840_1012711_SNP | 1012711 | C | A |
| scaffold46840_1013144_SNP | 1013144 | A | T |
| scaffold46840_1013502_SNP | 1013502 | C | T |
| scaffold46840_1013853_SNP | 1013853 | G | T |
| scaffold46840_1014491_SNP | 1014491 | A | G |
| scaffold46840_1017387_SNP | 1017387 | T | G |
| scaffold46840_1017454_SNP | 1017454 | C | T |
| scaffold46840_1017456_SNP | 1017456 | A | G |
| scaffold46840_1017513_SNP | 1017513 | G | A |
| scaffold46840_1017562_SNP | 1017562 | G | A |
| scaffold46840_1017580_SNP | 1017580 | A | G |
| scaffold46840_1018041_SNP | 1018041 | G | C |
| scaffold46840_1018803_SNP | 1018803 | A | G |
| scaffold46840_1018807_SNP | 1018807 | A | T |
| scaffold46840_1018808_SNP | 1018808 | A | T |
| scaffold46840_1018809_SNP | 1018809 | A | T |
| scaffold46840_1019830_SNP | 1019830 | T | A |
| scaffold46840_1019879_SNP | 1019879 | C | T |
| scaffold46840_1023021_SNP | 1023021 | A | G |
| scaffold46840_1025444_SNP | 1025444 | T | C |
| scaffold46840_1027183_SNP | 1027183 | T | C |
| scaffold46840_1027185_SNP | 1027185 | T | C |
| scaffold46840_1027206_SNP | 1027206 | C | T |
| scaffold46840_1028386_SNP | 1028386 | T | A |
| scaffold46840_1035663_SNP | 1035663 | T | G |
| scaffold46840_1050796_SNP | 1050796 | A | T |
| scaffold46840_1092407_SNP | 1092407 | C | T |

TABLE 1-continued

SNP Positions within SEQ ID NO: 1 that are associated with increased resistance to ASR

| SNP Name | Position | Favorable Allele (Rust Resistant) | Unfavorable Allele (Rust Susceptible) |
|---|---|---|---|
| scaffold46840_1092836_SNP | 1092836 | A | T |
| scaffold46840_1097462_SNP | 1097462 | G | T |
| scaffold46840_1100700_SNP | 1100700 | C | A |
| scaffold46840_1107270_SNP | 1107270 | C | G |
| scaffold46840_1108688_SNP | 1108688 | T | C |
| scaffold46840_1110411_SNP | 1110411 | G | A |
| scaffold46840_1110578_SNP | 1110578 | G | A |
| scaffold46840_1113083_SNP | 1113083 | C | A |
| scaffold46840_1128638_SNP | 1128638 | A | G |
| scaffold46840_1132152_SNP | 1132152 | A | T |
| scaffold46840_1145964_SNP | 1145964 | T | G |
| scaffold46840_1151108_SNP | 1151108 | T | C |
| scaffold46840_1152027_SNP | 1152027 | T | C |
| scaffold46840_1164739_SNP | 1164739 | A | C |
| scaffold46840_1179177_SNP | 1179177 | A | G |
| scaffold46840_1196044_SNP | 1196044 | T | C |
| scaffold46840_1208547_SNP | 1208547 | T | A |
| scaffold46840_1222050_SNP | 1222050 | T | C |
| scaffold46840_1236321_SNP | 1236321 | C | A |
| scaffold46840_1238462_SNP | 1238462 | A | T |
| scaffold46840_1245039_SNP | 1245039 | A | T |

TABLE 2

SNP Positions within SEQ ID NO: 2 that are associated with increased resistance to ASR

| SNP Name | Position | Favorable Allele (Rust Resistant) | Unfavorable Allele (Rust Susceptible) |
|---|---|---|---|
| scaffold49652_5217_SNP | 5217 | T | C |
| scaffold49652_17452_SNP | 17452 | T | C |
| scaffold49652_17508_SNP | 17508 | T | C |
| scaffold49652_18133_SNP | 18133 | G | A |
| scaffold49652_23299_SNP | 23299 | T | G |
| scaffold49652_23932_SNP | 23932 | T | A |
| scaffold49652_25316_SNP | 25316 | C | T |
| scaffold49652_27493_SNP | 27493 | C | T |
| scaffold49652_31604_SNP | 31604 | A | C |
| scaffold49652_33717_SNP | 33717 | T | C |
| scaffold49652_33754_SNP | 33754 | G | A |
| scaffold49652_33815_SNP | 33815 | C | T |
| scaffold49652_35579_SNP | 35579 | A | G |
| scaffold49652_42441_SNP | 42441 | C | T |
| scaffold49652_45742_SNP | 45742 | A | G |
| scaffold49652_47403_SNP | 47403 | G | T |
| scaffold49652_50271_SNP | 50271 | C | G |
| scaffold49652_50273_SNP | 50273 | A | C |
| scaffold49652_52163_SNP | 52163 | A | G |
| scaffold49652_53843_SNP | 53843 | T | C |
| scaffold49652_53867_SNP | 53867 | T | C |
| scaffold49652_57089_SNP | 57089 | A | G |
| scaffold49652_60723_SNP | 60723 | C | T |
| scaffold49652_62132_SNP | 62132 | T | C |
| scaffold49652_64164_SNP | 64164 | T | A |
| scaffold49652_65402_SNP | 65402 | G | A |
| scaffold49652_67001_SNP | 67001 | G | T |
| scaffold49652_68551_SNP | 68551 | G | A |
| scaffold49652_88556_SNP | 88556 | A | G |
| scaffold49652_90063_SNP | 90063 | T | C |
| scaffold49652_95177_SNP | 95177 | A | G |
| scaffold49652_95604_SNP | 95604 | C | T |
| scaffold49652_98488_SNP | 98488 | G | A |
| scaffold49652_112122_SNP | 112122 | G | T |
| scaffold49652_119068_SNP | 119068 | T | C |
| scaffold49652_129424_SNP | 129424 | G | A |
| scaffold49652_130808_SNP | 130808 | A | G |

TABLE 2-continued

SNP Positions within SEQ ID NO: 2 that are associated with increased resistance to ASR

| SNP Name | Position | Favorable Allele (Rust Resistant) | Unfavorable Allele (Rust Susceptible) |
|---|---|---|---|
| scaffold49652__136261__SNP | 136261 | C | A |
| scaffold49652__159300__SNP | 159300 | G | T |
| scaffold49652__164108__SNP | 164108 | G | A |
| scaffold49652__164267__SNP | 164267 | C | T |
| scaffold49652__164427__SNP | 164427 | A | G |
| scaffold49652__176366__SNP | 176366 | T | A |
| scaffold49652__178148__SNP | 178148 | T | C |
| scaffold49652__181207__SNP | 181207 | T | C |
| scaffold49652__182444__SNP | 182444 | A | G |
| scaffold49652__183913__SNP | 183913 | G | A |
| scaffold49652__185602__SNP | 185602 | A | C |
| scaffold49652__193012__SNP | 193012 | A | G |
| scaffold49652__196752__SNP | 196752 | T | C |
| scaffold49652__197492__SNP | 197492 | G | A |
| scaffold49652__197499__SNP | 197499 | T | C |
| scaffold49652__197616__SNP | 197616 | G | A |
| scaffold49652__199871__SNP | 199871 | G | A |
| scaffold49652__200228__SNP | 200228 | A | G |
| scaffold49652__203298__SNP | 203298 | G | A |
| scaffold49652__205904__SNP | 205904 | G | T |
| scaffold49652__206666__SNP | 206666 | A | G |
| scaffold49652__208874__SNP | 208874 | C | T |
| scaffold49652__215183__SNP | 215183 | G | A |
| scaffold49652__215265__SNP | 215265 | A | G |
| scaffold49652__216104__SNP | 216104 | G | A |
| scaffold49652__217181__SNP | 217181 | C | T |
| scaffold49652__218571__SNP | 218571 | A | G |
| scaffold49652__219511__SNP | 219511 | T | C |
| scaffold49652__219529__SNP | 219529 | A | G |
| scaffold49652__219575__SNP | 219575 | C | T |
| scaffold49652__219952__SNP | 219952 | G | A |
| scaffold49652__219953__SNP | 219953 | G | A |
| scaffold49652__219963__SNP | 219963 | T | C |
| scaffold49652__220068__SNP | 220068 | C | A |
| scaffold49652__220176__SNP | 220176 | G | T |
| scaffold49652__221463__SNP | 221463 | C | A |
| scaffold49652__222090__SNP | 222090 | G | A |
| scaffold49652__222099__SNP | 222099 | A | G |
| scaffold49652__222102__SNP | 222102 | A | G |
| scaffold49652__222109__SNP | 222109 | G | A |
| scaffold49652__222189__SNP | 222189 | G | A |
| scaffold49652__222205__SNP | 222205 | C | A |
| scaffold49652__222306__SNP | 222306 | C | T |
| scaffold49652__222440__SNP | 222440 | T | A |
| scaffold49652__222903__SNP | 222903 | C | A |
| scaffold49652__222937__SNP | 222937 | T | C |
| scaffold49652__222944__SNP | 222944 | G | A |
| scaffold49652__223876__SNP | 223876 | C | G |
| scaffold49652__223933__SNP | 223933 | C | G |
| scaffold49652__224422__SNP | 224422 | C | T |
| scaffold49652__225283__SNP | 225283 | G | C |
| scaffold49652__225922__SNP | 225922 | T | C |
| scaffold49652__226654__SNP | 226654 | G | C |
| scaffold49652__227737__SNP | 227737 | T | C |
| scaffold49652__228474__SNP | 228474 | A | G |
| scaffold49652__229075__SNP | 229075 | A | G |
| scaffold49652__230244__SNP | 230244 | T | C |
| scaffold49652__230528__SNP | 230528 | G | T |
| scaffold49652__238854__SNP | 238854 | C | G |
| scaffold49652__240022__SNP | 240022 | C | T |
| scaffold49652__240304__SNP | 240304 | C | T |
| scaffold49652__250663__SNP | 250663 | G | A |
| scaffold49652__251169__SNP | 251169 | A | G |
| scaffold49652__251304__SNP | 251304 | A | G |
| scaffold49652__252410__SNP | 252410 | T | C |
| scaffold49652__266259__SNP | 266259 | G | A |
| scaffold49652__269948__SNP | 269948 | G | A |
| scaffold49652__276433__SNP | 276433 | A | G |
| scaffold49652__279239__SNP | 279239 | T | A |
| scaffold49652__287492__SNP | 287492 | C | A |
| scaffold49652__287493__SNP | 287493 | A | C |
| scaffold49652__287554__SNP | 287554 | A | C |

TABLE 2-continued

SNP Positions within SEQ ID NO: 2 that are associated with increased resistance to ASR

| SNP Name | Position | Favorable Allele (Rust Resistant) | Unfavorable Allele (Rust Susceptible) |
|---|---|---|---|
| scaffold49652__289763__SNP | 289763 | A | T |
| scaffold49652__291185__SNP | 291185 | G | T |
| scaffold49652__291711__SNP | 291711 | C | T |
| scaffold49652__293833__SNP | 293833 | T | C |
| scaffold49652__293985__SNP | 293985 | A | G |
| scaffold49652__294334__SNP | 294334 | A | T |
| scaffold49652__294339__SNP | 294339 | T | G |
| scaffold49652__294569__SNP | 294569 | A | C |
| scaffold49652__294571__SNP | 294571 | T | A |
| scaffold49652__294582__SNP | 294582 | A | G |
| scaffold49652__296085__SNP | 296085 | A | T |
| scaffold49652__297573__SNP | 297573 | A | T |
| scaffold49652__297580__SNP | 297580 | T | C |
| scaffold49652__297847__SNP | 297847 | A | C |
| scaffold49652__298949__SNP | 298949 | A | C |
| scaffold49652__299350__SNP | 299350 | G | C |
| scaffold49652__300420__SNP | 300420 | G | C |
| scaffold49652__300424__SNP | 300424 | A | G |
| scaffold49652__301124__SNP | 301124 | G | A |
| scaffold49652__301167__SNP | 301167 | T | A |
| scaffold49652__301238__SNP | 301238 | T | A |
| scaffold49652__301913__SNP | 301913 | T | C |
| scaffold49652__302027__SNP | 302027 | A | C |
| scaffold49652__302168__SNP | 302168 | G | C |
| scaffold49652__302219__SNP | 302219 | T | C |
| scaffold49652__302434__SNP | 302434 | G | T |
| scaffold49652__302450__SNP | 302450 | T | A |
| scaffold49652__302683__SNP | 302683 | G | T |
| scaffold49652__303688__SNP | 303688 | T | C |
| scaffold49652__303860__SNP | 303860 | C | A |
| scaffold49652__304361__SNP | 304361 | G | A |
| scaffold49652__304888__SNP | 304888 | A | G |
| scaffold49652__304894__SNP | 304894 | A | G |
| scaffold49652__304927__SNP | 304927 | C | T |
| scaffold49652__304978__SNP | 304978 | T | C |
| scaffold49652__305002__SNP | 305002 | C | T |
| scaffold49652__305014__SNP | 305014 | T | A |
| scaffold49652__305380__SNP | 305380 | T | C |
| scaffold49652__306466__SNP | 306466 | C | G |
| scaffold49652__306538__SNP | 306538 | A | C |
| scaffold49652__308411__SNP | 308411 | C | G |
| scaffold49652__308438__SNP | 308438 | C | A |
| scaffold49652__308835__SNP | 308835 | C | T |
| scaffold49652__308836__SNP | 308836 | A | G |
| scaffold49652__308930__SNP | 308930 | T | C |
| scaffold49652__309042__SNP | 309042 | A | G |
| scaffold49652__309062__SNP | 309062 | A | C |
| scaffold49652__309971__SNP | 309971 | A | C |
| scaffold49652__310193__SNP | 310193 | A | C |
| scaffold49652__310385__SNP | 310385 | T | A |
| scaffold49652__310406__SNP | 310406 | T | G |
| scaffold49652__311266__SNP | 311266 | C | A |
| scaffold49652__311330__SNP | 311330 | T | C |
| scaffold49652__311522__SNP | 311522 | T | C |
| scaffold49652__311789__SNP | 311789 | A | G |
| scaffold49652__311935__SNP | 311935 | G | A |
| scaffold49652__311938__SNP | 311938 | T | C |
| scaffold49652__312257__SNP | 312257 | G | A |
| scaffold49652__312289__SNP | 312289 | T | C |
| scaffold49652__313499__SNP | 313499 | C | G |
| scaffold49652__313588__SNP | 313588 | C | T |
| scaffold49652__314672__SNP | 314672 | A | G |
| scaffold49652__315497__SNP | 315497 | A | G |
| scaffold49652__315498__SNP | 315498 | A | G |
| scaffold49652__315527__SNP | 315527 | G | A |
| scaffold49652__316007__SNP | 316007 | G | T |
| scaffold49652__316309__SNP | 316309 | G | A |
| scaffold49652__316425__SNP | 316425 | T | G |
| scaffold49652__317362__SNP | 317362 | C | G |
| scaffold49652__318444__SNP | 318444 | A | T |
| scaffold49652__318600__SNP | 318600 | G | T |
| scaffold49652__318645__SNP | 318645 | C | T |

TABLE 2-continued

SNP Positions within SEQ ID NO: 2 that are associated with increased resistance to ASR

| SNP Name | Position | Favorable Allele (Rust Resistant) | Unfavorable Allele (Rust Susceptible) |
|---|---|---|---|
| scaffold49652_318669_SNP | 318669 | T | C |
| scaffold49652_318696_SNP | 318696 | C | G |
| scaffold49652_319094_SNP | 319094 | T | C |
| scaffold49652_319397_SNP | 319397 | C | A |
| scaffold49652_319704_SNP | 319704 | G | A |
| scaffold49652_320373_SNP | 320373 | A | G |
| scaffold49652_321853_SNP | 321853 | T | A |
| scaffold49652_325751_SNP | 325751 | T | A |
| scaffold49652_326774_SNP | 326774 | G | C |
| scaffold49652_327926_SNP | 327926 | A | C |
| scaffold49652_327964_SNP | 327964 | G | T |
| scaffold49652_328344_SNP | 328344 | C | T |
| scaffold49652_328346_SNP | 328346 | T | G |
| scaffold49652_328748_SNP | 328748 | G | A |
| scaffold49652_329021_SNP | 329021 | T | G |
| scaffold49652_329291_SNP | 329291 | G | T |
| scaffold49652_329315_SNP | 329315 | A | C |
| scaffold49652_329561_SNP | 329561 | G | A |
| scaffold49652_329660_SNP | 329660 | A | T |
| scaffold49652_329903_SNP | 329903 | G | C |
| scaffold49652_330206_SNP | 330206 | C | T |
| scaffold49652_330224_SNP | 330224 | A | T |
| scaffold49652_330593_SNP | 330593 | A | G |
| scaffold49652_331196_SNP | 331196 | T | C |
| scaffold49652_333099_SNP | 333099 | G | A |
| scaffold49652_333133_SNP | 333133 | T | C |
| scaffold49652_333359_SNP | 333359 | T | G |
| scaffold49652_333413_SNP | 333413 | C | T |
| scaffold49652_333453_SNP | 333453 | G | C |
| scaffold49652_334022_SNP | 334022 | C | A |
| scaffold49652_334587_SNP | 334587 | T | C |
| scaffold49652_335926_SNP | 335926 | T | C |
| scaffold49652_336373_SNP | 336373 | C | T |
| scaffold49652_336392_SNP | 336392 | T | C |
| scaffold49652_336422_SNP | 336422 | G | C |
| scaffold49652_336783_SNP | 336783 | C | G |
| scaffold49652_336839_SNP | 336839 | G | T |
| scaffold49652_337703_SNP | 337703 | A | G |
| scaffold49652_337918_SNP | 337918 | A | G |
| scaffold49652_338070_SNP | 338070 | T | G |
| scaffold49652_339859_SNP | 339859 | C | T |
| scaffold49652_340107_SNP | 340107 | A | G |
| scaffold49652_340120_SNP | 340120 | G | C |
| scaffold49652_340174_SNP | 340174 | C | T |
| scaffold49652_341049_SNP | 341049 | G | T |
| scaffold49652_341264_SNP | 341264 | C | A |
| scaffold49652_345335_SNP | 345335 | A | G |
| scaffold49652_345365_SNP | 345365 | A | T |
| scaffold49652_345374_SNP | 345374 | A | G |
| scaffold49652_345484_SNP | 345484 | C | T |
| scaffold49652_345554_SNP | 345554 | G | A |
| scaffold49652_345575_SNP | 345575 | T | C |
| scaffold49652_345600_SNP | 345600 | A | C |
| scaffold49652_347890_SNP | 347890 | A | T |
| scaffold49652_347970_SNP | 347970 | T | G |
| scaffold49652_347974_SNP | 347974 | G | A |
| scaffold49652_347979_SNP | 347979 | G | A |
| scaffold49652_347996_SNP | 347996 | G | T |
| scaffold49652_349930_SNP | 349930 | C | T |
| scaffold49652_349948_SNP | 349948 | T | G |
| scaffold49652_351367_SNP | 351367 | T | A |
| scaffold49652_351556_SNP | 351556 | T | C |
| scaffold49652_351856_SNP | 351856 | G | A |
| scaffold49652_352037_SNP | 352037 | G | A |
| scaffold49652_353477_SNP | 353477 | C | T |
| scaffold49652_353505_SNP | 353505 | G | A |
| scaffold49652_354088_SNP | 354088 | T | C |
| scaffold49652_354298_SNP | 354298 | A | C |
| scaffold49652_354374_SNP | 354374 | C | T |
| scaffold49652_355975_SNP | 355975 | G | T |
| scaffold49652_356979_SNP | 356979 | G | A |
| scaffold49652_358191_SNP | 358191 | A | G |

TABLE 2-continued

SNP Positions within SEQ ID NO: 2 that are associated with increased resistance to ASR

| SNP Name | Position | Favorable Allele (Rust Resistant) | Unfavorable Allele (Rust Susceptible) |
|---|---|---|---|
| scaffold49652_360296_SNP | 360296 | T | C |
| scaffold49652_360986_SNP | 360986 | C | A |
| scaffold49652_362062_SNP | 362062 | G | A |
| scaffold49652_365432_SNP | 365432 | A | G |
| scaffold49652_366972_SNP | 366972 | C | T |
| scaffold49652_367235_SNP | 367235 | C | T |
| scaffold49652_374498_SNP | 374498 | C | A |
| scaffold49652_376756_SNP | 376756 | T | G |
| scaffold49652_381774_SNP | 381774 | G | C |
| scaffold49652_400199_SNP | 400199 | A | G |
| scaffold49652_400786_SNP | 400786 | C | T |
| scaffold49652_402643_SNP | 402643 | T | A |
| scaffold49652_403055_SNP | 403055 | A | T |
| scaffold49652_403379_SNP | 403379 | C | T |
| scaffold49652_403705_SNP | 403705 | C | T |
| scaffold49652_404201_SNP | 404201 | G | A |
| scaffold49652_404905_SNP | 404905 | G | C |
| scaffold49652_409753_SNP | 409753 | C | A |
| scaffold49652_411457_SNP | 411457 | A | C |
| scaffold49652_414901_SNP | 414901 | C | G |
| scaffold49652_416379_SNP | 416379 | G | A |
| scaffold49652_418210_SNP | 418210 | A | G |
| scaffold49652_433538_SNP | 433538 | C | T |
| scaffold49652_440036_SNP | 440036 | T | C |
| scaffold49652_449338_SNP | 449338 | A | T |
| scaffold49652_449339_SNP | 449339 | A | T |
| scaffold49652_453711_SNP | 453711 | G | A |
| scaffold49652_458506_SNP | 458506 | A | G |
| scaffold49652_467749_SNP | 467749 | A | T |
| scaffold49652_468384_SNP | 468384 | C | T |
| scaffold49652_474262_SNP | 474262 | G | A |
| scaffold49652_481700_SNP | 481700 | T | A |
| scaffold49652_481980_SNP | 481980 | A | G |
| scaffold49652_482017_SNP | 482017 | T | A |
| scaffold49652_482729_SNP | 482729 | C | A |
| scaffold49652_483114_SNP | 483114 | T | C |
| scaffold49652_483134_SNP | 483134 | A | T |
| scaffold49652_483238_SNP | 483238 | C | G |
| scaffold49652_483844_SNP | 483844 | T | C |
| scaffold49652_488135_SNP | 488135 | T | C |
| scaffold49652_489130_SNP | 489130 | C | A |
| scaffold49652_489402_SNP | 489402 | A | G |
| scaffold49652_490245_SNP | 490245 | G | A |
| scaffold49652_490567_SNP | 490567 | C | G |
| scaffold49652_490679_SNP | 490679 | A | G |
| scaffold49652_490686_SNP | 490686 | G | A |
| scaffold49652_490712_SNP | 490712 | A | G |
| scaffold49652_499896_SNP | 499896 | C | A |
| scaffold49652_500864_SNP | 500864 | G | A |
| scaffold49652_503510_SNP | 503510 | G | C |
| scaffold49652_504360_SNP | 504360 | A | G |
| scaffold49652_505008_SNP | 505008 | C | T |
| scaffold49652_505051_SNP | 505051 | A | T |
| scaffold49652_510409_SNP | 510409 | T | A |
| scaffold49652_519990_SNP | 519990 | C | A |
| scaffold49652_523968_SNP | 523968 | T | C |
| scaffold49652_531222_SNP | 531222 | A | G |
| scaffold49652_540357_SNP | 540357 | T | A |
| scaffold49652_551070_SNP | 551070 | G | A |
| scaffold49652_559257_SNP | 559257 | C | T |
| scaffold49652_559979_SNP | 559979 | A | G |
| scaffold49652_561291_SNP | 561291 | A | G |
| scaffold49652_567130_SNP | 567130 | A | T |
| scaffold49652_570015_SNP | 570015 | G | A |
| scaffold49652_570373_SNP | 570373 | C | A |
| scaffold49652_582494_SNP | 582494 | A | T |
| scaffold49652_586011_SNP | 586011 | T | A |
| scaffold49652_586012_SNP | 586012 | T | A |
| scaffold49652_591947_SNP | 591947 | G | A |
| scaffold49652_592239_SNP | 592239 | A | T |
| scaffold49652_594778_SNP | 594778 | T | G |
| scaffold49652_596868_SNP | 596868 | G | T |

TABLE 2-continued

SNP Positions within SEQ ID NO: 2 that are associated with increased resistance to ASR

| SNP Name | Position | Favorable Allele (Rust Resistant) | Unfavorable Allele (Rust Susceptible) |
|---|---|---|---|
| scaffold49652__599890__SNP | 599890 | T | C |
| scaffold49652__602894__SNP | 602894 | C | T |
| scaffold49652__608314__SNP | 608314 | A | T |
| scaffold49652__608649__SNP | 608649 | A | G |
| scaffold49652__609274__SNP | 609274 | C | G |
| scaffold49652__610620__SNP | 610620 | A | G |
| scaffold49652__610745__SNP | 610745 | G | A |
| scaffold49652__610785__SNP | 610785 | C | T |
| scaffold49652__610978__SNP | 610978 | A | G |
| scaffold49652__611812__SNP | 611812 | G | C |
| scaffold49652__612916__SNP | 612916 | A | T |
| scaffold49652__615662__SNP | 615662 | G | T |
| scaffold49652__615802__SNP | 615802 | T | A |
| scaffold49652__616179__SNP | 616179 | G | A |
| scaffold49652__619723__SNP | 619723 | A | G |
| scaffold49652__623226__SNP | 623226 | T | C |
| scaffold49652__623262__SNP | 623262 | G | A |
| scaffold49652__623316__SNP | 623316 | T | G |
| scaffold49652__623971__SNP | 623971 | A | G |
| scaffold49652__625797__SNP | 625797 | A | T |
| scaffold49652__626033__SNP | 626033 | C | G |
| scaffold49652__626576__SNP | 626576 | C | T |
| scaffold49652__636530__SNP | 636530 | T | C |
| scaffold49652__636591__SNP | 636591 | G | A |
| scaffold49652__640814__SNP | 640814 | T | A |
| scaffold49652__641023__SNP | 641023 | A | G |
| scaffold49652__642961__SNP | 642961 | C | G |
| scaffold49652__645742__SNP | 645742 | T | A |
| scaffold49652__649825__SNP | 649825 | G | A |
| scaffold49652__650622__SNP | 650622 | T | A |
| scaffold49652__650911__SNP | 650911 | G | A |
| scaffold49652__652582__SNP | 652582 | A | G |
| scaffold49652__653269__SNP | 653269 | A | T |
| scaffold49652__655875__SNP | 655875 | T | G |
| scaffold49652__655945__SNP | 655945 | A | G |
| scaffold49652__657235__SNP | 657235 | G | A |
| scaffold49652__657572__SNP | 657572 | C | T |
| scaffold49652__657890__SNP | 657890 | A | G |
| scaffold49652__660730__SNP | 660730 | A | T |
| scaffold49652__661085__SNP | 661085 | A | G |
| scaffold49652__661178__SNP | 661178 | A | T |
| scaffold49652__664050__SNP | 664050 | C | A |
| scaffold49652__671483__SNP | 671483 | A | G |
| scaffold49652__672897__SNP | 672897 | G | A |
| scaffold49652__675995__SNP | 675995 | A | G |
| scaffold49652__677013__SNP | 677013 | T | C |
| scaffold49652__677538__SNP | 677538 | C | T |
| scaffold49652__677686__SNP | 677686 | T | G |
| scaffold49652__677824__SNP | 677824 | G | A |
| scaffold49652__678252__SNP | 678252 | T | C |
| scaffold49652__678661__SNP | 678661 | G | A |
| scaffold49652__680010__SNP | 680010 | G | T |
| scaffold49652__680049__SNP | 680049 | C | A |
| scaffold49652__680102__SNP | 680102 | T | C |
| scaffold49652__681611__SNP | 681611 | C | T |
| scaffold49652__681834__SNP | 681834 | T | C |
| scaffold49652__683219__SNP | 683219 | A | C |
| scaffold49652__683499__SNP | 683499 | A | G |
| scaffold49652__685162__SNP | 685162 | A | T |
| scaffold49652__686427__SNP | 686427 | C | T |
| scaffold49652__686466__SNP | 686466 | G | A |
| scaffold49652__686575__SNP | 686575 | G | A |
| scaffold49652__690420__SNP | 690420 | G | A |
| scaffold49652__691001__SNP | 691001 | C | T |
| scaffold49652__691511__SNP | 691511 | G | A |
| scaffold49652__691562__SNP | 691562 | G | A |
| scaffold49652__694449__SNP | 694449 | T | G |
| scaffold49652__698078__SNP | 698078 | C | T |
| scaffold49652__698468__SNP | 698468 | C | T |
| scaffold49652__699891__SNP | 699891 | T | A |
| scaffold49652__701425__SNP | 701425 | C | T |
| scaffold49652__701847__SNP | 701847 | G | A |
| scaffold49652__702517__SNP | 702517 | T | G |
| scaffold49652__703686__SNP | 703686 | C | A |
| scaffold49652__704754__SNP | 704754 | T | A |
| scaffold49652__704765__SNP | 704765 | G | T |
| scaffold49652__707130__SNP | 707130 | C | A |
| scaffold49652__707457__SNP | 707457 | C | T |
| scaffold49652__708022__SNP | 708022 | C | T |
| scaffold49652__708235__SNP | 708235 | C | T |
| scaffold49652__711647__SNP | 711647 | C | G |
| scaffold49652__712665__SNP | 712665 | A | G |
| scaffold49652__718466__SNP | 718466 | T | G |
| scaffold49652__721386__SNP | 721386 | G | T |
| scaffold49652__722079__SNP | 722079 | G | A |
| scaffold49652__722931__SNP | 722931 | T | A |
| scaffold49652__724109__SNP | 724109 | C | A |
| scaffold49652__728106__SNP | 728106 | C | T |
| scaffold49652__729138__SNP | 729138 | A | T |
| scaffold49652__729202__SNP | 729202 | A | G |
| scaffold49652__731436__SNP | 731436 | C | G |
| scaffold49652__731484__SNP | 731484 | T | A |
| scaffold49652__731952__SNP | 731952 | C | T |
| scaffold49652__731997__SNP | 731997 | G | A |
| scaffold49652__732184__SNP | 732184 | C | T |
| scaffold49652__732236__SNP | 732236 | G | A |
| scaffold49652__732255__SNP | 732255 | T | C |
| scaffold49652__732256__SNP | 732256 | C | T |
| scaffold49652__732274__SNP | 732274 | A | G |
| scaffold49652__732285__SNP | 732285 | C | T |
| scaffold49652__732447__SNP | 732447 | T | C |
| scaffold49652__732546__SNP | 732546 | G | A |
| scaffold49652__732958__SNP | 732958 | T | C |
| scaffold49652__733147__SNP | 733147 | A | G |
| scaffold49652__733195__SNP | 733195 | C | A |
| scaffold49652__733199__SNP | 733199 | A | G |
| scaffold49652__733207__SNP | 733207 | A | G |
| scaffold49652__733321__SNP | 733321 | T | C |
| scaffold49652__733978__SNP | 733978 | A | G |
| scaffold49652__734856__SNP | 734856 | G | T |
| scaffold49652__735577__SNP | 735577 | C | T |
| scaffold49652__736430__SNP | 736430 | A | G |
| scaffold49652__737005__SNP | 737005 | C | T |
| scaffold49652__737576__SNP | 737576 | C | G |
| scaffold49652__740567__SNP | 740567 | C | T |
| scaffold49652__743622__SNP | 743622 | C | T |
| scaffold49652__748166__SNP | 748166 | T | A |
| scaffold49652__748594__SNP | 748594 | C | T |
| scaffold49652__762558__SNP | 762558 | T | C |
| scaffold49652__763277__SNP | 763277 | A | G |
| scaffold49652__767299__SNP | 767299 | G | T |
| scaffold49652__769480__SNP | 769480 | C | T |
| scaffold49652__769644__SNP | 769644 | A | G |
| scaffold49652__778065__SNP | 778065 | A | G |
| scaffold49652__780345__SNP | 780345 | T | A |
| scaffold49652__782788__SNP | 782788 | C | T |
| scaffold49652__783110__SNP | 783110 | C | T |
| scaffold49652__783990__SNP | 783990 | C | T |
| scaffold49652__787357__SNP | 787357 | T | C |
| scaffold49652__787629__SNP | 787629 | A | G |
| scaffold49652__790141__SNP | 790141 | G | A |
| scaffold49652__794383__SNP | 794383 | A | C |
| scaffold49652__794508__SNP | 794508 | G | A |
| scaffold49652__796408__SNP | 796408 | A | T |
| scaffold49652__796483__SNP | 796483 | C | T |
| scaffold49652__797153__SNP | 797153 | T | C |
| scaffold49652__797737__SNP | 797737 | A | T |
| scaffold49652__798218__SNP | 798218 | G | T |
| scaffold49652__798222__SNP | 798222 | T | A |
| scaffold49652__798260__SNP | 798260 | T | A |
| scaffold49652__800544__SNP | 800544 | T | C |
| scaffold49652__804203__SNP | 804203 | G | A |
| scaffold49652__805118__SNP | 805118 | T | C |
| scaffold49652__805150__SNP | 805150 | A | G |

TABLE 2-continued

SNP Positions within SEQ ID NO: 2 that are associated with increased resistance to ASR

| SNP Name | Position | Favorable Allele (Rust Resistant) | Unfavorable Allele (Rust Susceptible) |
|---|---|---|---|
| scaffold49652__805244__SNP | 805244 | G | A |
| scaffold49652__805264__SNP | 805264 | T | C |
| scaffold49652__805452__SNP | 805452 | T | C |
| scaffold49652__805642__SNP | 805642 | G | A |
| scaffold49652__805649__SNP | 805649 | G | A |
| scaffold49652__805890__SNP | 805890 | T | G |
| scaffold49652__807572__SNP | 807572 | C | T |
| scaffold49652__807576__SNP | 807576 | G | T |
| scaffold49652__808401__SNP | 808401 | A | T |
| scaffold49652__809462__SNP | 809462 | T | C |
| scaffold49652__817467__SNP | 817467 | A | G |
| scaffold49652__818447__SNP | 818447 | G | A |
| scaffold49652__818500__SNP | 818500 | G | A |
| scaffold49652__820447__SNP | 820447 | G | A |
| scaffold49652__821025__SNP | 821025 | T | C |
| scaffold49652__821660__SNP | 821660 | T | C |
| scaffold49652__821725__SNP | 821725 | C | T |
| scaffold49652__821732__SNP | 821732 | T | C |
| scaffold49652__821777__SNP | 821777 | A | G |
| scaffold49652__821778__SNP | 821778 | G | A |
| scaffold49652__822296__SNP | 822296 | A | T |
| scaffold49652__822527__SNP | 822527 | C | A |
| scaffold49652__824023__SNP | 824023 | T | C |
| scaffold49652__824548__SNP | 824548 | C | T |
| scaffold49652__827798__SNP | 827798 | C | G |
| scaffold49652__832297__SNP | 832297 | T | A |
| scaffold49652__833104__SNP | 833104 | A | T |
| scaffold49652__833445__SNP | 833445 | A | G |
| scaffold49652__834051__SNP | 834051 | G | T |
| scaffold49652__840395__SNP | 840395 | G | A |
| scaffold49652__843919__SNP | 843919 | T | C |
| scaffold49652__844263__SNP | 844263 | T | G |
| scaffold49652__849536__SNP | 849536 | G | C |
| scaffold49652__853686__SNP | 853686 | G | A |
| scaffold49652__853931__SNP | 853931 | G | A |
| scaffold49652__854014__SNP | 854014 | T | C |
| scaffold49652__854088__SNP | 854088 | G | T |
| scaffold49652__855619__SNP | 855619 | T | C |
| scaffold49652__860176__SNP | 860176 | A | G |
| scaffold49652__860721__SNP | 860721 | C | T |
| scaffold49652__866753__SNP | 866753 | T | C |
| scaffold49652__868488__SNP | 868488 | T | A |
| scaffold49652__875802__SNP | 875802 | G | C |
| scaffold49652__876164__SNP | 876164 | A | G |
| scaffold49652__879195__SNP | 879195 | T | C |
| scaffold49652__879309__SNP | 879309 | A | G |
| scaffold49652__881100__SNP | 881100 | G | A |
| scaffold49652__881391__SNP | 881391 | C | T |
| scaffold49652__882276__SNP | 882276 | C | T |
| scaffold49652__883184__SNP | 883184 | G | A |
| scaffold49652__883722__SNP | 883722 | A | T |
| scaffold49652__883731__SNP | 883731 | A | T |
| scaffold49652__883732__SNP | 883732 | T | C |
| scaffold49652__883744__SNP | 883744 | G | A |
| scaffold49652__883848__SNP | 883848 | G | A |
| scaffold49652__883854__SNP | 883854 | T | C |
| scaffold49652__883889__SNP | 883889 | G | A |
| scaffold49652__884086__SNP | 884086 | C | A |
| scaffold49652__884823__SNP | 884823 | C | G |
| scaffold49652__885116__SNP | 885116 | T | G |
| scaffold49652__885850__SNP | 885850 | A | G |
| scaffold49652__885852__SNP | 885852 | G | C |
| scaffold49652__885862__SNP | 885862 | A | G |
| scaffold49652__886294__SNP | 886294 | G | C |
| scaffold49652__886462__SNP | 886462 | C | T |
| scaffold49652__886996__SNP | 886996 | G | A |
| scaffold49652__887437__SNP | 887437 | A | T |
| scaffold49652__888216__SNP | 888216 | G | A |
| scaffold49652__888454__SNP | 888454 | A | G |
| scaffold49652__888727__SNP | 888727 | T | A |
| scaffold49652__889850__SNP | 889850 | T | A |
| scaffold49652__891032__SNP | 891032 | G | C |

TABLE 2-continued

SNP Positions within SEQ ID NO: 2 that are associated with increased resistance to ASR

| SNP Name | Position | Favorable Allele (Rust Resistant) | Unfavorable Allele (Rust Susceptible) |
|---|---|---|---|
| scaffold49652__892594__SNP | 892594 | A | G |
| scaffold49652__893679__SNP | 893679 | G | A |
| scaffold49652__893906__SNP | 893906 | G | A |
| scaffold49652__896197__SNP | 896197 | G | A |
| scaffold49652__897517__SNP | 897517 | A | C |
| scaffold49652__897932__SNP | 897932 | G | C |
| scaffold49652__898111__SNP | 898111 | C | A |
| scaffold49652__898112__SNP | 898112 | G | A |
| scaffold49652__898655__SNP | 898655 | T | C |
| scaffold49652__898950__SNP | 898950 | T | C |
| scaffold49652__899021__SNP | 899021 | G | A |
| scaffold49652__899148__SNP | 899148 | A | G |
| scaffold49652__899227__SNP | 899227 | G | T |
| scaffold49652__899335__SNP | 899335 | A | T |
| scaffold49652__899543__SNP | 899543 | T | G |
| scaffold49652__899625__SNP | 899625 | G | T |
| scaffold49652__900624__SNP | 900624 | C | T |
| scaffold49652__901177__SNP | 901177 | G | A |
| scaffold49652__901340__SNP | 901340 | T | C |
| scaffold49652__902549__SNP | 902549 | C | A |
| scaffold49652__903454__SNP | 903454 | T | C |
| scaffold49652__905830__SNP | 905830 | C | T |
| scaffold49652__905860__SNP | 905860 | G | A |
| scaffold49652__906056__SNP | 906056 | T | A |
| scaffold49652__906604__SNP | 906604 | A | G |
| scaffold49652__908695__SNP | 908695 | C | T |
| scaffold49652__909403__SNP | 909403 | C | T |
| scaffold49652__911183__SNP | 911183 | T | C |
| scaffold49652__911607__SNP | 911607 | A | G |
| scaffold49652__911780__SNP | 911780 | T | C |
| scaffold49652__920299__SNP | 920299 | A | G |
| scaffold49652__923770__SNP | 923770 | C | A |
| scaffold49652__924722__SNP | 924722 | G | A |
| scaffold49652__926562__SNP | 926562 | A | T |
| scaffold49652__927214__SNP | 927214 | G | A |
| scaffold49652__943083__SNP | 943083 | T | G |
| scaffold49652__948039__SNP | 948039 | G | A |
| scaffold49652__950135__SNP | 950135 | C | T |
| scaffold49652__951616__SNP | 951616 | C | A |
| scaffold49652__957995__SNP | 957995 | C | T |
| scaffold49652__958508__SNP | 958508 | A | C |
| scaffold49652__967938__SNP | 967938 | C | A |
| scaffold49652__968437__SNP | 968437 | T | C |
| scaffold49652__974414__SNP | 974414 | C | A |
| scaffold49652__979062__SNP | 979062 | C | T |
| scaffold49652__981337__SNP | 981337 | G | A |
| scaffold49652__982834__SNP | 982834 | G | A |
| scaffold49652__998825__SNP | 998825 | T | G |
| scaffold49652__1012367__SNP | 1012367 | A | T |
| scaffold49652__1019615__SNP | 1019615 | T | C |
| scaffold49652__1025554__SNP | 1025554 | A | G |
| scaffold49652__1026033__SNP | 1026033 | A | G |
| scaffold49652__1033935__SNP | 1033935 | G | A |
| scaffold49652__1035086__SNP | 1035086 | A | G |
| scaffold49652__1039213__SNP | 1039213 | T | A |
| scaffold49652__1040045__SNP | 1040045 | A | C |
| scaffold49652__1050328__SNP | 1050328 | C | T |
| scaffold49652__1060132__SNP | 1060132 | A | T |
| scaffold49652__1065677__SNP | 1065677 | G | A |
| scaffold49652__1065813__SNP | 1065813 | G | A |
| scaffold49652__1068136__SNP | 1068136 | T | C |
| scaffold49652__1077026__SNP | 1077026 | G | C |
| scaffold49652__1079091__SNP | 1079091 | A | G |
| scaffold49652__1089823__SNP | 1089823 | T | C |
| scaffold49652__1090444__SNP | 1090444 | A | G |
| scaffold49652__1091054__SNP | 1091054 | T | C |
| scaffold49652__1094373__SNP | 1094373 | G | T |
| scaffold49652__1094567__SNP | 1094567 | T | A |
| scaffold49652__1095586__SNP | 1095586 | G | T |
| scaffold49652__1096330__SNP | 1096330 | C | G |
| scaffold49652__1096345__SNP | 1096345 | C | T |
| scaffold49652__1097283__SNP | 1097283 | T | A |

TABLE 2-continued

SNP Positions within SEQ ID NO: 2 that are associated with increased resistance to ASR

| SNP Name | Position | Favorable Allele (Rust Resistant) | Unfavorable Allele (Rust Susceptible) |
|---|---|---|---|
| scaffold49652__1098183__SNP | 1098183 | T | C |
| scaffold49652__1098188__SNP | 1098188 | T | C |
| scaffold49652__1098428__SNP | 1098428 | G | A |
| scaffold49652__1098776__SNP | 1098776 | G | A |
| scaffold49652__1098789__SNP | 1098789 | G | A |
| scaffold49652__1099064__SNP | 1099064 | G | C |
| scaffold49652__1099104__SNP | 1099104 | A | G |
| scaffold49652__1099204__SNP | 1099204 | C | G |
| scaffold49652__1099381__SNP | 1099381 | C | A |
| scaffold49652__1101177__SNP | 1101177 | G | A |
| scaffold49652__1105870__SNP | 1105870 | G | A |
| scaffold49652__1106259__SNP | 1106259 | T | C |
| scaffold49652__1106268__SNP | 1106268 | T | G |
| scaffold49652__1107450__SNP | 1107450 | A | T |
| scaffold49652__1111008__SNP | 1111008 | C | A |
| scaffold49652__1113214__SNP | 1113214 | T | G |
| scaffold49652__1115505__SNP | 1115505 | C | T |
| scaffold49652__1115579__SNP | 1115579 | G | A |
| scaffold49652__1117895__SNP | 1117895 | C | A |
| scaffold49652__1118621__SNP | 1118621 | A | G |
| scaffold49652__1119640__SNP | 1119640 | A | G |
| scaffold49652__1120313__SNP | 1120313 | T | C |
| scaffold49652__1120591__SNP | 1120591 | G | A |
| scaffold49652__1120734__SNP | 1120734 | T | C |
| scaffold49652__1120836__SNP | 1120836 | G | A |
| scaffold49652__1121086__SNP | 1121086 | A | G |
| scaffold49652__1121309__SNP | 1121309 | T | C |
| scaffold49652__1122559__SNP | 1122559 | A | T |
| scaffold49652__1123165__SNP | 1123165 | A | C |
| scaffold49652__1124824__SNP | 1124824 | A | G |
| scaffold49652__1125027__SNP | 1125027 | C | G |
| scaffold49652__1125210__SNP | 1125210 | T | C |
| scaffold49652__1125225__SNP | 1125225 | T | C |
| scaffold49652__1125331__SNP | 1125331 | A | G |
| scaffold49652__1125495__SNP | 1125495 | C | T |
| scaffold49652__1125680__SNP | 1125680 | C | G |
| scaffold49652__1126353__SNP | 1126353 | T | A |
| scaffold49652__1126379__SNP | 1126379 | A | T |
| scaffold49652__1126987__SNP | 1126987 | G | T |
| scaffold49652__1128639__SNP | 1128639 | T | G |
| scaffold49652__1130083__SNP | 1130083 | A | T |
| scaffold49652__1132532__SNP | 1132532 | T | C |
| scaffold49652__1133562__SNP | 1133562 | C | A |
| scaffold49652__1138025__SNP | 1138025 | A | G |
| scaffold49652__1138114__SNP | 1138114 | A | G |
| scaffold49652__1138128__SNP | 1138128 | T | C |
| scaffold49652__1138158__SNP | 1138158 | C | A |
| scaffold49652__1138340__SNP | 1138340 | A | C |
| scaffold49652__1138444__SNP | 1138444 | A | T |
| scaffold49652__1138486__SNP | 1138486 | G | T |
| scaffold49652__1138569__SNP | 1138569 | C | T |
| scaffold49652__1138892__SNP | 1138892 | G | A |
| scaffold49652__1138915__SNP | 1138915 | T | C |
| scaffold49652__1138942__SNP | 1138942 | T | G |
| scaffold49652__1138948__SNP | 1138948 | A | G |
| scaffold49652__1138972__SNP | 1138972 | T | C |
| scaffold49652__1143904__SNP | 1143904 | T | A |
| scaffold49652__1145401__SNP | 1145401 | G | A |
| scaffold49652__1145644__SNP | 1145644 | A | G |
| scaffold49652__1147593__SNP | 1147593 | T | C |
| scaffold49652__1149884__SNP | 1149884 | T | G |
| scaffold49652__1156135__SNP | 1156135 | C | T |
| scaffold49652__1156749__SNP | 1156749 | T | A |
| scaffold49652__1160712__SNP | 1160712 | T | C |
| scaffold49652__1161165__SNP | 1161165 | A | G |
| scaffold49652__1161234__SNP | 1161234 | A | C |
| scaffold49652__1161762__SNP | 1161762 | C | A |
| scaffold49652__1161951__SNP | 1161951 | C | T |
| scaffold49652__1161984__SNP | 1161984 | C | T |
| scaffold49652__1161994__SNP | 1161994 | C | T |
| scaffold49652__1162010__SNP | 1162010 | T | C |
| scaffold49652__1162087__SNP | 1162087 | T | A |

TABLE 2-continued

SNP Positions within SEQ ID NO: 2 that are associated with increased resistance to ASR

| SNP Name | Position | Favorable Allele (Rust Resistant) | Unfavorable Allele (Rust Susceptible) |
|---|---|---|---|
| scaffold49652__1162117__SNP | 1162117 | C | T |
| scaffold49652__1163148__SNP | 1163148 | G | A |
| scaffold49652__1163858__SNP | 1163858 | C | T |
| scaffold49652__1165241__SNP | 1165241 | A | G |
| scaffold49652__1165983__SNP | 1165983 | G | A |
| scaffold49652__1166553__SNP | 1166553 | T | G |
| scaffold49652__1167905__SNP | 1167905 | G | A |
| scaffold49652__1168063__SNP | 1168063 | G | C |
| scaffold49652__1168123__SNP | 1168123 | C | G |
| scaffold49652__1168144__SNP | 1168144 | G | A |
| scaffold49652__1168354__SNP | 1168354 | G | A |
| scaffold49652__1168382__SNP | 1168382 | A | G |
| scaffold49652__1168402__SNP | 1168402 | C | T |
| scaffold49652__1168415__SNP | 1168415 | C | G |
| scaffold49652__1168591__SNP | 1168591 | A | G |
| scaffold49652__1168598__SNP | 1168598 | T | C |
| scaffold49652__1168676__SNP | 1168676 | A | G |
| scaffold49652__1173678__SNP | 1173678 | C | T |
| scaffold49652__1174439__SNP | 1174439 | G | A |
| scaffold49652__1174739__SNP | 1174739 | T | C |
| scaffold49652__1174886__SNP | 1174886 | G | C |
| scaffold49652__1174957__SNP | 1174957 | T | C |
| scaffold49652__1175137__SNP | 1175137 | T | C |
| scaffold49652__1176562__SNP | 1176562 | T | C |
| scaffold49652__1176601__SNP | 1176601 | A | G |
| scaffold49652__1176744__SNP | 1176744 | A | G |
| scaffold49652__1176824__SNP | 1176824 | T | C |
| scaffold49652__1176918__SNP | 1176918 | T | A |
| scaffold49652__1177011__SNP | 1177011 | T | C |
| scaffold49652__1177564__SNP | 1177564 | C | T |
| scaffold49652__1178504__SNP | 1178504 | G | C |
| scaffold49652__1178688__SNP | 1178688 | G | A |
| scaffold49652__1178845__SNP | 1178845 | T | C |
| scaffold49652__1180897__SNP | 1180897 | G | C |
| scaffold49652__1181191__SNP | 1181191 | C | A |
| scaffold49652__1182912__SNP | 1182912 | A | T |
| scaffold49652__1185115__SNP | 1185115 | A | T |
| scaffold49652__1185149__SNP | 1185149 | G | A |
| scaffold49652__1185173__SNP | 1185173 | T | C |
| scaffold49652__1185483__SNP | 1185483 | A | G |
| scaffold49652__1185495__SNP | 1185495 | A | G |
| scaffold49652__1185519__SNP | 1185519 | C | T |
| scaffold49652__1185550__SNP | 1185550 | C | T |
| scaffold49652__1186445__SNP | 1186445 | T | A |
| scaffold49652__1187282__SNP | 1187282 | T | C |
| scaffold49652__1187782__SNP | 1187782 | C | T |
| scaffold49652__1187807__SNP | 1187807 | G | C |
| scaffold49652__1187833__SNP | 1187833 | A | G |
| scaffold49652__1187867__SNP | 1187867 | C | T |
| scaffold49652__1189518__SNP | 1189518 | A | G |
| scaffold49652__1195840__SNP | 1195840 | C | A |
| scaffold49652__1197189__SNP | 1197189 | G | A |
| scaffold49652__1197456__SNP | 1197456 | A | G |
| scaffold49652__1197501__SNP | 1197501 | T | G |
| scaffold49652__1198166__SNP | 1198166 | A | G |
| scaffold49652__1198222__SNP | 1198222 | A | C |
| scaffold49652__1198541__SNP | 1198541 | A | T |
| scaffold49652__1198622__SNP | 1198622 | A | T |
| scaffold49652__1198980__SNP | 1198980 | C | T |
| scaffold49652__1199022__SNP | 1199022 | T | C |
| scaffold49652__1199906__SNP | 1199906 | A | C |
| scaffold49652__1200447__SNP | 1200447 | A | G |
| scaffold49652__1201288__SNP | 1201288 | T | C |
| scaffold49652__1201696__SNP | 1201696 | C | T |
| scaffold49652__1201765__SNP | 1201765 | T | G |
| scaffold49652__1202166__SNP | 1202166 | C | T |
| scaffold49652__1202941__SNP | 1202941 | T | G |
| scaffold49652__1203263__SNP | 1203263 | C | T |
| scaffold49652__1203989__SNP | 1203989 | G | A |
| scaffold49652__1204064__SNP | 1204064 | G | A |
| scaffold49652__1204476__SNP | 1204476 | T | C |
| scaffold49652__1204977__SNP | 1204977 | A | T |

TABLE 2-continued

SNP Positions within SEQ ID NO: 2 that are associated with increased resistance to ASR

| SNP Name | Position | Favorable Allele (Rust Resistant) | Unfavorable Allele (Rust Susceptible) |
|---|---|---|---|
| scaffold49652__1205446__SNP | 1205446 | A | G |
| scaffold49652__1205510__SNP | 1205510 | A | G |
| scaffold49652__1205721__SNP | 1205721 | A | G |
| scaffold49652__1205762__SNP | 1205762 | T | A |
| scaffold49652__1205797__SNP | 1205797 | A | C |
| scaffold49652__1205865__SNP | 1205865 | T | A |
| scaffold49652__1205903__SNP | 1205903 | A | G |
| scaffold49652__1206037__SNP | 1206037 | T | G |
| scaffold49652__1206135__SNP | 1206135 | A | T |
| scaffold49652__1206148__SNP | 1206148 | T | C |
| scaffold49652__1206150__SNP | 1206150 | A | T |
| scaffold49652__1206333__SNP | 1206333 | A | G |
| scaffold49652__1206709__SNP | 1206709 | A | G |
| scaffold49652__1207012__SNP | 1207012 | G | A |
| scaffold49652__1207348__SNP | 1207348 | A | G |
| scaffold49652__1207374__SNP | 1207374 | C | A |
| scaffold49652__1207430__SNP | 1207430 | T | A |
| scaffold49652__1207492__SNP | 1207492 | G | A |
| scaffold49652__1207513__SNP | 1207513 | C | T |
| scaffold49652__1209506__SNP | 1209506 | G | C |
| scaffold49652__1209518__SNP | 1209518 | T | C |
| scaffold49652__1209544__SNP | 1209544 | A | G |
| scaffold49652__1211198__SNP | 1211198 | T | C |
| scaffold49652__1211200__SNP | 1211200 | T | A |
| scaffold49652__1213512__SNP | 1213512 | T | C |
| scaffold49652__1214402__SNP | 1214402 | G | A |
| scaffold49652__1215784__SNP | 1215784 | T | A |
| scaffold49652__1216069__SNP | 1216069 | G | A |
| scaffold49652__1217956__SNP | 1217956 | T | C |
| scaffold49652__1219424__SNP | 1219424 | G | A |
| scaffold49652__1220232__SNP | 1220232 | A | G |
| scaffold49652__1220233__SNP | 1220233 | C | T |
| scaffold49652__1221995__SNP | 1221995 | C | T |
| scaffold49652__1222469__SNP | 1222469 | T | C |
| scaffold49652__1222668__SNP | 1222668 | T | C |
| scaffold49652__1224176__SNP | 1224176 | A | G |
| scaffold49652__1225431__SNP | 1225431 | A | C |
| scaffold49652__1227822__SNP | 1227822 | G | T |
| scaffold49652__1229006__SNP | 1229006 | G | A |
| scaffold49652__1229064__SNP | 1229064 | T | C |
| scaffold49652__1229326__SNP | 1229326 | C | G |
| scaffold49652__1231604__SNP | 1231604 | T | C |
| scaffold49652__1232591__SNP | 1232591 | G | C |
| scaffold49652__1233258__SNP | 1233258 | T | C |
| scaffold49652__1233269__SNP | 1233269 | G | A |
| scaffold49652__1233617__SNP | 1233617 | G | A |
| scaffold49652__1233633__SNP | 1233633 | T | C |
| scaffold49652__1234922__SNP | 1234922 | A | C |
| scaffold49652__1235646__SNP | 1235646 | T | C |
| scaffold49652__1242212__SNP | 1242212 | T | G |
| scaffold49652__1245007__SNP | 1245007 | C | T |
| scaffold49652__1245040__SNP | 1245040 | A | G |
| scaffold49652__1247417__SNP | 1247417 | A | T |
| scaffold49652__1248388__SNP | 1248388 | A | C |
| scaffold49652__1249563__SNP | 1249563 | C | T |
| scaffold49652__1249616__SNP | 1249616 | G | A |
| scaffold49652__1249760__SNP | 1249760 | G | A |
| scaffold49652__1249992__SNP | 1249992 | G | A |
| scaffold49652__1253370__SNP | 1253370 | T | G |
| scaffold49652__1254006__SNP | 1254006 | C | T |
| scaffold49652__1257900__SNP | 1257900 | A | G |
| scaffold49652__1260621__SNP | 1260621 | G | C |
| scaffold49652__1260771__SNP | 1260771 | T | C |
| scaffold49652__1261627__SNP | 1261627 | A | T |
| scaffold49652__1261954__SNP | 1261954 | C | A |
| scaffold49652__1262618__SNP | 1262618 | A | C |
| scaffold49652__1262670__SNP | 1262670 | G | C |
| scaffold49652__1263002__SNP | 1263002 | T | C |
| scaffold49652__1263917__SNP | 1263917 | T | C |
| scaffold49652__1263984__SNP | 1263984 | G | T |
| scaffold49652__1265551__SNP | 1265551 | G | C |
| scaffold49652__1266148__SNP | 1266148 | A | G |

TABLE 2-continued

SNP Positions within SEQ ID NO: 2 that are associated with increased resistance to ASR

| SNP Name | Position | Favorable Allele (Rust Resistant) | Unfavorable Allele (Rust Susceptible) |
|---|---|---|---|
| scaffold49652__1266149__SNP | 1266149 | G | A |
| scaffold49652__1266165__SNP | 1266165 | T | C |
| scaffold49652__1266173__SNP | 1266173 | G | A |
| scaffold49652__1266252__SNP | 1266252 | T | C |
| scaffold49652__1267716__SNP | 1267716 | T | C |
| scaffold49652__1268719__SNP | 1268719 | T | A |
| scaffold49652__1269754__SNP | 1269754 | A | G |
| scaffold49652__1272386__SNP | 1272386 | C | G |
| scaffold49652__1274965__SNP | 1274965 | C | T |
| scaffold49652__1275187__SNP | 1275187 | G | C |
| scaffold49652__1275978__SNP | 1275978 | G | A |
| scaffold49652__1276158__SNP | 1276158 | A | G |
| scaffold49652__1285645__SNP | 1285645 | C | T |
| scaffold49652__1285703__SNP | 1285703 | G | A |
| scaffold49652__1287076__SNP | 1287076 | T | A |
| scaffold49652__1287285__SNP | 1287285 | A | G |
| scaffold49652__1287342__SNP | 1287342 | C | T |
| scaffold49652__1288020__SNP | 1288020 | A | G |
| scaffold49652__1288039__SNP | 1288039 | C | A |
| scaffold49652__1288110__SNP | 1288110 | G | A |
| scaffold49652__1288261__SNP | 1288261 | G | T |
| scaffold49652__1288298__SNP | 1288298 | A | G |
| scaffold49652__1288817__SNP | 1288817 | T | C |
| scaffold49652__1289315__SNP | 1289315 | A | G |
| scaffold49652__1289365__SNP | 1289365 | A | G |
| scaffold49652__1290541__SNP | 1290541 | C | A |
| scaffold49652__1290877__SNP | 1290877 | C | T |
| scaffold49652__1292092__SNP | 1292092 | G | T |
| scaffold49652__1296215__SNP | 1296215 | T | G |
| scaffold49652__1300497__SNP | 1300497 | A | C |
| scaffold49652__1301168__SNP | 1301168 | T | G |
| scaffold49652__1301459__SNP | 1301459 | G | T |
| scaffold49652__1304023__SNP | 1304023 | T | C |
| scaffold49652__1304442__SNP | 1304442 | T | A |
| scaffold49652__1305544__SNP | 1305544 | G | A |
| scaffold49652__1305909__SNP | 1305909 | T | C |
| scaffold49652__1307320__SNP | 1307320 | A | G |
| scaffold49652__1308573__SNP | 1308573 | T | G |
| scaffold49652__1309111__SNP | 1309111 | A | T |
| scaffold49652__1309910__SNP | 1309910 | A | G |
| scaffold49652__1310627__SNP | 1310627 | A | G |
| scaffold49652__1311366__SNP | 1311366 | A | G |
| scaffold49652__1311661__SNP | 1311661 | G | C |
| scaffold49652__1312620__SNP | 1312620 | G | A |
| scaffold49652__1312688__SNP | 1312688 | A | T |
| scaffold49652__1314839__SNP | 1314839 | G | A |
| scaffold49652__1318161__SNP | 1318161 | G | A |
| scaffold49652__1319905__SNP | 1319905 | T | A |
| scaffold49652__1319927__SNP | 1319927 | A | T |
| scaffold49652__1325373__SNP | 1325373 | A | G |
| scaffold49652__1327039__SNP | 1327039 | C | A |
| scaffold49652__1327125__SNP | 1327125 | G | A |
| scaffold49652__1330359__SNP | 1330359 | C | T |
| scaffold49652__1330510__SNP | 1330510 | G | A |
| scaffold49652__1330691__SNP | 1330691 | C | T |
| scaffold49652__1331569__SNP | 1331569 | G | A |
| scaffold49652__1337671__SNP | 1337671 | A | C |
| scaffold49652__1338851__SNP | 1338851 | T | C |
| scaffold49652__1342039__SNP | 1342039 | T | C |
| scaffold49652__1349150__SNP | 1349150 | T | G |
| scaffold49652__1349305__SNP | 1349305 | C | G |
| scaffold49652__1349459__SNP | 1349459 | G | A |
| scaffold49652__1350228__SNP | 1350228 | C | A |
| scaffold49652__1350475__SNP | 1350475 | A | T |
| scaffold49652__1350767__SNP | 1350767 | A | G |
| scaffold49652__1350817__SNP | 1350817 | G | A |
| scaffold49652__1351683__SNP | 1351683 | C | T |
| scaffold49652__1351871__SNP | 1351871 | T | C |
| scaffold49652__1353291__SNP | 1353291 | C | T |
| scaffold49652__1355147__SNP | 1355147 | A | C |
| scaffold49652__1355187__SNP | 1355187 | A | G |
| scaffold49652__1355230__SNP | 1355230 | T | C |

TABLE 2-continued

SNP Positions within SEQ ID NO: 2 that are associated with increased resistance to ASR

| SNP Name | Position | Favorable Allele (Rust Resistant) | Unfavorable Allele (Rust Susceptible) |
|---|---|---|---|
| scaffold49652_1355250_SNP | 1355250 | A | G |
| scaffold49652_1355677_SNP | 1355677 | T | A |
| scaffold49652_1356300_SNP | 1356300 | T | C |
| scaffold49652_1356305_SNP | 1356305 | G | A |
| scaffold49652_1356320_SNP | 1356320 | G | C |
| scaffold49652_1359144_SNP | 1359144 | T | A |
| scaffold49652_1359155_SNP | 1359155 | A | T |
| scaffold49652_1360507_SNP | 1360507 | A | G |
| scaffold49652_1360522_SNP | 1360522 | C | T |
| scaffold49652_1360564_SNP | 1360564 | A | G |
| scaffold49652_1360872_SNP | 1360872 | C | T |
| scaffold49652_1370489_SNP | 1370489 | A | G |
| scaffold49652_1370564_SNP | 1370564 | A | G |
| scaffold49652_1372158_SNP | 1372158 | G | C |
| scaffold49652_1372159_SNP | 1372159 | T | C |
| scaffold49652_1373213_SNP | 1373213 | C | A |
| scaffold49652_1377409_SNP | 1377409 | T | C |
| scaffold49652_1378219_SNP | 1378219 | A | C |
| scaffold49652_1379478_SNP | 1379478 | A | G |
| scaffold49652_1379538_SNP | 1379538 | T | A |
| scaffold49652_1380960_SNP | 1380960 | T | C |
| scaffold49652_1381295_SNP | 1381295 | G | A |
| scaffold49652_1381522_SNP | 1381522 | G | A |
| scaffold49652_1381720_SNP | 1381720 | G | A |
| scaffold49652_1382796_SNP | 1382796 | A | G |
| scaffold49652_1384076_SNP | 1384076 | C | T |
| scaffold49652_1384083_SNP | 1384083 | C | T |
| scaffold49652_1384210_SNP | 1384210 | G | A |
| scaffold49652_1384225_SNP | 1384225 | T | C |
| scaffold49652_1384233_SNP | 1384233 | A | G |
| scaffold49652_1384646_SNP | 1384646 | C | G |
| scaffold49652_1386487_SNP | 1386487 | C | T |
| scaffold49652_1387398_SNP | 1387398 | T | C |
| scaffold49652_1388592_SNP | 1388592 | T | C |
| scaffold49652_1389373_SNP | 1389373 | A | G |
| scaffold49652_1390362_SNP | 1390362 | C | T |
| scaffold49652_1390399_SNP | 1390399 | C | A |
| scaffold49652_1391282_SNP | 1391282 | G | T |
| scaffold49652_1391283_SNP | 1391283 | G | T |
| scaffold49652_1391328_SNP | 1391328 | A | G |
| scaffold49652_1391432_SNP | 1391432 | G | A |
| scaffold49652_1392482_SNP | 1392482 | T | G |
| scaffold49652_1393382_SNP | 1393382 | A | G |
| scaffold49652_1394841_SNP | 1394841 | A | G |
| scaffold49652_1395450_SNP | 1395450 | C | A |
| scaffold49652_1396427_SNP | 1396427 | G | T |
| scaffold49652_1397384_SNP | 1397384 | G | C |
| scaffold49652_1397840_SNP | 1397840 | C | T |
| scaffold49652_1398988_SNP | 1398988 | G | T |
| scaffold49652_1398997_SNP | 1398997 | A | C |
| scaffold49652_1400236_SNP | 1400236 | T | C |
| scaffold49652_1406135_SNP | 1406135 | C | T |
| scaffold49652_1406929_SNP | 1406929 | T | C |
| scaffold49652_1406970_SNP | 1406970 | G | A |
| scaffold49652_1412574_SNP | 1412574 | G | A |
| scaffold49652_1412984_SNP | 1412984 | A | G |
| scaffold49652_1413190_SNP | 1413190 | T | G |
| scaffold49652_1413578_SNP | 1413578 | T | A |
| scaffold49652_1414567_SNP | 1414567 | T | A |
| scaffold49652_1414947_SNP | 1414947 | T | A |
| scaffold49652_1415171_SNP | 1415171 | A | G |
| scaffold49652_1420459_SNP | 1420459 | G | A |
| scaffold49652_1425012_SNP | 1425012 | A | G |
| scaffold49652_1425787_SNP | 1425787 | A | T |
| scaffold49652_1427691_SNP | 1427691 | A | T |
| scaffold49652_1439691_SNP | 1439691 | G | T |
| scaffold49652_1441763_SNP | 1441763 | A | T |
| scaffold49652_1446012_SNP | 1446012 | T | A |
| scaffold49652_1448318_SNP | 1448318 | G | A |
| scaffold49652_1452330_SNP | 1452330 | T | C |
| scaffold49652_1455958_SNP | 1455958 | A | G |
| scaffold49652_1458870_SNP | 1458870 | T | A |
| scaffold49652_1459287_SNP | 1459287 | C | A |
| scaffold49652_1464696_SNP | 1464696 | C | T |
| scaffold49652_1473688_SNP | 1473688 | C | A |
| scaffold49652_1477682_SNP | 1477682 | A | C |
| scaffold49652_1482016_SNP | 1482016 | G | A |
| scaffold49652_1484394_SNP | 1484394 | G | A |
| scaffold49652_1484736_SNP | 1484736 | A | T |
| scaffold49652_1486437_SNP | 1486437 | T | A |
| scaffold49652_1486718_SNP | 1486718 | A | G |
| scaffold49652_1487392_SNP | 1487392 | A | C |
| scaffold49652_1490346_SNP | 1490346 | A | G |
| scaffold49652_1490664_SNP | 1490664 | A | T |
| scaffold49652_1497465_SNP | 1497465 | G | A |
| scaffold49652_1498098_SNP | 1498098 | A | G |
| scaffold49652_1498277_SNP | 1498277 | G | A |
| scaffold49652_1498726_SNP | 1498726 | A | C |
| scaffold49652_1498730_SNP | 1498730 | G | A |
| scaffold49652_1498784_SNP | 1498784 | C | T |
| scaffold49652_1499589_SNP | 1499589 | T | C |
| scaffold49652_1499694_SNP | 1499694 | C | A |
| scaffold49652_1499831_SNP | 1499831 | T | C |
| scaffold49652_1499964_SNP | 1499964 | G | C |
| scaffold49652_1500119_SNP | 1500119 | C | T |
| scaffold49652_1500300_SNP | 1500300 | G | A |
| scaffold49652_1500589_SNP | 1500589 | C | T |
| scaffold49652_1500834_SNP | 1500834 | G | A |
| scaffold49652_1501563_SNP | 1501563 | G | C |
| scaffold49652_1501587_SNP | 1501587 | A | C |
| scaffold49652_1501646_SNP | 1501646 | C | T |
| scaffold49652_1502068_SNP | 1502068 | T | G |
| scaffold49652_1502597_SNP | 1502597 | A | G |
| scaffold49652_1502635_SNP | 1502635 | C | A |
| scaffold49652_1503077_SNP | 1503077 | C | A |
| scaffold49652_1503219_SNP | 1503219 | G | A |
| scaffold49652_1503270_SNP | 1503270 | T | C |
| scaffold49652_1503416_SNP | 1503416 | G | T |
| scaffold49652_1503427_SNP | 1503427 | T | C |
| scaffold49652_1503442_SNP | 1503442 | C | A |
| scaffold49652_1503443_SNP | 1503443 | G | A |
| scaffold49652_1503849_SNP | 1503849 | A | C |
| scaffold49652_1504038_SNP | 1504038 | A | G |
| scaffold49652_1504047_SNP | 1504047 | C | G |
| scaffold49652_1504065_SNP | 1504065 | G | A |
| scaffold49652_1504101_SNP | 1504101 | C | T |
| scaffold49652_1504276_SNP | 1504276 | G | C |
| scaffold49652_1504328_SNP | 1504328 | A | C |
| scaffold49652_1504542_SNP | 1504542 | C | T |
| scaffold49652_1504575_SNP | 1504575 | A | T |
| scaffold49652_1504595_SNP | 1504595 | T | C |
| scaffold49652_1504723_SNP | 1504723 | T | G |
| scaffold49652_1505015_SNP | 1505015 | A | T |
| scaffold49652_1505026_SNP | 1505026 | G | A |
| scaffold49652_1505111_SNP | 1505111 | T | A |
| scaffold49652_1505201_SNP | 1505201 | G | A |
| scaffold49652_1505243_SNP | 1505243 | G | A |
| scaffold49652_1506602_SNP | 1506602 | G | C |
| scaffold49652_1506823_SNP | 1506823 | C | T |
| scaffold49652_1506945_SNP | 1506945 | C | T |
| scaffold49652_1507115_SNP | 1507115 | A | C |
| scaffold49652_1507459_SNP | 1507459 | A | G |
| scaffold49652_1508337_SNP | 1508337 | A | C |
| scaffold49652_1508384_SNP | 1508384 | C | A |
| scaffold49652_1508840_SNP | 1508840 | G | A |
| scaffold49652_1509261_SNP | 1509261 | C | T |
| scaffold49652_1509579_SNP | 1509579 | T | A |
| scaffold49652_1509633_SNP | 1509633 | A | G |
| scaffold49652_1509837_SNP | 1509837 | A | C |
| scaffold49652_1509840_SNP | 1509840 | T | C |
| scaffold49652_1510029_SNP | 1510029 | G | T |
| scaffold49652_1510081_SNP | 1510081 | G | A |
| scaffold49652_1510310_SNP | 1510310 | G | A |
| scaffold49652_1510352_SNP | 1510352 | A | G |

TABLE 2-continued

SNP Positions within SEQ ID NO: 2 that are associated with increased resistance to ASR

| SNP Name | Position | Favorable Allele (Rust Resistant) | Unfavorable Allele (Rust Susceptible) |
|---|---|---|---|
| scaffold49652__1510865__SNP | 1510865 | C | T |
| scaffold49652__1511280__SNP | 1511280 | T | C |
| scaffold49652__1511395__SNP | 1511395 | T | C |
| scaffold49652__1511421__SNP | 1511421 | C | A |
| scaffold49652__1511424__SNP | 1511424 | A | T |
| scaffold49652__1511426__SNP | 1511426 | C | T |
| scaffold49652__1511469__SNP | 1511469 | C | T |
| scaffold49652__1511592__SNP | 1511592 | T | A |
| scaffold49652__1511657__SNP | 1511657 | T | G |
| scaffold49652__1511748__SNP | 1511748 | G | C |
| scaffold49652__1511995__SNP | 1511995 | C | A |
| scaffold49652__1512321__SNP | 1512321 | T | G |
| scaffold49652__1512638__SNP | 1512638 | A | G |
| scaffold49652__1512709__SNP | 1512709 | C | T |
| scaffold49652__1519579__SNP | 1519579 | T | C |
| scaffold49652__1525812__SNP | 1525812 | G | T |
| scaffold49652__1526777__SNP | 1526777 | T | C |
| scaffold49652__1527451__SNP | 1527451 | A | C |
| scaffold49652__1527474__SNP | 1527474 | T | C |
| scaffold49652__1527528__SNP | 1527528 | A | G |
| scaffold49652__1527697__SNP | 1527697 | G | C |
| scaffold49652__1529671__SNP | 1529671 | G | A |
| scaffold49652__1529889__SNP | 1529889 | C | A |
| scaffold49652__1529893__SNP | 1529893 | G | T |
| scaffold49652__1530108__SNP | 1530108 | A | C |
| scaffold49652__1532466__SNP | 1532466 | T | C |
| scaffold49652__1533033__SNP | 1533033 | C | T |
| scaffold49652__1533101__SNP | 1533101 | T | A |
| scaffold49652__1533473__SNP | 1533473 | G | C |
| scaffold49652__1533647__SNP | 1533647 | A | C |
| scaffold49652__1533653__SNP | 1533653 | T | C |
| scaffold49652__1533761__SNP | 1533761 | G | A |
| scaffold49652__1533817__SNP | 1533817 | T | C |
| scaffold49652__1533820__SNP | 1533820 | G | T |
| scaffold49652__1533913__SNP | 1533913 | C | T |
| scaffold49652__1533992__SNP | 1533992 | A | T |
| scaffold49652__1534122__SNP | 1534122 | C | T |
| scaffold49652__1534370__SNP | 1534370 | G | A |
| scaffold49652__1534594__SNP | 1534594 | G | T |
| scaffold49652__1534861__SNP | 1534861 | C | T |
| scaffold49652__1534901__SNP | 1534901 | T | C |
| scaffold49652__1534951__SNP | 1534951 | T | G |
| scaffold49652__1534973__SNP | 1534973 | T | C |
| scaffold49652__1535397__SNP | 1535397 | T | A |
| scaffold49652__1535471__SNP | 1535471 | A | G |
| scaffold49652__1535713__SNP | 1535713 | G | C |
| scaffold49652__1535759__SNP | 1535759 | G | T |
| scaffold49652__1535787__SNP | 1535787 | T | C |
| scaffold49652__1536164__SNP | 1536164 | T | A |
| scaffold49652__1536203__SNP | 1536203 | C | T |
| scaffold49652__1536208__SNP | 1536208 | C | T |
| scaffold49652__1536258__SNP | 1536258 | A | G |
| scaffold49652__1536492__SNP | 1536492 | T | A |
| scaffold49652__1536668__SNP | 1536668 | G | T |
| scaffold49652__1536874__SNP | 1536874 | C | G |
| scaffold49652__1536947__SNP | 1536947 | G | A |
| scaffold49652__1537026__SNP | 1537026 | T | C |
| scaffold49652__1537049__SNP | 1537049 | G | T |
| scaffold49652__1537209__SNP | 1537209 | C | T |
| scaffold49652__1537396__SNP | 1537396 | C | T |
| scaffold49652__1537400__SNP | 1537400 | A | G |
| scaffold49652__1537466__SNP | 1537466 | G | A |
| scaffold49652__1537469__SNP | 1537469 | A | G |
| scaffold49652__1537508__SNP | 1537508 | T | C |
| scaffold49652__1537761__SNP | 1537761 | A | C |
| scaffold49652__1537782__SNP | 1537782 | G | T |
| scaffold49652__1538460__SNP | 1538460 | T | A |
| scaffold49652__1538522__SNP | 1538522 | G | A |
| scaffold49652__1539298__SNP | 1539298 | T | C |
| scaffold49652__1539596__SNP | 1539596 | G | A |
| scaffold49652__1539844__SNP | 1539844 | A | G |
| scaffold49652__1539846__SNP | 1539846 | T | C |

TABLE 2-continued

SNP Positions within SEQ ID NO: 2 that are associated with increased resistance to ASR

| SNP Name | Position | Favorable Allele (Rust Resistant) | Unfavorable Allele (Rust Susceptible) |
|---|---|---|---|
| scaffold49652__1540106__SNP | 1540106 | C | T |
| scaffold49652__1540355__SNP | 1540355 | T | A |
| scaffold49652__1540361__SNP | 1540361 | T | C |
| scaffold49652__1542105__SNP | 1542105 | G | T |
| scaffold49652__1542192__SNP | 1542192 | A | G |
| scaffold49652__1542903__SNP | 1542903 | T | C |
| scaffold49652__1542948__SNP | 1542948 | G | A |
| scaffold49652__1542985__SNP | 1542985 | A | G |
| scaffold49652__1543326__SNP | 1543326 | G | A |
| scaffold49652__1543480__SNP | 1543480 | T | C |
| scaffold49652__1543521__SNP | 1543521 | T | C |
| scaffold49652__1543573__SNP | 1543573 | G | A |
| scaffold49652__1544029__SNP | 1544029 | G | T |
| scaffold49652__1544098__SNP | 1544098 | G | A |
| scaffold49652__1544113__SNP | 1544113 | C | T |
| scaffold49652__1544156__SNP | 1544156 | C | T |
| scaffold49652__1544767__SNP | 1544767 | A | G |
| scaffold49652__1544768__SNP | 1544768 | C | A |
| scaffold49652__1545344__SNP | 1545344 | T | C |
| scaffold49652__1545580__SNP | 1545580 | C | T |
| scaffold49652__1545677__SNP | 1545677 | G | C |
| scaffold49652__1546183__SNP | 1546183 | T | G |
| scaffold49652__1546253__SNP | 1546253 | G | C |
| scaffold49652__1547303__SNP | 1547303 | G | T |
| scaffold49652__1549454__SNP | 1549454 | G | C |
| scaffold49652__1550953__SNP | 1550953 | G | T |
| scaffold49652__1551454__SNP | 1551454 | G | T |
| scaffold49652__1551466__SNP | 1551466 | C | G |
| scaffold49652__1551516__SNP | 1551516 | C | T |
| scaffold49652__1551524__SNP | 1551524 | T | C |
| scaffold49652__1551889__SNP | 1551889 | T | C |
| scaffold49652__1551893__SNP | 1551893 | A | T |
| scaffold49652__1552041__SNP | 1552041 | A | C |
| scaffold49652__1552920__SNP | 1552920 | G | C |
| scaffold49652__1553019__SNP | 1553019 | A | T |
| scaffold49652__1553020__SNP | 1553020 | C | T |
| scaffold49652__1553247__SNP | 1553247 | G | A |
| scaffold49652__1553264__SNP | 1553264 | A | C |
| scaffold49652__1553305__SNP | 1553305 | T | C |
| scaffold49652__1553323__SNP | 1553323 | C | G |
| scaffold49652__1553641__SNP | 1553641 | C | G |
| scaffold49652__1554381__SNP | 1554381 | A | G |
| scaffold49652__1554522__SNP | 1554522 | A | C |
| scaffold49652__1555756__SNP | 1555756 | C | A |
| scaffold49652__1555802__SNP | 1555802 | A | G |
| scaffold49652__1556023__SNP | 1556023 | A | T |
| scaffold49652__1556301__SNP | 1556301 | T | C |
| scaffold49652__1556314__SNP | 1556314 | G | A |
| scaffold49652__1556354__SNP | 1556354 | G | A |
| scaffold49652__1556356__SNP | 1556356 | C | T |
| scaffold49652__1556398__SNP | 1556398 | C | T |
| scaffold49652__1556825__SNP | 1556825 | C | G |
| scaffold49652__1557388__SNP | 1557388 | T | C |
| scaffold49652__1557402__SNP | 1557402 | A | C |
| scaffold49652__1557403__SNP | 1557403 | G | T |
| scaffold49652__1558327__SNP | 1558327 | G | A |
| scaffold49652__1558999__SNP | 1558999 | C | T |
| scaffold49652__1559045__SNP | 1559045 | T | G |
| scaffold49652__1559075__SNP | 1559075 | T | A |
| scaffold49652__1559076__SNP | 1559076 | T | A |
| scaffold49652__1559133__SNP | 1559133 | T | C |
| scaffold49652__1561075__SNP | 1561075 | A | G |
| scaffold49652__1563948__SNP | 1563948 | C | T |
| scaffold49652__1563987__SNP | 1563987 | G | A |
| scaffold49652__1564295__SNP | 1564295 | G | A |
| scaffold49652__1564405__SNP | 1564405 | G | T |
| scaffold49652__1564547__SNP | 1564547 | A | G |
| scaffold49652__1564651__SNP | 1564651 | C | G |
| scaffold49652__1564876__SNP | 1564876 | A | C |
| scaffold49652__1565656__SNP | 1565656 | G | A |
| scaffold49652__1566960__SNP | 1566960 | G | A |
| scaffold49652__1568459__SNP | 1568459 | G | A |

TABLE 2-continued

SNP Positions within SEQ ID NO: 2 that are associated with increased resistance to ASR

| SNP Name | Position | Favorable Allele (Rust Resistant) | Unfavorable Allele (Rust Susceptible) |
|---|---|---|---|
| scaffold49652__1568469__SNP | 1568469 | T | C |
| scaffold49652__1568476__SNP | 1568476 | G | A |
| scaffold49652__1568909__SNP | 1568909 | T | C |
| scaffold49652__1569191__SNP | 1569191 | A | G |
| scaffold49652__1569222__SNP | 1569222 | C | T |
| scaffold49652__1569352__SNP | 1569352 | G | A |
| scaffold49652__1569521__SNP | 1569521 | C | T |
| scaffold49652__1569522__SNP | 1569522 | C | T |
| scaffold49652__1569581__SNP | 1569581 | C | T |
| scaffold49652__1569654__SNP | 1569654 | T | G |
| scaffold49652__1569941__SNP | 1569941 | G | T |
| scaffold49652__1569964__SNP | 1569964 | G | A |
| scaffold49652__1570030__SNP | 1570030 | A | G |
| scaffold49652__1570384__SNP | 1570384 | T | A |
| scaffold49652__1570684__SNP | 1570684 | T | G |
| scaffold49652__1570738__SNP | 1570738 | G | A |
| scaffold49652__1571106__SNP | 1571106 | C | A |
| scaffold49652__1571967__SNP | 1571967 | T | C |
| scaffold49652__1572221__SNP | 1572221 | C | A |
| scaffold49652__1572383__SNP | 1572383 | T | A |
| scaffold49652__1572517__SNP | 1572517 | G | A |
| scaffold49652__1573983__SNP | 1573983 | C | A |
| scaffold49652__1574213__SNP | 1574213 | T | C |
| scaffold49652__1574333__SNP | 1574333 | G | A |
| scaffold49652__1574676__SNP | 1574676 | G | A |
| scaffold49652__1574783__SNP | 1574783 | G | T |
| scaffold49652__1574817__SNP | 1574817 | T | C |
| scaffold49652__1574821__SNP | 1574821 | A | T |
| scaffold49652__1576691__SNP | 1576691 | G | A |
| scaffold49652__1578153__SNP | 1578153 | T | C |
| scaffold49652__1578410__SNP | 1578410 | T | A |
| scaffold49652__1579480__SNP | 1579480 | G | A |
| scaffold49652__1580162__SNP | 1580162 | G | A |
| scaffold49652__1585124__SNP | 1585124 | G | A |
| scaffold49652__1591552__SNP | 1591552 | G | C |
| scaffold49652__1593734__SNP | 1593734 | T | A |
| scaffold49652__1593979__SNP | 1593979 | G | A |
| scaffold49652__1594860__SNP | 1594860 | A | G |
| scaffold49652__1595032__SNP | 1595032 | C | T |
| scaffold49652__1596156__SNP | 1596156 | T | C |
| scaffold49652__1598089__SNP | 1598089 | C | A |
| scaffold49652__1598664__SNP | 1598664 | T | C |
| scaffold49652__1600217__SNP | 1600217 | G | C |
| scaffold49652__1600861__SNP | 1600861 | T | G |
| scaffold49652__1601108__SNP | 1601108 | A | G |
| scaffold49652__1606896__SNP | 1606896 | G | A |
| scaffold49652__1606901__SNP | 1606901 | A | C |
| scaffold49652__1606946__SNP | 1606946 | A | T |
| scaffold49652__1607051__SNP | 1607051 | C | T |
| scaffold49652__1607970__SNP | 1607970 | A | T |
| scaffold49652__1608931__SNP | 1608931 | C | T |
| scaffold49652__1611052__SNP | 1611052 | C | G |
| scaffold49652__1611319__SNP | 1611319 | T | C |
| scaffold49652__1611324__SNP | 1611324 | G | T |
| scaffold49652__1611669__SNP | 1611669 | T | C |
| scaffold49652__1612160__SNP | 1612160 | G | A |
| scaffold49652__1612262__SNP | 1612262 | A | G |
| scaffold49652__1612278__SNP | 1612278 | T | G |
| scaffold49652__1612872__SNP | 1612872 | A | G |
| scaffold49652__1613879__SNP | 1613879 | C | T |
| scaffold49652__1614448__SNP | 1614448 | G | A |
| scaffold49652__1614630__SNP | 1614630 | A | G |
| scaffold49652__1615422__SNP | 1615422 | T | C |
| scaffold49652__1615483__SNP | 1615483 | C | A |
| scaffold49652__1615540__SNP | 1615540 | T | C |
| scaffold49652__1615851__SNP | 1615851 | T | C |
| scaffold49652__1615852__SNP | 1615852 | G | A |
| scaffold49652__1616125__SNP | 1616125 | G | A |
| scaffold49652__1616178__SNP | 1616178 | A | G |
| scaffold49652__1616195__SNP | 1616195 | A | G |
| scaffold49652__1616403__SNP | 1616403 | G | A |
| scaffold49652__1617007__SNP | 1617007 | T | G |
| scaffold49652__1617865__SNP | 1617865 | G | C |
| scaffold49652__1618890__SNP | 1618890 | A | C |
| scaffold49652__1618892__SNP | 1618892 | T | A |
| scaffold49652__1619290__SNP | 1619290 | A | G |
| scaffold49652__1619574__SNP | 1619574 | C | A |
| scaffold49652__1619632__SNP | 1619632 | T | G |
| scaffold49652__1619917__SNP | 1619917 | G | A |
| scaffold49652__1621408__SNP | 1621408 | A | G |
| scaffold49652__1621878__SNP | 1621878 | G | A |
| scaffold49652__1622798__SNP | 1622798 | A | G |
| scaffold49652__1622821__SNP | 1622821 | C | T |
| scaffold49652__1626988__SNP | 1626988 | G | A |
| scaffold49652__1627444__SNP | 1627444 | G | A |
| scaffold49652__1627969__SNP | 1627969 | G | A |
| scaffold49652__1628615__SNP | 1628615 | C | T |
| scaffold49652__1630497__SNP | 1630497 | C | G |
| scaffold49652__1631111__SNP | 1631111 | C | G |
| scaffold49652__1631190__SNP | 1631190 | G | C |
| scaffold49652__1631597__SNP | 1631597 | C | G |
| scaffold49652__1632497__SNP | 1632497 | A | G |
| scaffold49652__1633787__SNP | 1633787 | A | G |
| scaffold49652__1635028__SNP | 1635028 | A | C |
| scaffold49652__1635345__SNP | 1635345 | A | T |
| scaffold49652__1636124__SNP | 1636124 | A | G |
| scaffold49652__1637672__SNP | 1637672 | A | G |
| scaffold49652__1637924__SNP | 1637924 | C | T |
| scaffold49652__1638248__SNP | 1638248 | C | A |
| scaffold49652__1638634__SNP | 1638634 | A | G |
| scaffold49652__1639333__SNP | 1639333 | C | G |
| scaffold49652__1639344__SNP | 1639344 | A | T |
| scaffold49652__1640567__SNP | 1640567 | T | A |
| scaffold49652__1640589__SNP | 1640589 | C | T |
| scaffold49652__1641369__SNP | 1641369 | T | A |
| scaffold49652__1642436__SNP | 1642436 | T | C |
| scaffold49652__1642517__SNP | 1642517 | A | G |
| scaffold49652__1642930__SNP | 1642930 | G | T |
| scaffold49652__1645749__SNP | 1645749 | G | A |
| scaffold49652__1645778__SNP | 1645778 | G | A |
| scaffold49652__1646272__SNP | 1646272 | T | C |
| scaffold49652__1648632__SNP | 1648632 | C | T |
| scaffold49652__1650650__SNP | 1650650 | C | T |
| scaffold49652__1653321__SNP | 1653321 | C | T |
| scaffold49652__1653395__SNP | 1653395 | T | G |
| scaffold49652__1653923__SNP | 1653923 | T | A |
| scaffold49652__1654022__SNP | 1654022 | T | C |
| scaffold49652__1654024__SNP | 1654024 | C | T |
| scaffold49652__1654082__SNP | 1654082 | C | A |
| scaffold49652__1654121__SNP | 1654121 | A | G |
| scaffold49652__1657071__SNP | 1657071 | C | T |
| scaffold49652__1657306__SNP | 1657306 | A | G |
| scaffold49652__1657419__SNP | 1657419 | C | G |
| scaffold49652__1659632__SNP | 1659632 | T | C |
| scaffold49652__1659667__SNP | 1659667 | C | T |
| scaffold49652__1660987__SNP | 1660987 | G | T |
| scaffold49652__1662158__SNP | 1662158 | G | C |
| scaffold49652__1668419__SNP | 1668419 | C | T |
| scaffold49652__1673502__SNP | 1673502 | G | T |
| scaffold49652__1683393__SNP | 1683393 | T | C |
| scaffold49652__1691712__SNP | 1691712 | G | A |
| scaffold49652__1706511__SNP | 1706511 | G | C |
| scaffold49652__1706512__SNP | 1706512 | G | A |
| scaffold49652__1708631__SNP | 1708631 | C | T |
| scaffold49652__1714596__SNP | 1714596 | G | A |
| scaffold49652__1715039__SNP | 1715039 | T | C |
| scaffold49652__1717036__SNP | 1717036 | G | A |
| scaffold49652__1724262__SNP | 1724262 | A | C |
| scaffold49652__1726873__SNP | 1726873 | T | A |
| scaffold49652__1728573__SNP | 1728573 | T | C |
| scaffold49652__1729370__SNP | 1729370 | G | A |
| scaffold49652__1731936__SNP | 1731936 | A | G |
| scaffold49652__1731965__SNP | 1731965 | A | G |
| scaffold49652__1733030__SNP | 1733030 | C | T |

TABLE 2-continued

SNP Positions within SEQ ID NO: 2 that are associated with increased resistance to ASR

| SNP Name | Position | Favorable Allele (Rust Resistant) | Unfavorable Allele (Rust Susceptible) |
|---|---|---|---|
| scaffold49652_1733331_SNP | 1733331 | G | A |
| scaffold49652_1733615_SNP | 1733615 | C | T |
| scaffold49652_1744444_SNP | 1744444 | G | A |
| scaffold49652_1744567_SNP | 1744567 | G | T |
| scaffold49652_1749854_SNP | 1749854 | G | A |
| scaffold49652_1752330_SNP | 1752330 | T | A |
| scaffold49652_1760004_SNP | 1760004 | C | T |
| scaffold49652_1764534_SNP | 1764534 | A | G |
| scaffold49652_1781766_SNP | 1781766 | G | C |
| scaffold49652_1781798_SNP | 1781798 | C | G |
| scaffold49652_1782420_SNP | 1782420 | A | C |
| scaffold49652_1784250_SNP | 1784250 | A | G |
| scaffold49652_1790651_SNP | 1790651 | T | G |
| scaffold49652_1801261_SNP | 1801261 | C | T |
| scaffold49652_1803941_SNP | 1803941 | G | A |
| scaffold49652_1817041_SNP | 1817041 | T | A |
| scaffold49652_1823072_SNP | 1823072 | T | C |
| scaffold49652_1830747_SNP | 1830747 | T | C |
| scaffold49652_1833496_SNP | 1833496 | A | G |
| scaffold49652_1834606_SNP | 1834606 | G | A |
| scaffold49652_1837409_SNP | 1837409 | A | G |
| scaffold49652_1843144_SNP | 1843144 | A | G |
| scaffold49652_1846505_SNP | 1846505 | G | A |
| scaffold49652_1846953_SNP | 1846953 | T | C |
| scaffold49652_1846990_SNP | 1846990 | A | C |
| scaffold49652_1847290_SNP | 1847290 | A | G |
| scaffold49652_1848210_SNP | 1848210 | T | C |
| scaffold49652_1848375_SNP | 1848375 | G | T |
| scaffold49652_1848606_SNP | 1848606 | C | A |
| scaffold49652_1850004_SNP | 1850004 | T | C |
| scaffold49652_1850077_SNP | 1850077 | A | G |
| scaffold49652_1851455_SNP | 1851455 | T | C |
| scaffold49652_1853986_SNP | 1853986 | T | C |
| scaffold49652_1854890_SNP | 1854890 | T | G |
| scaffold49652_1858706_SNP | 1858706 | G | T |
| scaffold49652_1859460_SNP | 1859460 | G | A |
| scaffold49652_1861379_SNP | 1861379 | A | C |
| scaffold49652_1861990_SNP | 1861990 | T | C |
| scaffold49652_1862056_SNP | 1862056 | G | C |
| scaffold49652_1862087_SNP | 1862087 | C | A |
| scaffold49652_1880564_SNP | 1880564 | T | C |
| scaffold49652_1882681_SNP | 1882681 | A | T |
| scaffold49652_1884227_SNP | 1884227 | G | A |
| scaffold49652_1889340_SNP | 1889340 | C | A |
| scaffold49652_1894466_SNP | 1894466 | A | C |
| scaffold49652_1894728_SNP | 1894728 | A | G |
| scaffold49652_1895837_SNP | 1895837 | C | T |
| scaffold49652_1896550_SNP | 1896550 | T | G |
| scaffold49652_1897010_SNP | 1897010 | C | T |
| scaffold49652_1899601_SNP | 1899601 | T | A |
| scaffold49652_1914992_SNP | 1914992 | T | A |
| scaffold49652_1929057_SNP | 1929057 | G | A |
| scaffold49652_1947534_SNP | 1947534 | A | T |
| scaffold49652_1950635_SNP | 1950635 | G | A |
| scaffold49652_1952814_SNP | 1952814 | C | T |
| scaffold49652_1952944_SNP | 1952944 | A | G |
| scaffold49652_1955067_SNP | 1955067 | G | T |
| scaffold49652_1955972_SNP | 1955972 | A | C |
| scaffold49652_1957208_SNP | 1957208 | T | G |
| scaffold49652_1957376_SNP | 1957376 | A | G |
| scaffold49652_1957591_SNP | 1957591 | C | T |
| scaffold49652_1957619_SNP | 1957619 | T | C |
| scaffold49652_1957630_SNP | 1957630 | G | T |
| scaffold49652_1969812_SNP | 1969812 | A | C |
| scaffold49652_1970984_SNP | 1970984 | T | C |
| scaffold49652_1973861_SNP | 1973861 | T | C |
| scaffold49652_1975056_SNP | 1975056 | T | G |
| scaffold49652_1993051_SNP | 1993051 | A | G |
| scaffold49652_1994772_SNP | 1994772 | G | A |
| scaffold49652_1994940_SNP | 1994940 | A | G |
| scaffold49652_1995121_SNP | 1995121 | G | A |
| scaffold49652_1996301_SNP | 1996301 | A | G |

TABLE 2-continued

SNP Positions within SEQ ID NO: 2 that are associated with increased resistance to ASR

| SNP Name | Position | Favorable Allele (Rust Resistant) | Unfavorable Allele (Rust Susceptible) |
|---|---|---|---|
| scaffold49652_1996348_SNP | 1996348 | A | G |
| scaffold49652_2002224_SNP | 2002224 | T | G |
| scaffold49652_2002613_SNP | 2002613 | C | A |
| scaffold49652_2007617_SNP | 2007617 | T | C |
| scaffold49652_2010119_SNP | 2010119 | A | G |
| scaffold49652_2010941_SNP | 2010941 | G | A |
| scaffold49652_2012896_SNP | 2012896 | C | T |
| scaffold49652_2019626_SNP | 2019626 | T | C |
| scaffold49652_2020758_SNP | 2020758 | C | T |
| scaffold49652_2021039_SNP | 2021039 | T | C |
| scaffold49652_2021994_SNP | 2021994 | C | T |
| scaffold49652_2031624_SNP | 2031624 | G | T |
| scaffold49652_2059291_SNP | 2059291 | G | A |
| scaffold49652_2064077_SNP | 2064077 | C | T |
| scaffold49652_2068668_SNP | 2068668 | T | C |
| scaffold49652_2075781_SNP | 2075781 | C | T |
| scaffold49652_2076365_SNP | 2076365 | C | T |
| scaffold49652_2076469_SNP | 2076469 | T | C |
| scaffold49652_2092527_SNP | 2092527 | T | C |
| scaffold49652_2092549_SNP | 2092549 | T | C |
| scaffold49652_2092809_SNP | 2092809 | C | G |
| scaffold49652_2094093_SNP | 2094093 | C | A |
| scaffold49652_2105568_SNP | 2105568 | A | G |
| scaffold49652_2115691_SNP | 2115691 | T | A |
| scaffold49652_2125447_SNP | 2125447 | C | T |
| scaffold49652_2126155_SNP | 2126155 | G | A |
| scaffold49652_2133188_SNP | 2133188 | T | C |
| scaffold49652_2138716_SNP | 2138716 | T | C |
| scaffold49652_2138774_SNP | 2138774 | T | C |
| scaffold49652_2156405_SNP | 2156405 | G | C |
| scaffold49652_2161240_SNP | 2161240 | C | T |
| scaffold49652_2178581_SNP | 2178581 | C | G |
| scaffold49652_2185469_SNP | 2185469 | A | T |
| scaffold49652_2187968_SNP | 2187968 | T | C |
| scaffold49652_2188098_SNP | 2188098 | T | C |
| scaffold49652_2188172_SNP | 2188172 | C | T |
| scaffold49652_2188805_SNP | 2188805 | G | C |
| scaffold49652_2198605_SNP | 2198605 | G | A |
| scaffold49652_2201366_SNP | 2201366 | A | C |
| scaffold49652_2216007_SNP | 2216007 | C | T |
| scaffold49652_2216622_SNP | 2216622 | G | A |
| scaffold49652_2227103_SNP | 2227103 | T | G |
| scaffold49652_2252002_SNP | 2252002 | A | C |
| scaffold49652_2267719_SNP | 2267719 | G | T |
| scaffold49652_2267778_SNP | 2267778 | G | C |
| scaffold49652_2275369_SNP | 2275369 | A | T |
| scaffold49652_2278763_SNP | 2278763 | A | G |
| scaffold49652_2284434_SNP | 2284434 | G | T |
| scaffold49652_2289155_SNP | 2289155 | G | A |
| scaffold49652_2293585_SNP | 2293585 | G | A |
| scaffold49652_2295350_SNP | 2295350 | A | G |
| scaffold49652_2319323_SNP | 2319323 | A | T |
| scaffold49652_2319892_SNP | 2319892 | A | G |
| scaffold49652_2340651_SNP | 2340651 | G | C |
| scaffold49652_2342022_SNP | 2342022 | G | T |
| scaffold49652_2350721_SNP | 2350721 | C | A |
| scaffold49652_2353391_SNP | 2353391 | T | G |
| scaffold49652_2368805_SNP | 2368805 | A | G |
| scaffold49652_2380689_SNP | 2380689 | T | C |
| scaffold49652_2380714_SNP | 2380714 | A | C |
| scaffold49652_2382130_SNP | 2382130 | T | C |
| scaffold49652_2383282_SNP | 2383282 | C | T |
| scaffold49652_2383554_SNP | 2383554 | T | C |
| scaffold49652_2384963_SNP | 2384963 | C | T |
| scaffold49652_2387325_SNP | 2387325 | C | T |
| scaffold49652_2387645_SNP | 2387645 | G | A |
| scaffold49652_2388437_SNP | 2388437 | A | C |
| scaffold49652_2400554_SNP | 2400554 | T | G |
| scaffold49652_2402164_SNP | 2402164 | T | C |
| scaffold49652_2405435_SNP | 2405435 | A | G |
| scaffold49652_2409799_SNP | 2409799 | C | T |
| scaffold49652_2410701_SNP | 2410701 | C | T |

TABLE 2-continued

SNP Positions within SEQ ID NO: 2 that are associated with increased resistance to ASR

| SNP Name | Position | Favorable Allele (Rust Resistant) | Unfavorable Allele (Rust Susceptible) |
|---|---|---|---|
| scaffold49652_2415748_SNP | 2415748 | A | G |
| scaffold49652_2415764_SNP | 2415764 | T | C |
| scaffold49652_2422192_SNP | 2422192 | T | G |
| scaffold49652_2442690_SNP | 2442690 | A | G |
| scaffold49652_2444153_SNP | 2444153 | A | C |
| scaffold49652_2458358_SNP | 2458358 | G | T |
| scaffold49652_2460701_SNP | 2460701 | G | C |
| scaffold49652_2471976_SNP | 2471976 | T | A |
| scaffold49652_2475982_SNP | 2475982 | G | C |
| scaffold49652_2476211_SNP | 2476211 | A | C |
| scaffold49652_2483904_SNP | 2483904 | C | A |
| scaffold49652_2492670_SNP | 2492670 | G | T |
| scaffold49652_2492681_SNP | 2492681 | C | T |
| scaffold49652_2503387_SNP | 2503387 | A | G |
| scaffold49652_2512568_SNP | 2512568 | C | A |
| scaffold49652_2513576_SNP | 2513576 | C | A |

TABLE 3

SNP Positions within SEQ ID NO: 3 that are associated with increased resistance to ASR

| SNP Name | Position | Favorable Allele (Rust Resistant) | Unfavorable Allele (Rust Susceptible) |
|---|---|---|---|
| 002687F_347209_SNP\|\|S_164680479 | 347209 | C | T |
| 002687F_205199_SNP\|\|S_164660488 | 205199 | A | C |
| 002687F_219471_SNP\|\|S_164662254 | 219471 | A | T |
| 002687F_219766_SNP\|\|S_164662304 | 219766 | A | C |
| 002687F_342670_SNP\|\|S_164679830 | 342670 | T | A |
| 002687F_347216_SNP\|\|S_164680481 | 347216 | C | T |
| 002687F_214317_SNP\|\|S_164661625 | 214317 | G | T |
| 002687F_214627_SNP\|\|S_164661653 | 214627 | T | A |
| 002687F_214883_SNP\|\|S_164661676 | 214883 | T | C |
| 002687F_223183_SNP\|\|S_164662750 | 223183 | C | T |
| 002687F_224184_SNP\|\|S_164662864 | 224184 | T | G |
| 002687F_224879_SNP\|\|S_164662947 | 224879 | T | C |
| 002687F_347638_SNP\|\|S_164680535 | 347638 | G | A |
| 002687F_213909_SNP\|\|S_164661595 | 213909 | C | A |
| 002687F_342685_SNP\|\|S_164679832 | 342685 | A | C |
| 002687F_355543_SNP\|\|S_164681678 | 355543 | G | A |
| 002687F_220657_SNP\|\|S_164662418 | 220657 | A | G |
| 002687F_208869_SNP\|\|S_164661018 | 208869 | G | A |
| 002687F_220760_SNP\|\|S_164662425 | 220760 | C | A |
| 002687F_221002_SNP\|\|S_164662446 | 221002 | G | A |
| 002687F_279573_SNP\|\|S_164670418 | 279573 | C | G |
| 002687F_215594_SNP\|\|S_164661771 | 215594 | T | C |
| 002687F_236335_SNP\|\|S_164664304 | 236335 | T | C |
| 002687F_213017_SNP\|\|S_164661504 | 213017 | T | G |
| 002687F_220051_SNP\|\|S_164662335 | 220051 | A | T |
| 002687F_4944_SNP\|\|S_164619728 | 4944 | T | C |
| 002687F_343869_SNP\|\|S_164679986 | 343869 | T | A |
| 002687F_227603_SNP\|\|S_164663273 | 227603 | A | G |
| 002687F_200922_SNP\|\|S_164659943 | 200922 | C | T |
| 002687F_202410_SNP\|\|S_164660103 | 202410 | T | C |
| 002687F_257232_SNP\|\|S_164667413 | 257232 | C | T |
| 002687F_258539_SNP\|\|S_164667602 | 258539 | A | C |
| 002687F_264907_SNP\|\|S_164668587 | 264907 | T | A |
| 002687F_265651_SNP\|\|S_164668676 | 265651 | C | T |
| 002687F_271932_SNP\|\|S_164669551 | 271932 | T | C |
| 002687F_283205_SNP\|\|S_164670839 | 283205 | C | T |
| 002687F_204093_SNP\|\|S_164660340 | 204093 | C | T |
| 002687F_210615_SNP | 210615 | T | C |
| 002687F_237462_SNP\|\|S_164664507 | 237462 | T | A |
| 002687F_244322_SNP\|\|S_164665473 | 244322 | G | C |
| 002687F_262053_SNP\|\|S_164668143 | 262053 | C | T |
| 002687F_236247_SNP\|\|S_164664292 | 236247 | C | T |
| 002687F_236323_SNP\|\|S_164664301 | 236323 | T | C |
| 002687F_154489_SNP\|\|S_164653160 | 154489 | A | G |
| 002687F_233977_SNP\|\|S_164664019 | 233977 | A | G |
| 002687F_257999_SNP\|\|S_164667512 | 257999 | G | A |
| 002687F_279277_SNP\|\|S_164670387 | 279277 | A | G |
| 002687F_282755_SNP\|\|S_164670788 | 282755 | G | A |
| 002687F_283768_SNP\|\|S_164670937 | 283768 | T | C |
| 002687F_302554_SNP\|\|S_164673590 | 302554 | A | G |
| 002687F_164869_SNP\|\|S_164655174 | 164869 | T | G |

TABLE 3-continued

| SNP Name | Position | Favorable Allele (Rust Resistant) | Unfavorable Allele (Rust Susceptible) |
|---|---|---|---|
| SNP Positions within SEQ ID NO: 3 that are associated with increased resistance to ASR | | | |
| 002687F_288304_SNP\|\|S_164671605 | 288304 | T | G |
| 002687F_294526_SNP\|\|S_164672282 | 294526 | T | G |
| 002687F_309973_SNP\|\|S_164674519 | 309973 | G | T |
| 002687F_337382_SNP\|\|S_164679163 | 337382 | G | A |
| 002687F_211731_SNP\|\|S_164661365 | 211731 | C | T |
| 002687F_220577_SNP\|\|S_164662407 | 220577 | G | A |
| 002687F_237097_SNP\|\|S_164664465 | 237097 | T | C |
| 002687F_266479_SNP\|\|S_164668817 | 266479 | C | A |
| 002687F_271386_SNP\|\|S_164669455 | 271386 | T | G |
| 002687F_273756_SNP\|\|S_164669758 | 273756 | C | T |
| 002687F_273817_SNP\|\|S_164669764 | 273817 | T | C |
| 002687F_276363_SNP\|\|S_164670071 | 276363 | G | A |
| 002687F_298340_SNP\|\|S_164672831 | 298340 | G | A |
| 002687F_238876_SNP\|\|S_164664664 | 238876 | T | A |
| 002687F_239424_SNP\|\|S_164664741 | 239424 | A | G |
| 002687F_256831_SNP\|\|S_164667336 | 256831 | G | A |
| 002687F_259186_SNP\|\|S_164667703 | 259186 | A | G |
| 002687F_275640_SNP\|\|S_164669976 | 275640 | G | A |
| 002687F_277720_SNP\|\|S_164670211 | 277720 | T | C |
| 002687F_279232_SNP\|\|S_164670381 | 279232 | C | T |
| 002687F_263744_SNP\|\|S_164668442 | 263744 | T | A |
| 002687F_304142_SNP\|\|S_164673806 | 304142 | A | G |
| 002687F_281179_SNP\|\|S_164670589 | 281179 | G | A |
| 002687F_236591_SNP\|\|S_164664403 | 236591 | G | A |
| 002687F_297512_SNP\|\|S_164672702 | 297512 | A | T |
| 002687F_305090_SNP\|\|S_164673953 | 305090 | T | A |
| 002687F_224674_SNP\|\|S_164662923 | 224674 | A | G |
| 002687F_275330_SNP\|\|S_164669940 | 275330 | A | G |
| 002687F_304685_SNP | 304685 | T | G |
| 002687F_319681_SNP | 319681 | T | C |
| 002687F_353495_SNP | 353495 | C | T |
| 002687F_52497_SNP\|\|S_164627583 | 52497 | T | C |
| 002687F_268767_SNP | 268767 | G | C |
| 002687F_278674_SNP | 278674 | A | G |
| 002687F_302719_SNP | 302719 | T | C |
| 002687F_343777_SNP | 343777 | T | C |
| 002687F_168567_SNP\|\|S_164655687 | 168567 | A | T |
| 002687F_325074_SNP\|\|S_164677221 | 325074 | T | G |
| 002687F_325106_SNP\|\|S_164677230 | 325106 | T | C |
| 002687F_333863_SNP | 333863 | A | G |
| 002687F_195487_SNP | 195487 | A | T |
| 002687F_228040_SNP\|\|S_164663308 | 228040 | T | A |
| 002687F_244345_SNP | 244345 | T | A |
| 002687F_278494_SNP\|\|S_164670290 | 278494 | A | G |
| 002687F_349619_SNP | 349619 | C | T |
| 002687F_198468_SNP | 198468 | G | T |
| 002687F_224844_SNP | 224844 | A | G |
| 002687F_224922_SNP | 224922 | A | G |
| 002687F_275515_SNP | 275515 | T | A |
| 002687F_292027_SNP | 292027 | T | A |
| 002687F_346308_SNP | 346308 | T | C |
| 002687F_362288_SNP | 362288 | A | C |
| 002687F_185377_SNP | 185377 | G | A |
| 002687F_220542_SNP | 220542 | G | A |
| 002687F_223788_SNP | 223788 | A | T |
| 002687F_343709_SNP | 343709 | T | C |
| 002687F_343862_SNP | 343862 | A | G |
| 002687F_201858_SNP | 201858 | T | G |
| 002687F_333763_SNP | 333763 | A | G |
| 002687F_347210_SNP | 347210 | A | G |
| 002687F_160730_SNP | 160730 | A | G |
| 002687F_161496_SNP | 161496 | A | G |
| 002687F_189663_SNP | 189663 | C | T |
| 002687F_341508_SNP | 341508 | A | T |
| 002687F_346605_SNP | 346605 | A | G |
| 002687F_362101_SNP | 362101 | G | A |

TABLE 4

| SNP Positions within SEQ ID NO: 4 that are associated with increased resistance to ASR | | | |
|---|---|---|---|
| SNP Name | Position | Favorable Allele (Rust Resistant) | Unfavorable Allele (Rust Susceptible) |
| 001084F-001-01__1285__SNP\|\|S__96261695 | 1285 | T | A |
| 001084F-001-01__1521__SNP\|\|S__96261716 | 1521 | C | A |
| 001084F-001-01__2588__SNP\|\|S__96261833 | 2588 | A | G |
| 001084F-001-01__2699__SNP\|\|S__96261849 | 2699 | G | A |
| 001084F-001-01__7021__SNP\|\|S__96262358 | 7021 | T | C |
| 001084F-001-01__8184__SNP\|\|S__96262509 | 8184 | G | A |
| 001084F-001-01__9147__SNP\|\|S__96262590 | 9147 | G | T |
| 001084F-001-01__10435__SNP\|\|S__96262737 | 10435 | G | C |
| 001084F-001-01__13118__SNP\|\|S__96263136 | 13118 | C | T |
| 001084F__27070__SNP\|\|S__96182069 | 27070 | T | C |
| 001084F__28184__SNP\|\|S__96182234 | 28184 | G | T |
| 001084F__31379__SNP\|\|S__96182641 | 31379 | C | G |
| 001084F__32184__SNP\|\|S__96182765 | 32184 | C | T |
| 001084F__42660__SNP\|\|S__96183942 | 42660 | T | A |
| 001084F__52001__SNP\|\|S__96185095 | 52001 | C | T |
| 001084F__52023__SNP | 52023 | A | G |
| 001084F__57467__SNP\|\|S__96185758 | 57467 | A | C |
| 001084F__57737__SNP\|\|S__96185798 | 57737 | C | G |
| 001084F__58089__SNP\|\|S__96185849 | 58089 | G | A |
| 001084F__63976__SNP\|\|S__96186652 | 63976 | G | A |
| 001084F__65903__SNP\|\|S__96186876 | 65903 | A | G |
| 001084F__82007__SNP\|\|S__96188830 | 82007 | G | T |
| 001084F-001-01__82274__SNP\|\|S__96272178 | 82274 | T | G |
| 001084F__84479__SNP\|\|S__96189187 | 84479 | T | G |
| 001084F__85287__SNP\|\|S__96189334 | 85287 | A | C |
| 001084F__85888__SNP\|\|S__96189417 | 85888 | A | T |
| 001084F__86201__SNP\|\|S__96189465 | 86201 | C | T |
| 001084F-001-01__86502__SNP\|\|S__96272667 | 86502 | A | G |
| 001084F__87914__SNP\|\|S__96189697 | 87914 | G | A |
| 001084F__88555__SNP\|\|S__96189801 | 88555 | T | A |
| 001084F__93651__SNP\|\|S__96190428 | 93651 | G | A |
| 001084F__95283__SNP\|\|S__96190621 | 95283 | G | C |
| 001084F-001-01__97554__SNP\|\|S__96274217 | 97554 | A | C |
| 001084F__98814__SNP\|\|S__96191018 | 98814 | C | A |
| 001084F__103767__SNP\|\|S__96191744 | 103767 | T | A |
| 001084F__106721__SNP\|\|S__96192163 | 106721 | G | T |
| 001084F__110421__SNP\|\|S__96192646 | 110421 | C | G |
| 001084F__111143__SNP\|\|S__96192765 | 111143 | C | T |
| 001084F__111365__SNP\|\|S__96192803 | 111365 | A | G |
| 001084F__113202__SNP\|\|S__96193055 | 113202 | A | T |
| 001084F__114276__SNP | 114276 | G | T |
| 001084F__114340__SNP\|\|S__96193207 | 114340 | A | G |
| 001084F__114450__SNP\|\|S__96193224 | 114450 | T | C |
| 001084F__114536__SNP\|\|S__96193238 | 114536 | G | A |
| 001084F__115661__SNP\|\|S__96193442 | 115661 | T | C |
| 001084F__121396__SNP\|\|S__96194243 | 121396 | A | T |
| 001084F__122184__SNP\|\|S__96194326 | 122184 | A | G |
| 001084F__123018__SNP\|\|S__96194413 | 123018 | T | C |
| 001084F__123034__SNP\|\|S__96194416 | 123034 | A | T |
| 001084F__124257__SNP\|\|S__96194591 | 124257 | A | C |
| 001084F__124583__SNP\|\|S__96194626 | 124583 | G | A |
| 001084F__125117__SNP\|\|S__96194736 | 125117 | C | A |
| 001084F__125329__SNP\|\|S__96194763 | 125329 | C | G |
| 001084F__125691__SNP\|\|S__96194803 | 125691 | T | C |
| 001084F__126047__SNP\|\|S__96194860 | 126047 | A | T |
| 001084F__126132__SNP\|\|S__96194877 | 126132 | G | A |
| 001084F__126350__SNP | 126350 | A | G |
| 001084F__126379__SNP\|\|S__96194890 | 126379 | G | A |
| 001084F__126664__SNP\|\|S__96194933 | 126664 | A | G |
| 001084F__126712__SNP\|\|S__96194939 | 126712 | G | C |
| 001084F-001-01__127911__SNP\|\|S__96278033 | 127911 | C | T |
| 001084F__129197__SNP\|\|S__96195328 | 129197 | A | G |
| 001084F__129484__SNP\|\|S__96195378 | 129484 | T | C |
| 001084F__130167__SNP\|\|S__96195529 | 130167 | C | T |
| 001084F__130305__SNP\|\|S__96195546 | 130305 | A | G |
| 001084F__130497__SNP\|\|S__96195566 | 130497 | C | A |
| 001084F__130604__SNP | 130604 | A | C |
| 001084F__132646__SNP\|\|S__96195748 | 132646 | A | C |
| 001084F__132795__SNP\|\|S__96195769 | 132795 | A | C |
| 001084F__133258__SNP\|\|S__96195812 | 133258 | A | C |
| 001084F__133487__SNP\|\|S__96195836 | 133487 | T | A |
| 001084F__139504__SNP\|\|S__96195994 | 139504 | T | C |
| 001084F__140393__SNP\|\|S__96196060 | 140393 | G | A |

TABLE 4-continued

SNP Positions within SEQ ID NO: 4 that are associated with increased resistance to ASR

| SNP Name | Position | Favorable Allele (Rust Resistant) | Unfavorable Allele (Rust Susceptible) |
|---|---|---|---|
| 001084F_140734_SNP\|\|S_96196116 | 140734 | G | A |
| 001084F_140889_SNP\|\|S_96196121 | 140889 | G | A |
| 001084F_140943_SNP\|\|S_96196125 | 140943 | C | G |
| 001084F_140956_SNP\|\|S_96196127 | 140956 | T | C |
| 001084F_141136_SNP\|\|S_96196151 | 141136 | C | T |
| 001084F_141999_SNP\|\|S_96196230 | 141999 | A | T |
| 001084F_142002_SNP\|\|S_96196231 | 142002 | T | C |
| 001084F_142266_SNP\|\|S_96196269 | 142266 | G | A |
| 001084F_142328_SNP\|\|S_96196272 | 142328 | A | G |
| 001084F_142364_SNP\|\|S_96196276 | 142364 | A | T |
| 001084F_142627_SNP | 142627 | T | C |
| 001084F_142993_SNP\|\|S_96196324 | 142993 | A | C |
| 001084F_143091_SNP\|\|S_96196333 | 143091 | A | T |
| 001084F_143145_SNP\|\|S_96196341 | 143145 | T | C |
| 001084F_143227_SNP\|\|S_96196350 | 143227 | A | C |
| 001084F_143257_SNP\|\|S_96196353 | 143257 | A | G |
| 001084F_144001_SNP\|\|S_96196414 | 144001 | A | C |
| 001084F_144670_SNP\|\|S_96196479 | 144670 | A | G |
| 001084F_144689_SNP\|\|S_96196480 | 144689 | G | A |
| 001084F_144794_SNP\|\|S_96196492 | 144794 | A | C |
| 001084F_145076_SNP | 145076 | C | T |
| 001084F_147040_SNP\|\|S_96196783 | 147040 | G | T |
| 001084F_148598_SNP\|\|S_96196947 | 148598 | G | A |
| 001084F_150856_SNP\|\|S_96197142 | 150856 | G | A |
| 001084F_150890_SNP\|\|S_96197144 | 150890 | C | T |
| 001084F_150946_SNP\|\|S_96197148 | 150946 | C | G |
| 001084F_151501_SNP\|\|S_96197186 | 151501 | C | T |
| 001084F_151988_SNP\|\|S_96197248 | 151988 | G | T |
| 001084F_152716_SNP\|\|S_96197335 | 152716 | A | C |
| 001084F_152718_SNP\|\|S_96197336 | 152718 | G | A |
| 001084F_153080_SNP\|\|S_96197385 | 153080 | G | T |
| 001084F_154824_SNP\|\|S_96197620 | 154824 | T | A |
| 001084F_155266_SNP\|\|S_96197675 | 155266 | A | T |
| 001084F_156572_SNP\|\|S_96197878 | 156572 | G | A |
| 001084F_157730_SNP\|\|S_96198007 | 157730 | T | C |
| 001084F_158682_SNP\|\|S_96198187 | 158682 | T | C |
| 001084F_158723_SNP\|\|S_96198192 | 158723 | T | G |
| 001084F_158742_SNP\|\|S_96198194 | 158742 | G | A |
| 001084F_159166_SNP\|\|S_96198257 | 159166 | A | T |
| 001084F_159313_SNP\|\|S_96198276 | 159313 | A | G |
| 001084F_159442_SNP\|\|S_96198291 | 159442 | C | T |
| 001084F_159587_SNP\|\|S_96198308 | 159587 | T | C |
| 001084F_160320_SNP\|\|S_96198404 | 160320 | A | C |
| 001084F_160645_SNP\|\|S_96198429 | 160645 | T | C |
| 001084F_161095_SNP\|\|S_96198508 | 161095 | C | T |
| 001084F_161709_SNP\|\|S_96198644 | 161709 | C | T |
| 001084F_162179_SNP\|\|S_96198670 | 162179 | C | G |
| 001084F_162814_SNP\|\|S_96198732 | 162814 | A | T |
| 001084F_163017_SNP\|\|S_96198749 | 163017 | C | A |
| 001084F_163383_SNP\|\|S_96198774 | 163383 | G | T |
| 001084F_163680_SNP\|\|S_96198808 | 163680 | G | A |
| 001084F_164905_SNP\|\|S_96198896 | 164905 | C | A |
| 001084F_167287_SNP\|\|S_96199111 | 167287 | G | T |
| 001084F_167515_SNP\|\|S_96199122 | 167515 | G | C |
| 001084F_167652_SNP\|\|S_96199135 | 167652 | T | C |
| 001084F_167962_SNP\|\|S_96199157 | 167962 | A | T |
| 001084F_168247_SNP\|\|S_96199187 | 168247 | T | A |
| 001084F_168725_SNP\|\|S_96199246 | 168725 | A | G |
| 001084F_168757_SNP\|\|S_96199252 | 168757 | C | T |
| 001084F_169076_SNP\|\|S_96199300 | 169076 | A | G |
| 001084F_169079_SNP\|\|S_96199301 | 169079 | C | T |
| 001084F_169225_SNP\|\|S_96199313 | 169225 | T | C |
| 001084F_169491_SNP\|\|S_96199351 | 169491 | A | G |
| 001084F_169747_SNP\|\|S_96199380 | 169747 | G | T |
| 001084F_170170_SNP\|\|S_96199415 | 170170 | A | G |
| 001084F_170426_SNP\|\|S_96199442 | 170426 | A | T |
| 001084F_170606_SNP\|\|S_96199460 | 170606 | A | C |
| 001084F_170818_SNP\|\|S_96199484 | 170818 | T | G |
| 001084F_171563_SNP\|\|S_96199521 | 171563 | A | G |
| 001084F_172571_SNP\|\|S_96199666 | 172571 | G | T |
| 001084F_172598_SNP\|\|S_96199673 | 172598 | G | C |
| 001084F_172978_SNP\|\|S_96199717 | 172978 | A | G |
| 001084F_173956_SNP\|\|S_96199838 | 173956 | C | T |

TABLE 4-continued

SNP Positions within SEQ ID NO: 4 that are associated with increased resistance to ASR

| SNP Name | Position | Favorable Allele (Rust Resistant) | Unfavorable Allele (Rust Susceptible) |
|---|---|---|---|
| 001084F_174469_SNP\|\|S_96199929 | 174469 | T | G |
| 001084F_174541_SNP\|\|S_96199946 | 174541 | G | C |
| 001084F_174758_SNP\|\|S_96199978 | 174758 | C | T |
| 001084F_174810_SNP\|\|S_96199982 | 174810 | C | G |
| 001084F_175992_SNP\|\|S_96200176 | 175992 | A | T |
| 001084F_176004_SNP\|\|S_96200178 | 176004 | G | A |
| 001084F_176028_SNP\|\|S_96200179 | 176028 | A | G |
| 001084F_176079_SNP\|\|S_96200184 | 176079 | G | A |
| 001084F_176112_SNP\|\|S_96200191 | 176112 | T | C |
| 001084F_176675_SNP\|\|S_96200247 | 176675 | C | T |
| 001084F_176780_SNP\|\|S_96200251 | 176780 | A | G |
| 001084F_176983_SNP\|\|S_96200275 | 176983 | A | T |
| 001084F_177786_SNP\|\|S_96200387 | 177786 | C | A |
| 001084F_177903_SNP\|\|S_96200440 | 177903 | G | A |
| 001084F_177935_SNP\|\|S_96200455 | 177935 | G | A |
| 001084F_178018_SNP\|\|S_96200464 | 178018 | A | T |
| 001084F_178034_SNP\|\|S_96200468 | 178034 | C | A |
| 001084F_178300_SNP\|\|S_96200512 | 178300 | C | G |
| 001084F_178555_SNP\|\|S_96200539 | 178555 | A | G |
| 001084F_178630_SNP\|\|S_96200546 | 178630 | G | A |
| 001084F_179301_SNP\|\|S_96200625 | 179301 | A | T |
| 001084F_179344_SNP\|\|S_96200632 | 179344 | C | T |
| 001084F_179983_SNP\|\|S_96200681 | 179983 | C | T |
| 001084F_179991_SNP\|\|S_96200682 | 179991 | C | T |
| 001084F_179996_SNP\|\|S_96200683 | 179996 | C | A |
| 001084F_180047_SNP\|\|S_96200686 | 180047 | C | G |
| 001084F_180211_SNP | 180211 | A | T |
| 001084F_180253_SNP\|\|S_96200700 | 180253 | A | G |
| 001084F_180363_SNP\|\|S_96200718 | 180363 | A | G |
| 001084F_181550_SNP\|\|S_96200860 | 181550 | A | C |
| 001084F_184764_SNP\|\|S_96201129 | 184764 | C | A |
| 001084F_185504_SNP\|\|S_96201216 | 185504 | G | A |
| 001084F_185881_SNP\|\|S_96201245 | 185881 | T | C |
| 001084F_185892_SNP\|\|S_96201246 | 185892 | A | T |
| 001084F_186629_SNP\|\|S_96201304 | 186629 | A | G |
| 001084F_188635_SNP\|\|S_96201526 | 188635 | A | G |
| 001084F_190570_SNP\|\|S_96201789 | 190570 | T | C |
| 001084F_198311_SNP\|\|S_96202837 | 198311 | A | T |
| 001084F_199171_SNP\|\|S_96202922 | 199171 | G | A |
| 001084F_202466_SNP\|\|S_96203367 | 202466 | T | C |
| 001084F_205193_SNP\|\|S_96203796 | 205193 | T | A |
| 001084F_211317_SNP\|\|S_96204657 | 211317 | A | T |
| 001084F_213117_SNP\|\|S_96204953 | 213117 | T | C |
| 001084F_213481_SNP\|\|S_96205009 | 213481 | T | C |
| 001084F_213587_SNP\|\|S_96205028 | 213587 | G | T |
| 001084F_218631_SNP\|\|S_96205568 | 218631 | G | A |
| 001084F_226564_SNP\|\|S_96206645 | 226564 | C | T |
| 001084F_227857_SNP\|\|S_96206816 | 227857 | G | A |
| 001084F_237891_SNP\|\|S_96208029 | 237891 | A | C |
| 001084F_239017_SNP\|\|S_96208161 | 239017 | C | T |
| 001084F_239368_SNP\|\|S_96208190 | 239368 | T | G |
| 001084F_239536_SNP\|\|S_96208211 | 239536 | C | T |
| 001084F_239682_SNP\|\|S_96208242 | 239682 | T | A |
| 001084F_245799_SNP\|\|S_96209112 | 245799 | A | T |
| 001084F_246318_SNP\|\|S_96209151 | 246318 | C | T |
| 001084F_246386_SNP\|\|S_96209159 | 246386 | A | T |
| 001084F_249008_SNP\|\|S_96209600 | 249008 | A | G |
| 001084F_250639_SNP | 250639 | T | C |
| 001084F_250641_SNP | 250641 | C | T |
| 001084F_251193_SNP\|\|S_96209831 | 251193 | T | C |
| 001084F_251515_SNP\|\|S_96209892 | 251515 | A | G |
| 001084F_252366_SNP\|\|S_96209966 | 252366 | T | C |
| 001084F_252578_SNP\|\|S_96209979 | 252578 | C | G |
| 001084F_253950_SNP\|\|S_96210134 | 253950 | C | G |
| 001084F_253956_SNP\|\|S_96210135 | 253956 | G | A |
| 001084F_254157_SNP\|\|S_96210146 | 254157 | T | G |
| 001084F_254286_SNP\|\|S_96210168 | 254286 | G | T |
| 001084F_254514_SNP\|\|S_96210191 | 254514 | A | G |
| 001084F_254545_SNP\|\|S_96210194 | 254545 | A | G |
| 001084F_255300_SNP\|\|S_96210279 | 255300 | G | C |
| 001084F_255476_SNP\|\|S_96210306 | 255476 | C | T |
| 001084F_255933_SNP\|\|S_96210349 | 255933 | C | T |
| 001084F_255992_SNP\|\|S_96210355 | 255992 | G | A |

TABLE 4-continued

SNP Positions within SEQ ID NO: 4 that are associated with increased resistance to ASR

| SNP Name | Position | Favorable Allele (Rust Resistant) | Unfavorable Allele (Rust Susceptible) |
|---|---|---|---|
| 001084F_256289_SNP\|\|S_96210412 | 256289 | C | T |
| 001084F_256296_SNP\|\|S_96210413 | 256296 | A | G |
| 001084F_256670_SNP\|\|S_96210467 | 256670 | T | A |
| 001084F_256861_SNP\|\|S_96210477 | 256861 | T | C |
| 001084F_256888_SNP\|\|S_96210478 | 256888 | T | G |
| 001084F_256929_SNP\|\|S_96210482 | 256929 | G | A |
| 001084F_257126_SNP\|\|S_96210501 | 257126 | C | T |
| 001084F_257133_SNP\|\|S_96210503 | 257133 | T | C |
| 001084F_257136_SNP\|\|S_96210504 | 257136 | T | C |
| 001084F_257289_SNP\|\|S_96210519 | 257289 | T | C |
| 001084F_257327_SNP\|\|S_96210520 | 257327 | A | G |
| 001084F_257534_SNP\|\|S_96210589 | 257534 | G | C |
| 001084F_257676_SNP\|\|S_96210618 | 257676 | C | T |
| 001084F_257874_SNP\|\|S_96210661 | 257874 | C | G |
| 001084F_257934_SNP\|\|S_96210667 | 257934 | G | A |
| 001084F_258230_SNP\|\|S_96210699 | 258230 | C | G |
| 001084F_258395_SNP\|\|S_96210734 | 258395 | C | G |
| 001084F_258418_SNP\|\|S_96210739 | 258418 | G | T |
| 001084F_258653_SNP\|\|S_96210766 | 258653 | A | G |
| 001084F_259060_SNP\|\|S_96210844 | 259060 | C | A |
| 001084F_259168_SNP | 259168 | G | T |
| 001084F_259273_SNP\|\|S_96210882 | 259273 | A | G |
| 001084F_259443_SNP\|\|S_96210898 | 259443 | C | G |
| 001084F_260067_SNP\|\|S_96210964 | 260067 | C | T |
| 001084F_260664_SNP\|\|S_96211072 | 260664 | T | C |
| 001084F_261242_SNP\|\|S_96211105 | 261242 | G | A |
| 001084F_262054_SNP\|\|S_96211201 | 262054 | G | A |
| 001084F_262740_SNP\|\|S_96211245 | 262740 | C | A |
| 001084F_263131_SNP\|\|S_96211295 | 263131 | C | T |
| 001084F_263585_SNP\|\|S_96211367 | 263585 | A | C |
| 001084F_263650_SNP\|\|S_96211378 | 263650 | G | A |
| 001084F_263970_SNP\|\|S_96211410 | 263970 | T | C |
| 001084F_264720_SNP\|\|S_96211554 | 264720 | A | T |
| 001084F_265298_SNP\|\|S_96211619 | 265298 | A | C |
| 001084F_265844_SNP\|\|S_96211678 | 265844 | C | T |
| 001084F_265895_SNP\|\|S_96211683 | 265895 | A | G |
| 001084F_268195_SNP\|\|S_96211902 | 268195 | T | G |
| 001084F_270197_SNP\|\|S_96212223 | 270197 | G | A |
| 001084F_271842_SNP\|\|S_96212410 | 271842 | A | G |
| 001084F_272342_SNP\|\|S_96212494 | 272342 | T | C |
| 001084F_272520_SNP\|\|S_96212517 | 272520 | C | T |
| 001084F_273104_SNP\|\|S_96212595 | 273104 | C | A |
| 001084F_273591_SNP\|\|S_96212652 | 273591 | T | C |
| 001084F_273652_SNP\|\|S_96212656 | 273652 | A | C |
| 001084F_275546_SNP\|\|S_96212833 | 275546 | T | C |
| 001084F_275658_SNP\|\|S_96212859 | 275658 | T | A |
| 001084F_278078_SNP\|\|S_96213204 | 278078 | G | A |
| 001084F_279158_SNP\|\|S_96213320 | 279158 | A | C |
| 001084F_279575_SNP\|\|S_96213380 | 279575 | A | G |
| 001084F_279729_SNP\|\|S_96213387 | 279729 | C | G |
| 001084F_279954_SNP\|\|S_96213419 | 279954 | C | T |
| 001084F_281389_SNP\|\|S_96213625 | 281389 | C | T |
| 001084F_281513_SNP\|\|S_96213642 | 281513 | C | T |
| 001084F_281542_SNP\|\|S_96213648 | 281542 | C | T |
| 001084F_285388_SNP\|\|S_96214072 | 285388 | C | T |
| 001084F_285487_SNP\|\|S_96214096 | 285487 | C | T |
| 001084F_285683_SNP\|\|S_96214122 | 285683 | C | T |
| 001084F_285771_SNP\|\|S_96214134 | 285771 | G | T |
| 001084F_286094_SNP\|\|S_96214209 | 286094 | A | G |
| 001084F_286116_SNP\|\|S_96214211 | 286116 | A | G |
| 001084F_288436_SNP\|\|S_96214424 | 288436 | A | T |
| 001084F_292939_SNP\|\|S_96215141 | 292939 | G | C |
| 001084F_293422_SNP\|\|S_96215191 | 293422 | C | T |
| 001084F_293810_SNP\|\|S_96215229 | 293810 | A | G |
| 001084F_295524_SNP\|\|S_96215424 | 295524 | A | G |
| 001084F_299778_SNP\|\|S_96215969 | 299778 | A | G |
| 001084F_299821_SNP\|\|S_96215974 | 299821 | G | T |
| 001084F_300075_SNP\|\|S_96215990 | 300075 | G | A |
| 001084F_300887_SNP\|\|S_96216153 | 300887 | A | G |
| 001084F_301156_SNP\|\|S_96216230 | 301156 | G | A |
| 001084F_301165_SNP\|\|S_96216235 | 301165 | T | C |
| 001084F_301641_SNP\|\|S_96216305 | 301641 | A | G |
| 001084F_301793_SNP\|\|S_96216321 | 301793 | A | C |

TABLE 4-continued

SNP Positions within SEQ ID NO: 4 that are associated with increased resistance to ASR

| SNP Name | Position | Favorable Allele (Rust Resistant) | Unfavorable Allele (Rust Susceptible) |
|---|---|---|---|
| 001084F_301853_SNP\|\|S_96216333 | 301853 | C | T |
| 001084F_302997_SNP | 302997 | C | T |
| 001084F_303003_SNP | 303003 | C | T |
| 001084F_304597_SNP\|\|S_96216721 | 304597 | G | A |
| 001084F_304622_SNP\|\|S_96216723 | 304622 | T | C |
| 001084F_304909_SNP\|\|S_96216751 | 304909 | T | C |
| 001084F_305891_SNP\|\|S_96216891 | 305891 | G | A |
| 001084F_306716_SNP\|\|S_96217046 | 306716 | G | A |
| 001084F_307693_SNP | 307693 | G | A |
| 001084F_310749_SNP\|\|S_96217542 | 310749 | C | T |
| 001084F_313646_SNP\|\|S_96217955 | 313646 | A | T |
| 001084F_313895_SNP\|\|S_96217991 | 313895 | A | G |
| 001084F_314482_SNP\|\|S_96218079 | 314482 | G | T |
| 001084F_315263_SNP\|\|S_96218215 | 315263 | G | A |
| 001084F_315605_SNP\|\|S_96218253 | 315605 | C | A |
| 001084F_316003_SNP\|\|S_96218288 | 316003 | C | A |
| 001084F_325995_SNP\|\|S_96219601 | 325995 | T | G |
| 001084F_326011_SNP\|\|S_96219606 | 326011 | A | G |
| 001084F_326714_SNP\|\|S_96219700 | 326714 | C | T |
| 001084F_327975_SNP\|\|S_96219824 | 327975 | T | A |
| 001084F_333039_SNP\|\|S_96220391 | 333039 | T | C |
| 001084F_335872_SNP\|\|S_96220742 | 335872 | A | G |
| 001084F_336344_SNP\|\|S_96220819 | 336344 | G | T |
| 001084F_337412_SNP\|\|S_96220956 | 337412 | C | T |
| 001084F_344980_SNP\|\|S_96221826 | 344980 | A | C |
| 001084F_345034_SNP\|\|S_96221832 | 345034 | T | G |
| 001084F_346595_SNP | 346595 | T | G |
| 001084F_346779_SNP | 346779 | T | C |
| 001084F_366657_SNP\|\|S_96224390 | 366657 | C | A |
| 001084F_368696_SNP\|\|S_96224623 | 368696 | A | G |
| 001084F_370079_SNP\|\|S_96224756 | 370079 | A | G |
| 001084F_370253_SNP\|\|S_96224774 | 370253 | T | C |
| 001084F_380989_SNP\|\|S_96226270 | 380989 | A | G |
| 001084F_382368_SNP\|\|S_96226437 | 382368 | C | T |
| 001084F_386547_SNP\|\|S_96226875 | 386547 | C | T |
| 001084F_392211_SNP\|\|S_96227525 | 392211 | C | T |
| 001084F_392954_SNP | 392954 | G | C |
| 001084F_393013_SNP\|\|S_96227637 | 393013 | T | C |
| 001084F_393748_SNP\|\|S_96227753 | 393748 | T | C |
| 001084F_394557_SNP\|\|S_96227856 | 394557 | G | A |
| 001084F_395656_SNP\|\|S_96228004 | 395656 | A | G |
| 001084F_395876_SNP\|\|S_96228023 | 395876 | T | A |
| 001084F_397385_SNP\|\|S_96228189 | 397385 | G | T |
| 001084F_398551_SNP\|\|S_96228339 | 398551 | C | T |
| 001084F_404731_SNP\|\|S_96229018 | 404731 | A | G |
| 001084F_404792_SNP\|\|S_96229021 | 404792 | T | A |
| 001084F_405196_SNP\|\|S_96229072 | 405196 | C | T |
| 001084F_405197_SNP\|\|S_96229073 | 405197 | A | C |
| 001084F_405198_SNP\|\|S_96229074 | 405198 | T | A |
| 001084F_405731_SNP\|\|S_96229143 | 405731 | C | G |
| 001084F_407194_SNP\|\|S_96229325 | 407194 | A | G |
| 001084F_409622_SNP\|\|S_96229641 | 409622 | A | T |
| 001084F_410452_SNP\|\|S_96229734 | 410452 | C | T |
| 001084F_412571_SNP\|\|S_96229970 | 412571 | T | C |
| 001084F_412785_SNP\|\|S_96230001 | 412785 | A | G |
| 001084F_413752_SNP\|\|S_96230139 | 413752 | G | A |
| 001084F_416185_SNP\|\|S_96230412 | 416185 | G | T |
| 001084F_416395_SNP\|\|S_96230427 | 416395 | C | A |
| 001084F_416591_SNP\|\|S_96230446 | 416591 | T | G |
| 001084F_416593_SNP\|\|S_96230447 | 416593 | G | C |
| 001084F_417106_SNP\|\|S_96230492 | 417106 | G | C |
| 001084F_419325_SNP\|\|S_96230786 | 419325 | A | G |
| 001084F_419460_SNP\|\|S_96230801 | 419460 | C | A |
| 001084F_420529_SNP\|\|S_96230939 | 420529 | C | T |
| 001084F_420584_SNP\|\|S_96230944 | 420584 | A | G |
| 001084F_421121_SNP\|\|S_96231014 | 421121 | T | C |
| 001084F_427016_SNP\|\|S_96231729 | 427016 | G | C |
| 001084F_432148_SNP\|\|S_96232338 | 432148 | A | G |
| 001084F_432700_SNP\|\|S_96232398 | 432700 | A | G |
| 001084F_432798_SNP\|\|S_96232404 | 432798 | A | G |
| 001084F_433511_SNP\|\|S_96232528 | 433511 | C | T |
| 001084F_433994_SNP\|\|S_96232606 | 433994 | T | A |
| 001084F_434231_SNP\|\|S_96232644 | 434231 | G | T |

TABLE 4-continued

SNP Positions within SEQ ID NO: 4 that are associated with increased resistance to ASR

| SNP Name | Position | Favorable Allele (Rust Resistant) | Unfavorable Allele (Rust Susceptible) |
|---|---|---|---|
| 001084F_436588_SNP||S_96232887 | 436588 | A | G |
| 001084F_437273_SNP||S_96232934 | 437273 | T | C |
| 001084F_439876_SNP||S_96233294 | 439876 | T | G |
| 001084F_446565_SNP||S_96234158 | 446565 | C | A |
| 001084F_446712_SNP||S_96234176 | 446712 | A | G |
| 001084F_446950_SNP||S_96234212 | 446950 | C | T |
| 001084F_448070_SNP||S_96234319 | 448070 | T | C |
| 001084F_448364_SNP||S_96234350 | 448364 | C | T |
| 001084F_449012_SNP | 449012 | A | G |
| 001084F_449590_SNP||S_96234450 | 449590 | C | T |
| 001084F_451682_SNP||S_96234684 | 451682 | T | C |
| 001084F_453264_SNP | 453264 | A | G |
| 001084F_454594_SNP||S_96235135 | 454594 | G | A |
| 001084F_457770_SNP||S_96235545 | 457770 | T | C |
| 001084F_458788_SNP||S_96235648 | 458788 | A | G |
| 001084F_459147_SNP||S_96235687 | 459147 | C | T |
| 001084F_461166_SNP||S_96236019 | 461166 | A | G |
| 001084F_461247_SNP||S_96236039 | 461247 | G | A |
| 001084F_461752_SNP||S_96236125 | 461752 | C | T |
| 001084F_466437_SNP||S_96236630 | 466437 | T | G |
| 001084F_466805_SNP||S_96236678 | 466805 | T | C |
| 001084F_467644_SNP||S_96236780 | 467644 | A | C |
| 001084F_468704_SNP||S_96236898 | 468704 | T | A |
| 001084F_471659_SNP||S_96237333 | 471659 | T | A |
| 001084F_471667_SNP||S_96237334 | 471667 | G | T |
| 001084F_471959_SNP||S_96237354 | 471959 | T | G |
| 001084F_474765_SNP||S_96237787 | 474765 | T | C |
| 001084F_475731_SNP||S_96237878 | 475731 | A | T |
| 001084F_476014_SNP||S_96237900 | 476014 | A | T |
| 001084F_481574_SNP||S_96238618 | 481574 | C | T |
| 001084F_481748_SNP||S_96238640 | 481748 | A | T |
| 001084F_481949_SNP||S_96238661 | 481949 | T | A |
| 001084F_483822_SNP||S_96238932 | 483822 | C | T |
| 001084F_483922_SNP||S_96238940 | 483922 | A | C |
| 001084F_491255_SNP||S_96239840 | 491255 | T | C |
| 001084F_491264_SNP||S_96239843 | 491264 | C | T |
| 001084F_491333_SNP||S_96239854 | 491333 | A | G |
| 001084F_491388_SNP||S_96239874 | 491388 | C | T |
| 001084F_491438_SNP||S_96239884 | 491438 | C | A |
| 001084F_491456_SNP||S_96239888 | 491456 | T | C |
| 001084F_491474_SNP||S_96239891 | 491474 | A | G |
| 001084F_492676_SNP||S_96240013 | 492676 | C | G |
| 001084F_492681_SNP||S_96240014 | 492681 | C | T |
| 001084F_493223_SNP||S_96240071 | 493223 | G | A |
| 001084F_493257_SNP||S_96240074 | 493257 | C | T |
| 001084F_495167_SNP||S_96240310 | 495167 | G | T |
| 001084F_495237_SNP||S_96240320 | 495237 | A | G |
| 001084F_496103_SNP | 496103 | C | A |
| 001084F_511172_SNP||S_96242515 | 511172 | T | C |
| 001084F_575347_SNP||S_96250573 | 575347 | A | G |
| 001084F_577730_SNP||S_96251010 | 577730 | G | A |
| 001084F_578149_SNP||S_96251054 | 578149 | G | A |
| 001084F_579372_SNP||S_96251212 | 579372 | A | G |
| 001084F_586316_SNP||S_96252046 | 586316 | A | G |
| 001084F_589859_SNP||S_96252610 | 589859 | T | C |
| 001084F_589957_SNP||S_96252616 | 589957 | T | C |
| 001084F_589968_SNP||S_96252619 | 589968 | T | C |
| 001084F_590712_SNP||S_96252758 | 590712 | T | C |
| 001084F_591010_SNP||S_96252775 | 591010 | T | A |
| 001084F_591944_SNP||S_96252903 | 591944 | C | A |
| 001084F_592110_SNP||S_96252917 | 592110 | C | T |
| 001084F_592173_SNP||S_96252923 | 592173 | G | A |
| 001084F_594029_SNP||S_96253180 | 594029 | A | G |
| 001084F_594234_SNP||S_96253198 | 594234 | T | C |
| 001084F_594408_SNP||S_96253219 | 594408 | C | T |
| 001084F_594539_SNP||S_96253244 | 594539 | G | A |
| 001084F_595688_SNP||S_96253403 | 595688 | C | T |
| 001084F_595748_SNP||S_96253409 | 595748 | A | G |
| 001084F_596093_SNP||S_96253455 | 596093 | A | C |
| 001084F_598845_SNP||S_96253843 | 598845 | G | A |
| 001084F_599340_SNP||S_96253911 | 599340 | A | C |
| 001084F_600996_SNP||S_96254147 | 600996 | A | G |
| 001084F_601300_SNP||S_96254185 | 601300 | T | C |

TABLE 4-continued

SNP Positions within SEQ ID NO: 4 that are associated with increased resistance to ASR

| SNP Name | Position | Favorable Allele (Rust Resistant) | Unfavorable Allele (Rust Susceptible) |
|---|---|---|---|
| 001084F__601957__SNP\|\|S__96254250 | 601957 | G | A |
| 001084F__602486__SNP | 602486 | C | T |
| 001084F__606403__SNP\|\|S__96254906 | 606403 | C | G |
| 001084F__607071__SNP\|\|S__96254986 | 607071 | G | T |
| 001084F__610092__SNP\|\|S__96255394 | 610092 | T | C |
| 001084F__610896__SNP\|\|S__96255567 | 610896 | A | G |
| 001084F__611678__SNP\|\|S__96255725 | 611678 | C | T |
| 001084F__612116__SNP\|\|S__96255826 | 612116 | C | T |
| 001084F__613144__SNP\|\|S__96256025 | 613144 | A | G |
| 001084F__614025__SNP | 614025 | G | A |
| 001084F__616919__SNP\|\|S__96256727 | 616919 | T | G |
| 001084F__617682__SNP\|\|S__96256806 | 617682 | A | T |
| 001084F__617849__SNP\|\|S__96256827 | 617849 | A | G |
| 001084F__618353__SNP | 618353 | T | C |
| 001084F__621278__SNP\|\|S__96257215 | 621278 | G | T |
| 001084F__621394__SNP\|\|S__96257226 | 621394 | T | C |
| 001084F__623147__SNP\|\|S__96257479 | 623147 | A | G |
| 001084F__624529__SNP | 624529 | T | A |
| 001084F__627999__SNP\|\|S__96258130 | 627999 | T | G |
| 001084F__628120__SNP\|\|S__96258147 | 628120 | C | T |
| 001084F__628359__SNP\|\|S__96258172 | 628359 | T | G |
| 001084F__628992__SNP\|\|S__96258268 | 628992 | T | C |
| 001084F__629050__SNP\|\|S__96258285 | 629050 | A | G |
| 001084F__629328__SNP\|\|S__96258334 | 629328 | C | T |
| 001084F__630582__SNP\|\|S__96258523 | 630582 | G | C |
| 001084F__631413__SNP\|\|S__96258645 | 631413 | T | G |
| 001084F__633048__SNP\|\|S__96258882 | 633048 | A | T |
| 001084F__643660__SNP\|\|S__96261113 | 643660 | A | G |

TABLE 5

SNP Positions within SEQ ID NO: 5 that are associated with increased resistance to ASR

| SNP Name | Position | Favorable Allele (Rust Resistant) | Unfavorable Allele (Rust Susceptible) |
|---|---|---|---|
| 000819F/G__tomentella__PI__583970__v1 | 114599 | G | C |
| 000819F/G__tomentella__PI__583970__v1 | 149238 | C | T |
| 000819F/G__tomentella__PI__583970__v1 | 149288 | C | T |
| 000819F/G__tomentella__PI__583970__v1 | 150032 | T | C |
| 000819F/G__tomentella__PI__583970__v1 | 151944 | C | T |
| 000819F/G__tomentella__PI__583970__v1 | 152479 | A | T |
| 000819F/G__tomentella__PI__583970__v1 | 155540 | G | A |
| 000819F/G__tomentella__PI__583970__v1 | 162204 | A | C |
| 000819F/G__tomentella__PI__583970__v1 | 163754 | G | A |
| 000819F/G__tomentella__PI__583970__v1 | 165362 | A | C |
| 000819F/G__tomentella__PI__583970__v1 | 165535 | A | T |
| 000819F/G__tomentella__PI__583970__v1 | 165577 | G | C |
| 000819F/G__tomentella__PI__583970__v1 | 167131 | T | C |
| 000819F/G__tomentella__PI__583970__v1 | 171396 | A | G |
| 000819F/G__tomentella__PI__583970__v1 | 172021 | T | C |
| 000819F/G__tomentella__PI__583970__v1 | 172471 | G | C |
| 000819F/G__tomentella__PI__583970__v1 | 177992 | A | C |
| 000819F/G__tomentella__PI__583970__v1 | 180263 | A | C |
| 000819F/G__tomentella__PI__583970__v1 | 181800 | C | T |
| 000819F/G__tomentella__PI__583970__v1 | 193762 | C | T |
| 000819F/G__tomentella__PI__583970__v1 | 194604 | T | A |
| 000819F/G__tomentella__PI__583970__v1 | 205989 | T | A |
| 000819F/G__tomentella__PI__583970__v1 | 212017 | A | G |
| 000819F/G__tomentella__PI__583970__v1 | 213446 | C | T |
| 000819F/G__tomentella__PI__583970__v1 | 232768 | A | T |
| 000819F/G__tomentella__PI__583970__v1 | 245161 | G | A |
| 000819F/G__tomentella__PI__583970__v1 | 245854 | T | A |
| 000819F/G__tomentella__PI__583970__v1 | 246180 | C | A |
| 000819F/G__tomentella__PI__583970__v1 | 246738 | C | T |
| 000819F/G__tomentella__PI__583970__v1 | 246919 | G | A |
| 000819F/G__tomentella__PI__583970__v1 | 248321 | G | A |
| 000819F/G__tomentella__PI__583970__v1 | 252345 | A | G |

TABLE 5-continued

| SNP Positions within SEQ ID NO: 5 that are associated with increased resistance to ASR | | | |
|---|---|---|---|
| SNP Name | Position | Favorable Allele (Rust Resistant) | Unfavorable Allele (Rust Susceptible) |
| 000819F/G__tomentella__PI__583970__v1 | 252360 | A | T |
| 000819F/G__tomentella__PI__583970__v1 | 265534 | A | G |
| 000819F/G__tomentella__PI__583970__v1 | 266733 | T | C |
| 000819F/G__tomentella__PI__583970__v1 | 266773 | T | C |
| 000819F/G__tomentella__PI__583970__v1 | 266963 | G | A |
| 000819F/G__tomentella__PI__583970__v1 | 267269 | A | T |
| 000819F/G__tomentella__PI__583970__v1 | 267342 | G | A |
| 000819F/G__tomentella__PI__583970__v1 | 267921 | C | T |
| 000819F/G__tomentella__PI__583970__v1 | 267929 | A | G |
| 000819F/G__tomentella__PI__583970__v1 | 275462 | G | A |
| 000819F/G__tomentella__PI__583970__v1 | 275759 | T | C |
| 000819F/G__tomentella__PI__583970__v1 | 276045 | T | C |
| 000819F/G__tomentella__PI__583970__v1 | 276067 | G | A |
| 000819F/G__tomentella__PI__583970__v1 | 278203 | C | T |
| 000819F/G__tomentella__PI__583970__v1 | 278888 | A | T |
| 000819F/G__tomentella__PI__583970__v1 | 283800 | G | A |
| 000819F/G__tomentella__PI__583970__v1 | 284053 | T | A |
| 000819F/G__tomentella__PI__583970__v1 | 284831 | G | C |
| 000819F/G__tomentella__PI__583970__v1 | 287570 | G | C |
| 000819F/G__tomentella__PI__583970__v1 | 288787 | A | T |
| 000819F/G__tomentella__PI__583970__v1 | 289782 | A | T |
| 000819F/G__tomentella__PI__583970__v1 | 290827 | T | C |
| 000819F/G__tomentella__PI__583970__v1 | 291200 | T | C |
| 000819F/G__tomentella__PI__583970__v1 | 291213 | G | A |
| 000819F/G__tomentella__PI__583970__v1 | 293207 | G | A |
| 000819F/G__tomentella__PI__583970__v1 | 293867 | C | T |
| 000819F/G__tomentella__PI__583970__v1 | 297410 | T | G |
| 000819F/G__tomentella__PI__583970__v1 | 297431 | T | C |
| 000819F/G__tomentella__PI__583970__v1 | 297475 | T | C |
| 000819F/G__tomentella__PI__583970__v1 | 298295 | G | T |
| 000819F/G__tomentella__PI__583970__v1 | 298437 | A | G |
| 000819F/G__tomentella__PI__583970__v1 | 298979 | G | C |
| 000819F/G__tomentella__PI__583970__v1 | 303692 | A | G |
| 000819F/G__tomentella__PI__583970__v1 | 304046 | T | A |
| 000819F/G__tomentella__PI__583970__v1 | 304512 | C | T |
| 000819F/G__tomentella__PI__583970__v1 | 304764 | C | A |
| 000819F/G__tomentella__PI__583970__v1 | 305269 | T | C |
| 000819F/G__tomentella__PI__583970__v1 | 305624 | T | C |
| 000819F/G__tomentella__PI__583970__v1 | 306037 | T | A |
| 000819F/G__tomentella__PI__583970__v1 | 306171 | G | A |
| 000819F/G__tomentella__PI__583970__v1 | 318002 | C | T |
| 000819F/G__tomentella__PI__583970__v1 | 328015 | G | A |
| 000819F/G__tomentella__PI__583970__v1 | 333209 | A | G |
| 000819F/G__tomentella__PI__583970__v1 | 341293 | C | T |
| 000819F/G__tomentella__PI__583970__v1 | 344251 | C | T |
| 000819F/G__tomentella__PI__583970__v1 | 346694 | T | C |
| 000819F/G__tomentella__PI__583970__v1 | 347362 | A | C |
| 000819F/G__tomentella__PI__583970__v1 | 347867 | A | G |
| 000819F/G__tomentella__PI__583970__v1 | 369651 | C | A |
| 000819F/G__tomentella__PI__583970__v1 | 380730 | C | T |
| 000819F/G__tomentella__PI__583970__v1 | 381546 | C | T |
| 000819F/G__tomentella__PI__583970__v1 | 385059 | A | G |
| 000819F/G__tomentella__PI__583970__v1 | 386671 | A | T |
| 000819F/G__tomentella__PI__583970__v1 | 387021 | C | T |
| 000819F/G__tomentella__PI__583970__v1 | 387788 | T | A |
| 000819F/G__tomentella__PI__583970__v1 | 388859 | T | C |
| 000819F/G__tomentella__PI__583970__v1 | 401614 | G | C |
| 000819F/G__tomentella__PI__583970__v1 | 420350 | C | G |
| 000819F/G__tomentella__PI__583970__v1 | 427998 | G | A |
| 000819F/G__tomentella__PI__583970__v1 | 428798 | T | C |
| 000819F/G__tomentella__PI__583970__v1 | 450156 | C | T |
| 000819F/G__tomentella__PI__583970__v1 | 453725 | C | T |
| 000819F/G__tomentella__PI__583970__v1 | 466651 | A | G |
| 000819F/G__tomentella__PI__583970__v1 | 467520 | T | C |
| 000819F/G__tomentella__PI__583970__v1 | 501821 | G | A |
| 000819F/G__tomentella__PI__583970__v1 | 510702 | G | C |
| 000819F/G__tomentella__PI__583970__v1 | 533134 | T | G |
| 000819F/G__tomentella__PI__583970__v1 | 586465 | G | A |
| 000819F/G__tomentella__PI__583970__v1 | 704705 | C | G |
| 000819F/G__tomentella__PI__583970__v1 | 704714 | A | G |

Oligonucleotide primers (herein, 'primers') can be developed and used to identify plants carrying any one of the chromosomal intervals depicted in SEQ ID NOs 1, 2, 3, 4 and/or 5 found to be highly associated with ASR resistance. Specifically, one having ordinary skill in the art can develop primers to detect any single nucleotide polymorphism (herein 'SNP') as identified in any one of Tables 1-5 in respect to identifying or producing soybean lines having any one of or a portion of the chromosome intervals depicted in SEQ ID NOs: 1, 2, 3, 4 or 5 that are associated with ASR resistance. A TAQMAN® assay (e.g. generally a two-step allelic discrimination assay or similar), a KASP™ assay (generally a one-step allelic discrimination assay defined below or similar), or both can be employed to identify the SNPs that associate with increased ASR resistance as disclosed herein (e.g. favorable alleles as depicted in Tables 1-5). In an exemplary two-step assay, a forward primer, a reverse primer, and two assay probes (or hybridization oligos) are employed. The forward and reverse primers are employed to amplify genetic loci that comprise SNPs that are associated with ASR resistance loci (for example, any of the favorable alleles as shown in Tables 1-5). The particular nucleotides that are present at the SNP positions are then assayed using the assay primers (which in some embodiments are differentially labeled with, for example, fluorophores to permit distinguishing between the two assay probes in a single reaction), which in each pair differ from each other with respect to the nucleotides that are present at the SNP position (although it is noted that in any given pair, the probes can differ in their 5' or 3' ends without impacting their abilities to differentiate between nucleotides present at the corresponding SNP positions). In some embodiments, the assay primers and the reaction conditions are designed such that an assay primer will only hybridize to the reverse complement of a 100% perfectly matched sequence, thereby permitting identification of which allele(s) that are present based upon detection of hybridizations.

Compositions and methods for identifying, selecting and producing *Glycine* plants (including wild Glycines (e.g. *Glycine tomentella*) and *Glycine max* lines) with enhanced disease resistance are provided. Disease resistant soybean plants and germplasms are also provided.

In some embodiments, methods of identifying a disease resistant soybean plant or germplasm are provided. Such methods may comprise detecting, in the soybean plant or germplasm, a genetic loci or molecular marker (e.g. SNP or a Quantitative Trait Loci (QTL)) associated with enhanced disease resistance, in particular ASR resistance. In some embodiments the genetic loci or molecular marker associates with the presence of a chromosomal interval comprising the nucleotide sequence or a portion thereof of SEQ ID NOs 1, 2, 3, 4 or 5, wherein the portion thereof associates with ASR resistance.

In some embodiments, methods of producing a disease resistant soybean plant are provided. Such methods may comprise detecting, in a soybean plant or germplasm, the presence of a genetic loci and/or a genetic marker associated with enhanced pathogen resistance (e.g. ASR) and producing a progeny plant from said soybean germplasm.

In some embodiments, methods of selecting a disease resistant soybean plant or germplasm are provided. Such methods may comprise crossing a first soybean plant or germplasm with a second soybean plant or germplasm, wherein the first soybean plant or germplasm comprises a genetic loci derived from any one of plant accessions PI441001, PI441008, PI446958, PI509501, PI583970, PI483224, or a progeny plant thereof comprising any one of SEQ ID NOs 1, 2, 3, 4 or 5 or a portion thereof associated with enhanced disease and/or ASR resistance, and/or tolerance, and selecting a progeny plant or germplasm that possesses the genetic loci.

In some embodiments, methods of introgressing a genetic loci derived from soybean accession numbers PI441001, PI441008, PI446958, PI509501, PI583970, or PI483224 associated with enhanced pathogen resistance into a soybean plant or germplasm are provided. Such methods may comprise crossing a first soybean plant or germplasm comprising a chromosomal interval (e.g. SEQ ID Nos: 1, 2, 3, 4 or 5) derived from soybean accession number PI441001, PI441008, PI446958, PI509501, PI583970, or PI483224 associated with enhanced pathogen resistance with a second soybean plant or germplasm that lacks said genetic loci and optionally repeatedly backcrossing progeny plants comprising said genetic allele with the second soybean plant or germplasm to produce an soybean plant (e.g. *Glycine max*) or germplasm with enhanced pathogen resistance comprising the chromosomal interval derived from soybean accession number PI441001, PI441008, PI446958, PI509501, PI583970, or PI483224 associated with enhanced ASR resistance. Progeny comprising the chromosomal interval associated with enhanced pathogen resistance may be identified by detecting, in their genomes, the presence of a marker associated with or genetically linked to said chromosomal interval derived from soybean accession number PI441001, PI441008, PI446958, PI509501, PI583970, or PI483224 wherein said chromosomal interval comprises SEQ ID NOs 1, 2, 3, 4 or 5 or a portion thereof and the marker can be any of the favorable alleles as described in Tables 1-5. R-Genes from PI441001, PI441008, PI446958, PI509501, PI583970, or PI483224 can be introgressed into a *Glycine max* line through the use of embryo rescue methods known by those skilled in the art for example as is disclosed in U.S. Pat. No. 7,842,850 herein incorporated by reference and through methods as described in the working Examples herein, describing a alternative method of embryo rescue.

Soybean plants and/or germplasms identified, produced or selected by the methods of this invention are also provided, as are any progeny and/or seeds derived from a soybean plant or germplasm identified, produced or selected by these methods. In one embodiment molecular markers associating with the presence of a chromosomal intervals depicted in any one of SEQ ID NOs 1, 2, 3, 4 or 5 may be used to identify or select for plant lines resistant to ASR. Further said molecular markers may be located within 20 cM, 10 cM, 5 cM, 4 cM, 3 cM, 2 cM, and 1 cM of said chromosomal interval or from any respective favorable allele associated with ASR resistance as depicted in any one of Tables 1-5. In another embodiment, said molecular marker may be located within 20 cM, 10 cM, 5 cM, 4 cM, 3 cM, 2 cM, 1 cM of any SNP markers associated with ASR as described in any one of Tables 1-5.

Non-naturally occurring soybean seeds, plants and/or germplasms comprising one or genetic loci derived from plant accession number PI441001, PI441008, PI446958, PI509501, PI583970, or PI483224 (herein, 'PI441001', 'PI441008', 'PI446958', PI509501", 'PI583970', or 'PI483224') associated with enhanced pathogen resistance (e.g. ASR, Cyst Nematode, Phytophthora, etc.) are also provided. In specific embodiments said genetic loci comprise SEQ ID NOs 1, 2, 3, 4 or 5 and/or any favorable alleles as depicted in Tables 1-5.

A marker associated with enhanced pathogen resistance, more specifically ASR, may comprise, consist essentially of or consist of a single allele or a combination of alleles at one or more genetic loci derived from PI441001, PI441008, PI446958, PI509501, PI583970, or PI483224 that associate with enhanced pathogen (ASR) resistance. In one embodiment the marker is within a chromosomal interval as described by SEQ ID NOs 1, 2, 3, 4 or 5. In another embodiment the marker is any one of the favorable alleles as depicted in Tables 1-5.

The foregoing and other objects and aspects of the present invention are explained in detail in the drawings and specification set forth below.

BRIEF DESCRIPTION OF THE DRAWINGS

FIG. 1 shows a depiction of *Glycine tomentella* SNPs associated with ASR resistance on *Glycine tomentella* genomic scaffolding located on chromosome 5.

FIG. 2 shows a mapping interval 0.023-1.16 Mb on Scaffold 49652 associated with ASR resistance.

FIG. 3 shows a mapping interval 0.02-1.19 Mb on Scaffold 46840 associated with ASR resistance.

FIG. 4 is a marker association map for *Glycine tomentella* (PI441001) where bands indicate regions/intervals of respective chromosomes associated with ASR resistance.

FIG. 5 illustrates the rust rating scale used to measure plant phenotype.

FIG. 6 shows chromosome mapping for ASR resistance QTL for *Glycine tomentella* PI583970.

FIG. 7 is a marker association map for *Glycine tomentella* (PI583970) where bands indicate regions/intervals of respective chromosomes associated with ASR resistance.

FIG. 8 shows a mapping interval on scaffold 000819F associated with ASR resistance.

FIG. 9 shows chromosome mapping for ASR resistance QTL for *Glycine tomentella* PI483224.

FIG. 10 is a marker association map for *Glycine tomentella* (PI483224) where bands indicate regions/intervals of respective chromosomes associated with ASR resistance.

FIG. 11 shows a mapping interval on scaffold 002687F associated with ASR resistance.

DETAILED DESCRIPTION OF THE INVENTION

The presently disclosed subject matter relates at least in part to the identification of a genomic region (i.e. chromosomal interval(s) on *Glycine tomentella* Chromosome 5) derived from *Glycine tomentella* accession lines PI441001, PI441008, PI446958, PI509501, PI583970, PI483224, PI441008 or progeny thereof associated with enhanced ASR resistance. As such, said chromosomal interval from PI441001, PI441008, PI446958, PI509501, PI583970, PI483224, PI441008 or progeny thereof, may be introgressed into *Glycine max* lines via somatic embryo rescue (see for example U.S. Patent Publication 2007/0261139 and examples herein describing a alternative method of embryo rescue) or through the use of a *Glycine max* donor line having introgressed into its genome the genetic region from PI441001, PI441008, PI583970, or PI483224, wherein the region comprises any one of SEQ ID NO: 1-5 or a portion thereof wherein presence of said genetic region is associated with increased or enhanced disease resistance to, for example, ASR, SCN, Stem termination, Stem Canker, Bacterial pustule, root knot nematode, brown stem rot, Frogeye leaf spot, or phytophthora. In another embodiment a chromosomal interval derived from PI441001, PI441008, PI446958, PI509501, PI583970, or PI483224 is introduced into a *Glycine max* line not comprising said chromosomal interval wherein said introduction confers in the *Glycine max* line or its progeny increased resistances to disease (e.g. ASR) wherein the said chromosome interval is derived from chromosome 5 of *Glycine tomentella* and further wherein said chromosomal interval comprises at least one allele that associates with the trait of increased disease resistance, such as ASR, wherein said allele is any one of the alleles respectively selected from any one as depicted in Tables 1-5.

This description is not intended to be a detailed catalog of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. Thus, the invention contemplates that in some embodiments of the invention, any feature or combination of features set forth herein can be excluded or omitted. In addition, numerous variations and additions to the various embodiments suggested herein will be apparent to those skilled in the art in light of the instant disclosure, which do not depart from the instant invention. Hence, the following descriptions are intended to illustrate some particular embodiments of the invention, and not to exhaustively specify all permutations, combinations and variations thereof.

All references listed below, as well as all references cited in the instant disclosure, including but not limited to all patents, patent applications and publications thereof, scientific journal articles, and database entries (e.g., GENBANK® database entries and all annotations available therein) are incorporated herein by reference in their entireties to the extent that they supplement, explain, provide a background for, or teach methodology, techniques, and/or compositions employed herein.

Definitions

Unless defined otherwise, all technical and scientific terms used herein have the same meaning as commonly understood to one of ordinary skill in the art to which the presently disclosed subject matter belongs.

Although the following terms are believed to be well understood by one of ordinary skill in the art, the following definitions are set forth to facilitate understanding of the presently disclosed subject matter.

As used herein, the terms "a" or "an" or "the" may refer to one or more than one. For example, "a" marker can mean one marker or a plurality of markers.

As used herein, the term "and/or" refers to and encompasses any and all possible combinations of one or more of the associated listed items, as well as the lack of combinations when interpreted in the alternative ("or").

As used herein, the term "about," when used in reference to a measurable value such as an amount of mass, dose, time, temperature, and the like, is meant to encompass variations of up to 10% of the specified amount.

The term "consists essentially of" (and grammatical variants thereof), as applied to a polynucleotide sequence of this invention, means a polynucleotide sequence that consists of both the recited sequence (e.g., SEQ ID NO) and a total of ten or less (e.g., 1, 2, 3, 4, 5, 6, 7, 8, 9, or 10) additional nucleotides on the 5' and/or 3' ends of the recited sequence such that the function of the polynucleotide is not materially altered. The total of ten or less additional nucleotides includes the total number of additional nucleotides on both ends added together. The term "materially altered," as applied to polynucleotides of the invention, refers to an increase or decrease in ability to express the polynucleotide sequence of at least about 50% or more as compared to the expression level of a polynucleotide sequence consisting of the recited sequence.

The term "introduced" as used herein, in connection to a plant, means accomplished by any manner including but not limited to; introgression, transgenic, Clustered Regularly Interspaced Short Palindromic Repeats modification (CRISPR), Transcription activator-like effector nucleases (TALENs) (Feng et al. 2013, Joung & Sander 2013), meganucleases, or zinc finger nucleases (ZFNs).

As used herein, the term "wild glycine" refers to a perennial *Glycine* plant, for example any one of *G. canescens, G. argyrea, G. clandestine, G. latrobeana, G. albicans, G. aphyonota, G. arenaria, G. curvata, G. cyrtoloba, G. dolichocarpa, G. falcate, G. gracei, G. hirticaulis, G. lactovirens, G. latifolia, G. microphylla, G. montis-douglas, G. peratosa, G. pescadrensis, G. pindanica, G. pullenii, G. rubiginosa, G. stenophita, G. syndetika*, or *G. tomentella.*

As used herein, the term "allele" refers to one of two or more different nucleotides or nucleotide sequences that occur at a specific locus.

A marker is "associated with" a trait when it is linked to it and when the presence of the marker is an indicator of whether and/or to what extent the desired trait or trait form will occur in a plant/germplasm comprising the marker. Similarly, a marker is "associated with" an allele when it is linked to it and when the presence of the marker is an indicator of whether the allele is present in a plant/germplasm comprising the marker. For example, "a marker associated with enhanced pathogen resistance" refers to a marker whose presence or absence can be used to predict whether and/or to what extent a plant will display a pathogen resistant phenotype (e.g. any favorable SNP allele as described in Tables 1-5 are "associated with" ASR resistance in a soybean plant).

As used herein, the terms "backcross" and "backcrossing" refer to the process whereby a progeny plant is repeatedly crossed back to one of its parents. In a backcrossing scheme, the "donor" parent refers to the parental plant with the desired gene or locus to be introgressed. The "recipient" parent (used one or more times) or "recurrent" parent (used two or more times) refers to the parental plant into which the gene or locus is being introgressed. For example, see Ragot, M. et al. *Marker-assisted Backcrossing: A Practical Example, in* Techniques et Utilisations des Marqueurs Moleculaires LEs Colloques, Vol. 72, pp. 45-56 (1995); and Openshaw et al., *Marker-assisted Selection in Backcross Breeding, in* Proceedings of the Symposium "Analysis of Molecular Marker Data," pp. 41-53 (1994). The initial cross gives rise to the F1 generation. The term "BC1" refers to the second use of the recurrent parent, "BC2" refers to the third use of the recurrent parent, and so on.

A centimorgan ("cM") is a unit of measure of recombination frequency. One cM is equal to a 1% chance that a marker at one genetic locus will be separated from a marker at a second locus due to crossing over in a single generation.

As used herein, the term "chromosomal interval defined by and including," used in reference to particular loci and/or alleles, refers to a chromosomal interval delimited by and encompassing the stated loci/alleles.

As used herein, the terms "cross" or "crossed" refer to the fusion of gametes via pollination to produce progeny (e.g., cells, seeds or plants). The term encompasses both sexual crosses (the pollination of one plant by another) and selfing (self-pollination, e.g., when the pollen and ovule are from the same plant). The term "crossing" refers to the act of fusing gametes via pollination to produce progeny.

As used herein, the terms "cultivar" and "variety" refer to a group of similar plants that by structural or genetic features and/or performance can be distinguished from other varieties within the same species.

As used herein, the terms "desired allele", "favorable allele" and "allele of interest" are used interchangeably to refer to an allele associated with a desired trait (e.g. ASR resistance).

As used herein, the terms "enhanced pathogen resistance" or "enhanced disease resistance" refers to an improvement, enhancement, or increase in a plant's ability to endure and/or thrive despite being infected with a disease (e.g. Asian soybean rust) as compared to one or more control plants (e.g., one or both of the parents, or a plant lacking a marker associated with enhanced pathogen resistance to respective pathogen/disease). Enhanced disease resistance includes any mechanism (other than whole-plant immunity or resistance) that reduces the expression of symptoms indicative of infection for a respective disease such as Asian soybean rust, soybean cyst nematode, *Phytophthora*, etc.

An "elite line" or "elite strain" is an agronomically superior line that has resulted from many cycles of breeding and selection for superior agronomic performance. Numerous elite lines are available and known to those of skill in the art of soybean breeding. An "elite population" is an assortment of elite individuals or lines that can be used to represent the state of the art in terms of agronomically superior genotypes of a given crop species, such as soybean. Similarly, an "elite germplasm" or elite strain of germplasm is an agronomically superior germplasm, typically derived from and/or capable of giving rise to a plant with superior agronomic performance, such as an existing or newly developed elite line of soybean.

An "elite" plant is any plant from an elite line, such that an elite plant is a representative plant from an elite variety. Non-limiting examples of elite soybean varieties that are commercially available to farmers or soybean breeders include: AG00802, A0868, AG0902, A1923, AG2403, A2824, A3704, A4324, A5404, AG5903, AG6202 AG0934; AG1435; AG2031; AG2035; AG2433; AG2733; AG2933; AG3334; AG3832; AG4135; AG4632; AG4934; AG5831; AG6534; and AG7231 (Asgrow Seeds, Des Moines, Iowa, USA); BPR0144RR, BPR 4077NRR and BPR 4390NRR (Bio Plant Research, Camp Point, Ill., USA); DKB17-51 and DKB37-51 (DeKalb Genetics, DeKalb, Ill., USA); DP 4546 RR, and DP 7870 RR (Delta & Pine Land Company, Lubbock, Tex., USA); JG 03R501, JG 32R606C ADD and JG 55R503C (JGL Inc., Greencastle, Ind., USA); NKS 13-K2 (NK Division of Syngenta Seeds, Golden Valley, Minn., USA); 90M01, 91M30, 92M33, 93M11, 94M30, 95M30, 97B52, P008T22R2; P16T17R2; P22T69R; P25T51R; P34T07R2; P35T58R; P39T67R; P47T36R; P46T21R; and P56T03R2 (Pioneer Hi-Bred International, Johnston, Iowa, USA); SG4771NRR and SG5161NRR/STS (Soygenetics, LLC, Lafayette, Ind., USA); S00-K5, S11-L2, S28-Y2, S43-B1, S53-A1, S76-L9, S78-G6, S0009-M2; S007-Y4; 504-D3; S14-A6; S20-T6; S21-M7; S26-P3; S28-N6; S30-V6; S35-C3; S36-Y6; S39-C4; S47-K5; S48-D9; S52-Y2; S58-Z4; S67-R6; S73-S8; and S78-G6 (Syngenta Seeds, Henderson, Ky., USA); Richer (Northstar Seed Ltd. Alberta, Calif.); 14RD62 (Stine Seed Co. Ia., USA); or Armor 4744 (Armor Seed, LLC, Ar., USA).

The terms "agronomically elite" as used herein, means a genotype that has a culmination of many distinguishable traits such as emergence, vigor, vegetative vigor, disease resistance, seed set, standability, yield and threshability which allows a producer to harvest a product of commercial significance.

As used herein, the term "commercially significant yield" or "agronomically acceptable yield" refers to a grain yield of at least 100% of a commercial check variety such as AG2703 or DKB23-51.

As used herein, the terms "exotic," "exotic line" and "exotic germplasm" refer to any plant, line or germplasm that is not elite. In general, exotic plants/germplasms are not derived from any known elite plant or germplasm, but rather are selected to introduce one or more desired genetic elements into a breeding program (e.g., to introduce novel alleles into a breeding program).

A "genetic map" is a description of genetic linkage relationships among loci on one or more chromosomes within a given species, generally depicted in a diagrammatic or tabular form. For each genetic map, distances between loci are measured by the recombination frequencies between them. Recombinations between loci can be detected using a variety of markers. A genetic map is a product of the mapping population, types of markers used, and the polymorphic potential of each marker between different populations. The order and genetic distances between loci can differ from one genetic map to another.

As used herein, the term "genotype" refers to the genetic constitution of an individual (or group of individuals) at one or more genetic loci, as contrasted with the observable and/or detectable and/or manifested trait (the phenotype). Genotype is defined by the allele(s) of one or more known loci that the individual has inherited from its parents. The term genotype can be used to refer to an individual's genetic constitution at a single locus, at multiple loci, or more generally, the term genotype can be used to refer to an individual's genetic make-up for all the genes in its genome. Genotypes can be indirectly characterized, e.g., using markers and/or directly characterized by nucleic acid sequencing.

As used herein, the term "germplasm" refers to genetic material of or from an individual (e.g., a plant), a group of individuals (e.g., a plant line, variety or family), or a clone derived from a line, variety, species, or culture. The germplasm can be part of an organism or cell, or can be separate from the organism or cell. In general, germplasm provides genetic material with a specific molecular makeup that provides a physical foundation for some or all of the hereditary qualities of an organism or cell culture. As used herein, germplasm may refer to seeds, cells (including protoplasts and calli) or tissues from which new plants may be grown, as well as plant parts that can be cultured into a whole plant (e.g., stems, buds, roots, leaves, etc.).

A "haplotype" is the genotype of an individual at a plurality of genetic loci, i.e., a combination of alleles. Typically, the genetic loci that define a haplotype are physically and genetically linked, i.e., on the same chromosome segment. The term "haplotype" can refer to polymorphisms at a particular locus, such as a single marker locus, or polymorphisms at multiple loci along a chromosomal segment.

As used herein, the term "heterozygous" refers to a genetic status wherein different alleles reside at corresponding loci on homologous chromosomes.

As used herein, the term "homozygous" refers to a genetic status wherein identical alleles reside at corresponding loci on homologous chromosomes.

As used herein, the term "hybrid" refers to a seed and/or plant produced when at least two genetically dissimilar parents are crossed.

As used herein, the term "inbred" refers to a substantially homozygous plant or variety. The term may refer to a plant or variety that is substantially homozygous throughout the entire genome or that is substantially homozygous with respect to a portion of the genome that is of particular interest.

As used herein, the term "indel" refers to an insertion or deletion in a pair of nucleotide sequences, wherein a first sequence may be referred to as having an insertion relative to a second sequence or the second sequence may be referred to as having a deletion relative to the first sequence.

As used herein, the terms "introgression," "introgressing" and "introgressed" refer to both the natural and artificial transmission of a desired allele or combination of desired alleles of a genetic locus or genetic loci from one genetic background to another. For example, a desired allele at a specified locus can be transmitted to at least one progeny via a sexual cross between two parents of the same species, where at least one of the parents has the desired allele in its genome. Alternatively, for example, transmission of an allele can occur by recombination between two donor genomes, e.g., in a fused protoplast, where at least one of the donor protoplasts has the desired allele in its genome. The desired allele may be a selected allele of a marker, a QTL, a transgene, or the like. Offspring comprising the desired allele can be repeatedly backcrossed to a line having a desired genetic background and selected for the desired allele, with the result being that the desired allele becomes fixed in the desired genetic background. For example, a marker associated with enhanced ASR tolerance may be introgressed from a donor into a recurrent parent that is not disease resistant. The resulting offspring could then be repeatedly backcrossed and selected until the progeny possess the ASR tolerance allele(s) in the recurrent parent background.

As used herein, the term "linkage" refers to the degree with which one marker locus is associated with another marker locus or some other locus (for example, an ASR tolerance locus). The linkage relationship between a molecular marker and a phenotype may be given as a "probability" or "adjusted probability." Linkage can be expressed as a desired limit or range. For example, in some embodiments, any marker is linked (genetically and physically) to any other marker when the markers are separated by less than about 50, 40, 30, 25, 20, or 15 map units (or cM). For example, embodiments of the invention herein, provide for marker loci closely linked to ASR resistant chromosomal intervals comprising a nucleotide sequence of any one of SEQ ID NOs 1-5.

In some aspects of the present invention, it is advantageous to define a bracketed range of linkage, for example, from about 10 cM and about 20 cM, from about 10 cM and about 30 cM, or from about 10 cM and about 40 cM. The more closely a marker is linked to a second locus, the better an indicator for the second locus that marker becomes. Thus, "closely linked loci" such as a marker locus and a second locus display an inter-locus recombination frequency of about 10%, 9%, 8%, 7%, 6%, 5%, 4%, 3%, or 2% or less. In some embodiments, the relevant loci display a recombination frequency of about 1% or less, e.g., about 0.75%, 0.5%, 0.25% or less. Two loci that are localized to the same chromosome, and at such a distance that recombination between the two loci occurs at a frequency of less than about 10% (e.g., about 9%, 8%, 7%, 6%, 5%, 4%, 3%, 2%, 1%, 0.75%, 0.5%, or 0.25%, or less) may also be said to be "proximal to" each other. Since one cM is the distance between two markers that show a 1% recombination frequency, any marker is closely linked (genetically and physically) to any other marker that is in close proximity, e.g., at or less than about 10 cM distant. Two closely linked markers on the same chromosome may be positioned about 9, 8, 7, 6, 5, 4, 3, 2, 1, 0.75, 0.5 or 0.25 cM or less from each other.

As used herein, the term "linkage disequilibrium" refers to a non-random segregation of genetic loci or traits (or both). In either case, linkage disequilibrium implies that the relevant loci are within sufficient physical proximity along a length of a chromosome so that they segregate together with greater than random (i.e., non-random) frequency (in the case of co-segregating traits, the loci that underlie the traits are in sufficient proximity to each other). Markers that show linkage disequilibrium are considered linked. Linked loci co-segregate more than 50% of the time, e.g., from about 51% to about 100% of the time. In other words, two markers that co-segregate have a recombination frequency of less than 50% (and, by definition, are separated by less than 50 cM on the same chromosome). As used herein, linkage can be between two markers, or alternatively between a marker and a phenotype. A marker locus can be "associated with" (linked to) a trait, e.g., Asian Soybean Rust. The degree of linkage of a molecular marker to a phenotypic trait is measured, e.g., as a statistical probability of co-segregation of that molecular marker with the phenotype.

Linkage disequilibrium is most commonly assessed using the measure $r^2$, which is calculated using the formula described by Hill and Robertson, *Theor. Appl. Genet.* 38:226 (1968). When $r^2=1$, complete linkage disequilibrium exists between the two marker loci, meaning that the markers have not been separated by recombination and have the same allele frequency. Values for $r^2$ above ⅓ indicate sufficiently strong linkage disequilibrium to be useful for mapping. Ardlie et al., *Nature Reviews Genetics* 3:299 (2002). Hence, alleles are in linkage disequilibrium when $r^2$ values between pairwise marker loci are greater than or equal to about 0.33, 0.4, 0.5, 0.6, 0.7, 0.8, 0.9, or 1.0.

As used herein, the term "linkage equilibrium" describes a situation where two markers independently segregate, i.e., sort among progeny randomly. Markers that show linkage equilibrium are considered unlinked (whether or not they lie on the same chromosome).

A "locus" is a position on a chromosome where a gene or marker or allele is located. In some embodiments, a locus may encompass one or more nucleotides.

As used herein, the terms "marker" and "genetic marker" are used interchangeably to refer to a nucleotide and/or a nucleotide sequence that has been associated with a phenotype, trait or trait form. In some embodiments, a marker may be associated with an allele or alleles of interest and may be indicative of the presence or absence of the allele or alleles of interest in a cell or organism. A marker may be, but is not limited to, an allele, a gene, a haplotype, a restriction fragment length polymorphism (RFLP), a simple sequence repeat (SSR), random amplified polymorphic DNA (RAPD), cleaved amplified polymorphic sequences (CAPS) (Rafalski and Tingey, *Trends in Genetics* 9:275 (1993)), an amplified fragment length polymorphism (AFLP) (Vos et al., *Nucleic Acids Res.* 23:4407 (1995)), a single nucleotide polymorphism (SNP) (Brookes, *Gene* 234:177 (1993)), a sequence-characterized amplified region (SCAR) (Paran and Michelmore, *Theor. Appl. Genet.* 85:985 (1993)), a sequence-tagged site (STS) (Onozaki et al., *Euphytica* 138: 255 (2004)), a single-stranded conformation polymorphism (SSCP) (Orita et al., *Proc. Natl. Acad. Sci. USA* 86:2766 (1989)), an inter-simple sequence repeat (ISSR) (Blair et al., *Theor. Appl. Genet.* 98:780 (1999)), an inter-retrotransposon amplified polymorphism (IRAP), a retrotransposon-microsatellite amplified polymorphism (REMAP) (Kalendar et al., *Theor. Appl. Genet.* 98:704 (1999)), a chromosome interval, or an RNA cleavage product (such as a Lynx tag). A marker may be present in genomic or expressed nucleic acids (e.g., ESTs). The term marker may also refer to nucleic acids used as probes or primers (e.g., primer pairs) for use in amplifying, hybridizing to and/or detecting nucleic acid molecules according to methods well known in the art. A large number of soybean molecular markers are known in the art, and are published or available from various sources, such as the SoyBase internet resource.

Markers corresponding to genetic polymorphisms between members of a population can be detected by methods well-established in the art. These include, e.g., nucleic acid sequencing, hybridization methods, amplification methods (e.g., PCR-based sequence specific amplification methods), detection of restriction fragment length polymorphisms (RFLP), detection of isozyme markers, detection of polynucleotide polymorphisms by allele specific hybridization (ASH), detection of amplified variable sequences of the plant genome, detection of self-sustained sequence replication, detection of simple sequence repeats (SSRs), detection of single nucleotide polymorphisms (SNPs), and/or detection of amplified fragment length polymorphisms (AFLPs). Well established methods are also known for the detection of expressed sequence tags (ESTs) and SSR markers derived from EST sequences and randomly amplified polymorphic DNA (RAPD).

A "marker allele," also described as an "allele of a marker locus," can refer to one of a plurality of polymorphic nucleotide sequences found at a marker locus in a population that is polymorphic for the marker locus.

"Marker-assisted selection" (MAS) is a process by which phenotypes are selected based on marker genotypes. In some embodiments, marker genotypes are used to identify plants that will be selected for a breeding program or for planting. In some embodiments, marker genotypes are used to identify plants that will not be selected for a breeding program or for planting (i.e., counter-selected plants), allowing them to be removed from the breeding/planting population.

As used herein, the terms "marker locus" and "marker loci" refer to a specific chromosome location or locations in the genome of an organism where a specific marker or markers can be found. A marker locus can be used to track the presence of a second linked locus, e.g., a linked locus that encodes or contributes to expression of a phenotypic trait. For example, a marker locus can be used to monitor segregation of alleles at a locus, such as a QTL or single gene, that are genetically or physically linked to the marker locus.

As used herein, the terms "marker probe" and "probe" refer to a nucleotide sequence or nucleic acid molecule that can be used to detect the presence of one or more particular alleles within a marker locus (e.g., a nucleic acid probe that is complementary to all of or a portion of the marker or marker locus, through nucleic acid hybridization). Marker probes comprising about 8, 10, 15, 20, 30, 40, 50, 60, 70, 80, 90, 100 or more contiguous nucleotides may be used for nucleic acid hybridization. Alternatively, in some aspects, a marker probe refers to a probe of any type that is able to distinguish (i.e., genotype) the particular allele that is present at a marker locus.

As used herein, the terms "molecular marker" or "genetic marker" may be used to refer to a genetic marker, as defined above, or an encoded product thereof (e.g., a protein) used as a point of reference when identifying a linked locus. A molecular marker can be derived from genomic nucleotide sequences or from expressed nucleotide sequences (e.g., from a spliced RNA, a cDNA, etc.). The term also refers to nucleotide sequences complementary to or flanking the marker sequences, such as nucleotide sequences used as probes and/or primers capable of amplifying the marker sequence. Nucleotide sequences are "complementary" when they specifically hybridize in solution, e.g., according to Watson-Crick base pairing rules. Some of the markers described herein are also referred to as hybridization markers when located on an indel region. This is because the insertion region is, by definition, a polymorphism vis-ã-vis a plant without the insertion. Thus, the marker need only indicate whether the indel region is present or absent. Any suitable marker detection technology may be used to identify such a hybridization marker, e.g., SNP technology is used in the examples provided herein.

A "non-naturally occurring variety of soybean" is any variety of soybean that does not naturally exist in nature. A "non-naturally occurring variety of soybean" may be produced by any method known in the art, including, but not limited to, transforming a soybean plant or germplasm, transfecting a soybean plant or germplasm and crossing a naturally occurring variety of soybean with a non-naturally occurring variety of soybean. In some embodiments, a "non-naturally occurring variety of soybean" may comprise one of more heterologous nucleotide sequences. In some embodiments, a "non-naturally occurring variety of soybean" may comprise one or more non-naturally occurring copies of a naturally occurring nucleotide sequence (i.e., extraneous copies of a gene that naturally occurs in soybean). In some embodiments, a "non-naturally occurring variety of soybean" may comprise a non-natural combination of two or more naturally occurring nucleotide sequences (i.e., two or more naturally occurring genes that do not naturally occur in the same soybean, for instance genes not found in *Glycine max* lines).

As used herein, the term "primer" refers to an oligonucleotide which is capable of annealing to a nucleic acid target and serving as a point of initiation of DNA synthesis when placed under conditions in which synthesis of a primer extension product is induced (e.g., in the presence of nucleotides and an agent for polymerization such as DNA polymerase and at a suitable temperature and pH). A primer (in some embodiments an extension primer and in some embodiments an amplification primer) is in some embodiments single stranded for maximum efficiency in extension and/or amplification. In some embodiments, the primer is an oligodeoxyribonucleotide. A primer is typically sufficiently long to prime the synthesis of extension and/or amplification products in the presence of the agent for polymerization. The minimum length of the primer can depend on many factors, including, but not limited to temperature and composition (A/T vs. G/C content) of the primer. In the context of amplification primers, these are typically provided as a pair of bi-directional primers consisting of one forward and one reverse primer or provided as a pair of forward primers as commonly used in the art of DNA amplification such as in PCR amplification. As such, it will be understood that the term "primer," as used herein, can refer to more than one primer, particularly in the case where there is some ambiguity in the information regarding the terminal sequence(s) of the target region to be amplified. Hence, a "primer" can include a collection of primer oligonucleotides containing sequences representing the possible variations in the sequence or includes nucleotides which allow a typical base pairing. Primers can be prepared by any suitable method known in the art. Methods for preparing oligonucleotides of specific sequence are known in the art, and include, for example, cloning and restriction of appropriate sequences and direct chemical synthesis. Chemical synthesis methods can include, for example, the phospho di- or tri-ester method, the diethylphosphoramidate method and the solid support method disclosed in U.S. Pat. No. 4,458,066. Primers can be labeled, if desired, by incorporating detectable moieties by for instance spectroscopic, fluorescence, photochemical, biochemical, immunochemical, or chemical moieties. Primers diagnostic (i.e. able to identify or select based on presence of ASR resistant alleles) for ASR resistance can be created to any favorable SNP as described in any one of Tables 1-5. The PCR method is well described in handbooks and known to the skilled person. After amplification by PCR, target polynucleotides can be detected by hybridization with a probe polynucleotide, which forms a stable hybrid with the target sequence under stringent to moderately stringent hybridization and wash conditions. If it is expected that the probes are essentially completely complementary (i.e., about 99% or greater) to the target sequence, stringent conditions can be used. If some mismatching is expected, for example if variant strains are expected with the result that the probe will not be completely complementary, the stringency of hybridization can be reduced. In some embodiments, conditions are chosen to rule out non-specific/adventitious binding. Conditions that affect hybridization, and that select against non-specific binding are known in the art, and are described in, for example, Sambrook & Russell (2001). Molecular Cloning: A Laboratory Manual, Third Edition, Cold Spring Harbor Laboratory Press, Cold Spring Harbor, N.Y., United States of America. Generally, lower salt concentration and higher temperature hybridization and/or washes increase the stringency of hybridization conditions.

As used herein, the terms "phenotype," "phenotypic trait" or "trait" refer to one or more traits and/or manifestations of an organism. The phenotype can be a manifestation that is observable to the naked eye, or by any other means of evaluation known in the art, e.g., microscopy, biochemical analysis, or an electromechanical assay. In some cases, a phenotype or trait is directly controlled by a single gene or genetic locus, i.e., a "single gene trait." In other cases, a phenotype or trait is the result of several genes. It is noted that, as used herein, the term "disease resistant phenotype" takes into account environmental conditions that might affect the respective disease such that the effect is real and reproducible.

As used herein, the term "plant" may refer to a whole plant, any part thereof, or a cell or tissue culture derived from a plant. Thus, the term "plant" can refer to any of: whole plants, plant components or organs (e.g., roots, stems, leaves, buds, flowers, pods, etc.), plant tissues, seeds and/or plant cells. A plant cell is a cell of a plant, taken from a plant, or derived through culture from a cell taken from a plant. Thus, the term "soybean plant" may refer to a whole soybean plant, one or more parts of a soybean plant (e.g., roots, root tips, stems, leaves, buds, flowers, pods, seeds, cotyledons, etc.), soybean plant cells, soybean plant protoplasts and/or soybean plant calli.

As used herein, the term "plant part" includes but is not limited to embryos, pollen, seeds, leaves, flowers (including but not limited to anthers, ovules and the like), fruit, stems or branches, roots, root tips, cells including cells that are intact in plants and/or parts of plants, protoplasts, plant cell tissue cultures, plant calli, plant clumps, and the like. Thus, a plant part includes soybean tissue culture from which soybean plants can be regenerated. Further, as used herein, "plant cell" refers to a structural and physiological unit of the plant, which comprises a cell wall and also may refer to a protoplast. A plant cell of the present invention can be in the form of an isolated single cell or can be a cultured cell or can be a part of a higher-organized unit such as, for example, a plant tissue or a plant organ.

As used herein, the term "polymorphism" refers to a variation in the nucleotide sequence at a locus, where said variation is too common to be due merely to a spontaneous mutation. A polymorphism can be a single nucleotide polymorphism (SNP) or an insertion/deletion polymorphism, also referred to herein as an "indel." Additionally, the variation can be in a transcriptional profile or a methylation pattern. The polymorphic site or sites of a nucleotide sequence can be determined by comparing the nucleotide sequences at one or more loci in two or more germplasm entries.

As used herein, the terms "closely linked" refers to linked markers displaying a cross over frequency with a given marker of about 10% or less (e.g. the given marker is within about 10 cM of a closely linked ASR marker). Put another way, closely linked loci co-segregate at least about 90% of the time. With regard to physical position on a chromosome, closely linked markers can be separated, for example, by about 1 megabase (Mb; 1 million nucleotides), about 500 kilobases (Kb; 1000 nucleotides), about 400 Kb, about 300 Kb, about 200 Kb, about 100 Kb, about 50 Kb, about 25 Kb, about 10 Kb, about 5 Kb, about 4 Kb, about 3 Kb, about 2 Kb, about 1 Kb, about 500 nucleotides, about 250 nucleotides, or less.

As used herein, the term "population" refers to a genetically heterogeneous collection of plants sharing a common genetic derivation.

As used herein, the terms "progeny" and "progeny plant" refer to a plant generated from a vegetative or sexual reproduction from one or more parent plants. A progeny plant may be obtained by cloning or selfing a single parent plant, or by crossing two parental plants.

As used herein, the term "reference sequence" refers to a defined nucleotide sequence used as a basis for nucleotide sequence comparison. The reference sequence for a marker, for example, is obtained by genotyping a number of lines at the locus or loci of interest, aligning the nucleotide sequences in a sequence alignment program, and then obtaining the consensus sequence of the alignment. Hence, a reference sequence identifies the polymorphisms in alleles at a locus. A reference sequence may not be a copy of an actual nucleic acid sequence from any particular organism; however, it is useful for designing primers and probes for actual polymorphisms in the locus or loci.

As used herein, the terms "disease tolerance" and "disease resistant" refer to a plant's ability to endure and/or thrive despite being infected with a respective disease. When used in reference to germplasm, the terms refer to the ability of a plant that arises from that germplasm to endure and/or thrive despite being infected with a respective disease. In some embodiments, infected Disease resistant soybean plants may yield as well (or nearly as well) as uninfected soybean plants. In general, a plant or germplasm is labeled as "Disease resistant" if it displays "enhanced pathogen resistance."

An "unfavorable allele" of a marker is a marker allele that segregates with the unfavorable plant phenotype, therefore providing the benefit of identifying plants that can be removed from a breeding program or planting. For instance, one could eliminate from a plant breeding program plant lines carrying unfavorable alleles for ASR resistance.

"PI441001, PI441008, PI583970, or PI483224," refers to *Glycine tomentella* plant accession number PI441001, PI441008, PI583970, or PI483224.

Genetic Mapping

Genetic loci correlating with particular phenotypes, such as disease resistance, can be mapped in an organism's genome. By identifying a marker or cluster of markers that co-segregate with a trait of interest, the breeder is able to rapidly select a desired phenotype by selecting for the proper marker (a process called marker-assisted selection, or "MAS"). Such markers may also be used by breeders to design genotypes in silico and to practice whole genome selection.

The present invention provides markers associated with enhanced disease resistance. Detection of these markers and/or other linked markers can be used to identify, select and/or produce disease resistant, more specifically ASR resistant, plants and/or to eliminate plants that are not disease resistant from breeding programs or planting.

*Glycine tomentella* Genetic Loci Associated with Enhanced Disease Resistance Markers associated with enhanced disease resistance are identified herein (see Tables 1-5 indicating favorable markers associated with enhanced ASR resistance). A marker of the present invention may comprise a single allele or a combination of alleles at one or more genetic loci (for example, any combination of a favorable markers from Tables 1-5). For example, the marker may comprise one or more marker alleles located within a first chromosomal interval (e.g. SEQ ID NO: 1) and one or more marker alleles located within a second chromosomal interval (e.g. SEQ ID NO: 2).

Marker-Assisted Selection

Markers can be used in a variety of plant breeding applications. See, e.g., Staub et al., *Hortscience* 31: 729 (1996); Tanksley, *Plant Molecular Biology Reporter* 1: 3 (1983). One of the main areas of interest is to increase the efficiency of backcrossing and introgressing genes using marker-assisted selection (MAS). In general, MAS takes advantage of genetic markers that have been identified as having a significant likelihood of co-segregation with a desired trait. Such markers are presumed to be in/near the gene(s) that give rise to the desired phenotype, and their presence indicates that the plant will possess the desired trait. Plants which possess the marker are expected to transfer the desired phenotype to their progeny.

A marker that demonstrates linkage with a locus affecting a desired phenotypic trait provides a useful tool for the selection of the trait in a plant population. This is particularly true where the phenotype is hard to assay or occurs at a late stage in plant development. Since DNA marker assays are less laborious and take up less physical space than field phenotyping, much larger populations can be assayed, increasing the chances of finding a recombinant with the target segment from the donor line moved to the recipient line. The closer the linkage, the more useful the marker, as recombination is less likely to occur between the marker and the gene causing or imparting the trait. Having flanking markers decreases the chances that false positive selection will occur. The ideal situation is to have a marker within the causative gene itself, so that recombination cannot occur between the marker and the gene. Such a marker is called a "perfect marker".

When a gene is introgressed by MAS, it is not only the gene that is introduced but also the flanking regions. Gepts, *Crop Sci* 42:1780 (2002). This is referred to as "linkage drag." In the case where the donor plant is highly unrelated to the recipient plant, these flanking regions carry additional genes that may code for agronomically undesirable traits. This "linkage drag" may also result in reduced yield or other negative agronomic characteristics even after multiple cycles of backcrossing into the elite soybean line. This is also sometimes referred to as "yield drag." The size of the flanking region can be decreased by additional backcrossing, although this is not always successful, as breeders do not have control over the size of the region or the recombination breakpoints. Young et al., *Genetics* 120:579 (1998). In classical breeding, it is usually only by chance that recombinations that contribute to a reduction in the size of the donor segment are selected. Tanksley et al., *Biotechnology* 7: 257 (1989). Even after 20 backcrosses, one might find a sizeable piece of the donor chromosome still linked to the gene being selected. With markers, however, it is possible to select those rare individuals that have experienced recombination near the gene of interest. In 150 backcross plants, there is a 95% chance that at least one plant will have experienced a crossover within 1 cM of the gene, based on a single meiosis map distance. Markers allow for unequivocal identification of those individuals. With one additional backcross of 300 plants, there would be a 95% chance of a crossover within 1 cM single meiosis map distance of the other side of the gene, generating a segment around the target gene of less than 2 cM based on a single meiosis map distance. This can be accomplished in two generations with markers, while it would have required on average 100 generations without markers. See Tanksley et al., supra. When the exact location of a gene is known, flanking markers surrounding the gene can be utilized to select for recombinations in different population sizes. For example, in smaller population sizes, recombinations may be expected further away from the gene, so more distal flanking markers would be required to detect the recombination.

The availability of integrated linkage maps of the soybean genome containing increasing densities of public soybean markers has facilitated soybean genetic mapping and MAS.

Of all the molecular marker types, SNPs are the most abundant and have the potential to provide the highest genetic map resolution. Bhattramakki et al., *Plant Molec. Biol.* 48:539 (2002). SNPs can be assayed in a so-called "ultra-high-throughput" fashion because they do not require large amounts of nucleic acid and automation of the assay is straight-forward. SNPs also have the benefit of being relatively low-cost systems. These three factors together make SNPs highly attractive for use in MAS. Several methods are available for SNP genotyping, including but not limited to, hybridization, primer extension, oligonucleotide ligation, nuclease cleavage, minisequencing and coded spheres. Such methods have been reviewed in various publications: Gut, *Hum. Mutat.* 17:475 (2001); Shi, *Clin. Chem.* 47:164 (2001); Kwok, Pharmacogenomics 1:95 (2000); Bhattramakki and Rafalski, *Discovery and application of single nucleotide polymorphism markers in plants, in* PLANT GENOTYPING: THE DNA FINGERPRINTING OF PLANTS, CABI Publishing, Wallingford (2001). A wide range of commercially available technologies utilize these and other methods to interrogate SNPs, including Masscode™ (Qiagen, Germantown, Md.), Invader® (Hologic, Madison, Wis.), SnapShot® (Applied Biosystems, Foster City, Calif.), Taqman® (Applied Biosystems, Foster City, Calif.) and Beadarrays™ (Illumina, San Diego, Calif.).

A number of SNP alleles together within a sequence, or across linked sequences, can be used to describe a haplotype for any particular genotype. Ching et al., *BMC Genet.* 3:19 (2002); Gupta et al., (2001), Rafalski, *Plant Sci.* 162:329 (2002b). Haplotypes can be more informative than single SNPs and can be more descriptive of any particular genotype. For example, a single SNP may be allele "T" for a specific Disease resistant line or variety, but the allele "T" might also occur in the soybean breeding population being utilized for recurrent parents. In this case, a combination of alleles at linked SNPs may be more informative. Once a unique haplotype has been assigned to a donor chromosomal region, that haplotype can be used in that population or any subset thereof to determine whether an individual has a particular gene. The use of automated high throughput marker detection platforms known to those of ordinary skill in the art makes this process highly efficient and effective.

The markers of the present invention can be used in marker-assisted selection protocols to identify and/or select progeny with enhanced Asian soybean rust resistance. Such methods can comprise, consist essentially of or consist of crossing a first soybean plant or germplasm with a second soybean plant or germplasm, wherein the first soybean plant or germplasm comprises a chromosomal interval derived from PI441001, PI441008, PI446958, PI509501, PI583970, or PI483224 wherein said chromosomal interval corresponds with nucleotide base 1 to nucleotide base 1251375 of SEQ ID NO: 1 or wherein the chromosomal interval corresponds with nucleotide base 1 to nucleotide base 2515428 of SEQ ID NO: 2, and selecting a progeny plant that possesses the marker. Either of the first and second soybean plants, or both, may be of a non-naturally occurring variety of soybean. In some embodiments, the second soybean plant or germplasm is of an elite variety of soybean. In some embodiments, the genome of the second soybean plant or germplasm is at least about 50%, 55%, 60%, 65%, 70%, 75%, 80%, 85%, 90%, 95%, 97%, 99% or 100% identical to that of an elite variety of soybean. In another embodiment, the first soybean plant comprises the chromosomal interval a chromosomal interval derived from PI441001, PI441008, PI446958, PI509501, PI583970, or PI483224 wherein said chromosomal interval corresponds with nucleotide base 1 to nucleotide base 1251375 of SEQ ID NO: 1 or wherein the chromosomal interval corresponds with nucleotide base 1 to nucleotide base 2515428 of SEQ ID NO: 2 wherein the chromosome interval further comprises at least one allele as depicted in any of Tables 1-5

Methods for identifying and/or selecting a disease resistant soybean plant or germplasm may comprise, consist essentially of or consist of detecting the presence of a marker associated with enhanced ASR tolerance. The marker may be detected in any sample taken from the plant or germplasm, including, but not limited to, the whole plant or germplasm, a portion of said plant or germplasm (e.g., a seed chip, a leaf punch disk or a cell from said plant or germplasm) or a nucleotide sequence from said plant or germplasm. Such a sample may be taken from the plant or germplasm using any present or future method known in the art, including, but not limited to, automated methods of removing a portion of endosperm with a sharp blade, drilling a small hole in the seed and collecting the resultant powder, cutting the seed with a laser and punching a leaf disk. The soybean plant may be of a non-naturally occurring variety of soybean. In some embodiments, the genome of the soybean plant or germplasm is at least about 50%, 55%, 60%, 65%, 70%, 75%, 80%, 85%, 90%, 95%, 97%, 99% or 100% identical to that of an elite variety of soybean.

In some embodiments, the marker detected in the sample may comprise, consist essentially of or consist of one or more marker alleles located within a chromosomal interval selected from the group consisting of:

1) chromosomal interval derived from PI441001, PI441008, PI446958, PI509501, PI583970, or PI483224 wherein said chromosomal interval corresponds with nucleotide base 1 to nucleotide base 1251375 of SEQ ID NO: 1; or
2) chromosomal interval derived from PI441001, PI441008, PI446958, PI509501, PI583970, or PI483224 wherein said chromosomal interval corresponds with nucleotide base 1 to nucleotide base 2515428 of SEQ ID NO: 2; or
3) chromosomal interval derived from PI441001, PI441008, PI446958, PI509501, PI583970, or PI483224 wherein said chromosomal interval corresponds with nucleotide base 1 to nucleotide base 365842 of SEQ ID NO: 3; or
4) chromosomal interval derived from PI441001, PI441008, PI446958, PI509501, PI583970, or PI483224 wherein said chromosomal interval corresponds with nucleotide base 1 to nucleotide base 646429 of SEQ ID NO: 4;
5) chromosomal interval derived from PI441001, PI441008, PI446958, PI509501, PI583970, or PI483224 wherein said chromosomal interval corresponds with nucleotide base 1 to nucleotide base 750080 of SEQ ID NO: 5; or
6) A chromosomal interval spanning 20 cM, 15 cM, 10 cM, 5 cM, 1 cM, 0.5 cM from a SNP marker that associates with increased ASR resistance in soybean wherein the SNP marker is selected from the group consisting of any favorable SNP marker displayed in Tables 1-5.

Methods for producing an disease resistant soybean plant may comprise, consist essentially of or consist of detecting, in a germplasm, a marker associated with enhanced disease resistance (e.g. ASR) wherein said marker is selected from Tables 1-5 or wherein marker is a closely linked loci of any marker described in any one of Tables 1-5 and producing a soybean plant from said germplasm. The marker may be detected in any sample taken from the germplasm, including, but not limited to, a portion of said germplasm (e.g., a seed chip or a cell from said germplasm) or a nucleotide sequence from said germplasm. Such a sample may be taken from the germplasm using any present or future method known in the art, including, but not limited to, automated methods of removing a portion of endosperm with a sharp blade, drilling a small hole in the seed and collecting the resultant powder, cutting the seed with a laser and punching a leaf disk. The germplasm may be of a non-naturally occurring variety of soybean. In some embodiments, the genome of the germplasm is at least about 50%, 55%, 60%, 65%, 70%, 75%, 80%, 85%, 90%, 95%, 97%, 99% or 100% identical to that of an elite variety of soybean. A disease resistant soybean plant is then produced from the germplasm identified as having the marker associated with enhanced disease resistance (e.g. ASR) according to methods well known in the art for breeding and producing plants from germplasm.

In some embodiments, the marker detected in the germplasm may comprise, consist essentially of or consist of one or more marker alleles located within a chromosomal interval selected from the group consisting of:

1) chromosomal interval derived from PI441001, PI441008, PI446958, PI509501, PI583970, or PI483224 wherein said chromosomal interval corresponds with nucleotide base 1 to nucleotide base 1251375 of SEQ ID NO: 1; or
2) chromosomal interval derived from PI441001, PI441008, PI446958, PI509501, PI583970, or PI483224 wherein said chromosomal interval corresponds with nucleotide base 1 to nucleotide base 2515428 of SEQ ID NO: 2; or
3) chromosomal interval derived from PI441001, PI441008, PI446958, PI509501, PI583970, or PI483224 wherein said chromosomal interval corresponds with nucleotide base 1 to nucleotide base 365842 of SEQ ID NO: 3; or
4) chromosomal interval derived from PI441001, PI441008, PI446958, PI509501, PI583970, or PI483224 wherein said chromosomal interval corresponds with nucleotide base 1 to nucleotide base 646429 of SEQ ID NO: 4;
5) chromosomal interval derived from PI441001, PI441008, PI446958, PI509501, PI583970, or PI483224 wherein said chromosomal interval corresponds with nucleotide base 1 to nucleotide base 750080 of SEQ ID NO: 5; or
6) A chromosomal interval spanning 20 cM, 15 cM, 10 cM, 5 cM, 1 cM, 0.5 cM from a SNP marker that associates with increased ASR resistance in soybean wherein the SNP marker is selected from the group consisting of any favorable SNP marker displayed in Tables 1-5.

In some embodiments, the marker detected in the germplasm may comprise, consist essentially of or consist of one or more marker alleles selected from any of Tables 1-5.

Methods for producing and/or selecting an Asian soy rust resistant/tolerant soybean plant or germplasm may comprise crossing a first soybean plant or germplasm with a second soybean plant or germplasm, wherein said first soybean plant or germplasm comprises a chromosomal interval selected from the group consisting of:

1) chromosomal interval derived from PI441001, PI441008, PI446958, PI509501, PI583970, or PI483224 wherein said chromosomal interval corresponds with nucleotide base 1 to nucleotide base 1251375 of SEQ ID NO: 1; or
2) chromosomal interval derived from PI441001, PI441008, PI446958, PI509501, PI583970, or PI483224 wherein said chromosomal interval corresponds with nucleotide base 1 to nucleotide base 2515428 of SEQ ID NO: 2; or
3) chromosomal interval derived from PI441001, PI441008, PI446958, PI509501, PI583970, or PI483224 wherein said chromosomal interval corresponds with nucleotide base 1 to nucleotide base 365842 of SEQ ID NO: 3; or
4) chromosomal interval derived from PI441001, PI441008, PI446958, PI509501, PI583970, or PI483224 wherein said chromosomal interval corresponds with nucleotide base 1 to nucleotide base 646429 of SEQ ID NO: 4; or
5) chromosomal interval derived from PI441001, PI441008, PI446958, PI509501, PI583970, or PI483224 wherein said chromosomal interval corresponds with nucleotide base 1 to nucleotide base 750080 of SEQ ID NO: 5; or 6) A chromosomal interval spanning 20 cM, 15 cM, 10 cM, ScM, 1 cM, 0.5 cM from a SNP marker that associates with increased ASR resistance in soybean wherein the SNP marker is selected from the group consisting of any SNP marker displayed in Tables 1-5; and crossing with a second soybean plant not comprising the chromosome interval then producing a progeny plant with increased ASR resistance. Either the first or second soybean plant or germplasm, or both, may be of a non-naturally occurring variety of soybean. In some embodiments, the second soybean plant or germplasm is of an elite variety of soybean. In some embodiments, the genome of the second soybean plant or germplasm is at least about 50%, 55%, 60%, 65%, 70%, 75%, 80%, 85%, 90%, 95%, 97%, 99% or 100% identical to that of an elite variety of soybean.

Also provided herein is a method of introgres sing an allele associated with enhanced Disease (e.g. ASR, SCN, SDS, RKN, Phytopthora, etc.) resistance/tolerance into a soybean plant. Such methods for introgressing an allele associated with enhanced Disease (e.g. ASR, SCN, SDS, RKN, Phytopthora, etc.) resistance/tolerance into a soybean plant or germplasm may comprise, consist essentially of or consist of crossing a first soybean plant or germplasm comprising said allele (the donor) wherein said allele is selected from any allele listed in Table 1 or Table 2 or a maker in "close proximity" to a marker listed in Tables 1-5 with a second soybean plant or germplasm that lacks said allele (the recurrent parent) and repeatedly backcrossing progeny comprising said allele with the recurrent parent. Progeny comprising said allele may be identified by detecting, in their genomes, the presence of a marker associated with enhanced Disease (e.g. ASR, SCN, SDS, RKN, Phytopthora, etc.) resistance/tolerance. The marker may be detected in any sample taken from the progeny, including, but not limited to, a portion of said progeny (e.g., a seed chip, a leaf punch disk or a cell from said plant or germplasm) or a nucleotide sequence from said progeny. Such a sample may be taken from the progeny using any present or future method known in the art, including, but not limited to, automated methods of removing a portion of endosperm with a sharp blade, drilling a small hole in the seed and collecting the resultant powder, cutting the seed with a laser and punching a leaf disk. Either the donor or the recurrent parent, or both, may be of a non-naturally occurring variety of soybean. In some embodiments, the recurrent parent is of an elite variety of soybean. In some embodiments, the genome of the recurrent parent is at least about 50%, 55%, 60%, 65%, 70%, 75%, 80%, 85%, 90%, 95%, 97%, 99% or 100% identical to that of an elite variety of soybean.

In some embodiments, the marker used to identify progeny comprising an allele associated with enhanced Disease (e.g. ASR, SCN, SDS, RKN, Phytopthora, etc.) resistance/tolerance may comprise, consist essentially of or consist of one or more marker alleles located within a chromosomal interval selected from the group consisting of:

1) a chromosomal interval derived from PI441001, PI441008, PI446958, PI509501, PI583970, or PI483224 wherein said chromosomal interval corresponds with nucleotide base 1 to nucleotide base 1251375 of SEQ ID NO: 1; or 2) a chromosomal interval derived from PI441001, PI441008, PI446958, PI509501, PI583970, or PI483224 wherein said chromosomal interval corresponds with nucleotide base 1 to nucleotide base 2515428 of SEQ ID NO: 2;

3) a chromosomal interval derived from PI441001, PI441008, PI446958, PI509501, PI583970, or PI483224 wherein said chromosomal interval corresponds with nucleotide base 1 to nucleotide base 365842 of SEQ ID NO: 3; or 4) a chromosomal interval derived from PI441001, PI441008, PI446958, PI509501, PI583970, or PI483224 wherein said chromosomal interval corresponds with nucleotide base 1 to nucleotide base 646429 of SEQ ID NO: 4;

5) chromosomal interval derived from PI441001, PI441008, PI446958, PI509501, PI583970, or PI483224 wherein said chromosomal interval corresponds with nucleotide base 1 to nucleotide base 750080 of SEQ ID NO: 5; or 6) a chromosomal interval spanning 20 cM, 15 cM, 10 cM, ScM, 1 cM, 0.5 cM from a SNP marker that associates with increased ASR resistance in soybean wherein the SNP marker is selected from the group consisting of any SNP marker displayed in Tables 1-5 or any closely linked markers in close proximity to said intervals 1)-5).

In some embodiments, the marker may comprise, consist essentially of or consist of marker alleles located in at least two different chromosomal intervals. For example, the marker may comprise one or more alleles located in the chromosomal interval defined by and including any two markers in Table 1, any two markers located in Table 2 any two markers in Table 3 or any two markers in Tables 4 and/or 5.

The following are all embodiments contemplated and encompassed within the invention:

1. An elite *Glycine max* plant having in its genome a chromosomal interval from a wild Glycine plant wherein the chromosomal interval comprises any one of SEQ ID NOs: 1-5 or a functional portion thereof that confers ASR resistance in said plant; in some instances the wild Glycine plant is *Glycine tomentella* and in further instances the wild Glycine plant is selected from any one of plant accessions PI441001, PI441008, PI446958, PI509501, PI583970, or PI483224, wherein said chromosomal interval confers increased Asian soy rust (ASR) resistance as compared to a control plant not comprising said chromosomal interval; Further in a variation of embodiment 1 said elite *Glycine max* plant is produced by a) performing a non-natural cross between a *Glycine max* plant and a *Glycine tomentella* plant wherein "non-natural cross" means a cross between two species that will not produce viable offspring without further intervention (e.g. embryo rescue such as described in Example 3) such as; a) performing embryo rescue as essentially described in Example 3 to create a amphidiploid plant; b) backcrossing the amphidiploid plant of b) with a *Glycine max* plant for at least 1 backcross generation (preferably BC4) resulting in the generation of an elite *Glycine max* plant having introgressed in its genome said chromosome interval (s); further the said elite *Glycine max* plant may have 20 chromosome pairs or could maintain a chromosome pair from *Glycine tomentella* and inheriting said intervals to confer ASR resistance in said elite *Glycine max* plant.
2. The plant of embodiment 1, wherein the chromosomal interval comprises SEQ ID NOs: 1, 2, 3, 4, 5 or a portion of any thereof wherein said portion confers ASR resistance to elite *Glycine max* plant.
3. The plant of embodiments 1-2, wherein the chromosomal interval comprises a SNP marker associated with increased ASR resistance wherein said SNP marker corresponds with any one of the favorable SNP markers as listed in Tables 1-5; or in another variation a haplotype comprising at least 2 SNP markers associated with ASR resistance and further wherein the at least 2 SNP markers are selected from any favorable SNP markers as listed in Tables 1-5.

4. The plant of embodiments 1-3, wherein the chromosomal interval is derived from *Glycine tomentella* chromosome 5 at an approximate mapping interval of 0.02-1.19 Mb.
5. The plant of embodiments 1-5, wherein the chromosomal interval corresponds to a position within the wild Glycine and/or *Glycine tomentella* genome that comprises SEQ ID NOs: 1-5 or a portion thereof wherein said portion confers increased ASR resistance in said elite *Glycine max* plant.
6. The plant of embodiments 1-5, wherein the elite *Glycine max* plant further shows resistance to any one of the stresses selected from: diseases (such as powdery mildew, *Pythium ultimum*, Phytophthora root rot, leaf spot, blast, brown spot, root-knot nematode, soybean cyst nematode, soybean vein necrosis virus, soybean stem canker, soybean sudden death syndrome, leaf and neck blast, rust, frogeye leaf spot, brown stem rot, Fusarium, or sheath blight); insect pests (such as whitefly, aphid, grey field slug, sugarcane borer, green bug, or aphid); abiotic stress (such as drought tolerance, flooding, high level of salinity, heavy metal, aluminum, manganese, cadmium, zinc, UV-B, boron, iron deficiency chlorosis or cold tolerance (i.e. extreme temperatures)) and further wherein said resistance to stress is conferred from said chromosomal interval.
7. The plant of embodiments 1-6, wherein at least one parental line of said plant was selected or identified through molecular marker selection, wherein said parental line is selected or identified based on a molecular marker located within or closely associated with said chromosome interval corresponding to any one of SEQ ID NOs: 1-5.
8. The plant of embodiment 7, wherein the molecular marker is a single nucleotide polymorphism (SNP), a quantitative trait locus (QTL), a amplified fragment length polymorphism (AFLP), randomly amplified polymorphic DNA (RAPD), a restriction fragment length polymorphism (RFLP) or a microsatellite.
9. The plant of embodiments 7-8, wherein the molecular marker is a SNP marker and the molecular marker is any favorable marker as shown in Tables 1-5.
10. The plant of any of embodiments 1-9, wherein the plant is a agronomically elite *Glycine max* plant having a commercially significant yield as well as commercially susceptible: vigor, seed set, standability or threshability.
11. The plant of any of embodiments 1-10, wherein said interval is introduced into said plant genome by a "non-natural" wide cross between a *Glycine max* and *Glycine tomentella* line followed by subsequent embryo rescue (e.g. as described in Example 3) and then resultant plant backcrossed at least once and more preferably at least four backcrosses (BC4) with *Glycine max* line (i.e. in some instances a recurrent *Glycine max* line) to produce an elite or agronomically elite *Glycine max* line.
12. The plant of any of embodiments 1-10, wherein said interval is introduced into said plant genome by transgenic expression or genome editing of sequences corresponding to and comprising any one of SEQ ID NOS: 1-5 or a portion thereof wherein said portion retains ASR resistance when introduced into a susceptible line.
13. The plant of embodiment 12, wherein the interval is introduced by genome editing of a *Glycine max* genomic region homologous to, or a ortholog of any of the intervals corresponding to SEQ ID NOs: 1-5 and further making at least one genetic edit to said *Glycine max* genomic region to include at least 1 allele change corresponding to any favorable allele as described in any of Tables 1-5 wherein said *Glycine max* genomic region did not comprise said allele change before genome edit and said genome edit confers in plant increased ASR resistance as compared to a control plant.
14. The plant of embodiment 13, wherein the genetic edit is accomplished through CRISPR, TALEN, meganucleases or through modification of genomic nucleic acids.
15. The plant of embodiments 1-14 wherein the chromosomal interval comprises any one of or a portion thereof (where said portion retains ASR resistance) of nucleotide base pair positions: 1-1251375 of SEQ ID NO: 1; 1-2515428 of SEQ ID NO: 2; 1-365842 of SEQ ID NO: 3; 1-646429 of SEQ ID NO: 4, or 1-750080 of SEQ ID NO: 5.
16. A ASR resistant agronomically elite *Glycine max* plant having commercially significant yield, wherein said plant comprises an introgression of a chromosomal interval from a wild Glycine plant wherein said chromosome interval corresponds to and/or comprises any one of SEQ ID NOs: 1-5; in some instances said wild Glycine plant is *Glycine tomentella*, in further instances the wild Glycine plant is any one of accessions PI441001, PI441008, PI446958, PI509501, PI583970, PI483224 or progeny thereof, wherein the introgression comprises a ASR resistance conferring QTL linked to at least one marker located on the chromosome equivalent to *Glycine tomentella* chromosome 5.
17. The ASR resistant elite *Glycine max* plant of embodiment 16, wherein said QTL is homozygous.
18. The plant of embodiments 16-17, wherein the parental plant of said ASR resistant agronomically elite *Glycine max* plant is a wide cross between *Glycine max* and *Glycine tomentella* parental lines; in one variation the parental line is a amphidiploid hybrid between *Glycine max* and *Glycine tomentella* parental lines (herein, "amphidiploid hybrid").
19. An agronomically elite *Glycine max* plant having commercially significant yield comprising an ASR resistant allele which confers increased resistance to ASR, and wherein the ASR allele comprises at least one single nucleotide polymorphism (SNP) selected from the group of favorable SNPs described in any one of Tables 1-5 and further wherein said plant comprises in its genome a chromosomal interval (i.e. such as any one of SEQ ID NOs: 1-5) from *Glycine tomentella* or a progeny there of (e.g. a amphidiploid hybrid).
20. An agronomically elite soybean having commercially significant yield comprising a chromosomal interval from *Glycine tomentella* chromosome 5 comprising at least one favorable SNP marker selected from any one of Tables 1-5; in one variation the chromosome interval is any one of SEQ ID NOs: 1-5.
21. The plant of embodiment 20, wherein said chromosomal interval from *Glycine tomentella* chromosome 5 is derived from any one of plant accessions PI441001, PI441008, PI446958, PI509501, PI583970, PI483224 or progeny thereof (e.g. such as a amphidiploid hybrid).

22. The plant of embodiments 20-21, wherein the chromosomal interval comprises SEQ ID NO: 1, SEQ ID NO: 2, SEQ ID NO: 3, SEQ ID NO: 4, SEQ ID NO: 5 or a portion thereof wherein said chromosomal interval confers increased ASR resistance in said plant as compared to a control plant not comprising said chromosomal interval.

23. A plant cell or plant part derived from the plant or seed of embodiments 1-22; in some instances the plant cell or plant part cannot be used to regenerate a plant (e.g. thus a plant cell or plant part unable to be used to regenerate a plant from the plant or seed of embodiments 1-22).

24. A progeny plant or seed from any of the plants of embodiments 1-22.

25. A *Glycine max* plant of embodiments 1-22, wherein said plant has 20 chromosome pairs and/or 40 paired chromosomes or in some instances said plant maintains a chromosomal pair derived from a wild glycine line.

26. A *Glycine max* plant of embodiments 1-25, wherein there is no yield drag or negative agronomic effects as compared to a control plant.

27. A method of producing a soybean plant (in some instances a "amphidiploid hybrid") having increased resistance to Asian soybean rust (ASR), the method comprising the steps of:
   a. crossing a *Glycine max* plant with a ASR resistant wild Glycine plant, in some instances a *Glycine tomentella* plant;
   b. generating soybean pods from the cross of a);
   c. isolating embryos from the pods of b) and placing said embryos onto embryo rescue medium (in some instances the embryo rescue medium comprises or has a composition essentially equivalent to: 3.1 g B5 basal salt, Gamborg's, 1 ml B5 vitamins 1000×, 40 g sucrose [C12H22011], 0.25 g casein hydrolysate, 0.25 mg BAP, 0.75 g MgCl2*6H20, 20 ml glutamine 25 mg/ml, 0.1 g serine [C3H7NO3], 4 ml Asparagine 25 mg/ml, 0.05 ml of IBA 1 mg/ml, and 2.0 g Gelzan); or Murashige and Skoog Medium (MS) or Gamborg's B-5 media (Bridgen, 1994)) wherein there is no callus induction caused or initiated in this step c);
   d. transferring the embryos of c) onto germination medium or elongation medium (in some instances the germination medium comprises or has a composition essentially equivalent to: 3.2 g Schenk and Hilderbrandt Basal salt mixture, 1 g Myo-inositol [C6H12O6], 5 ml Thiamine 1 mg/ml, 0.5 ml pyridoxine 1 mg/ml, 10 g sucrose [C12H22O11], and 7.5 g purified agar) or elongation medium comprising or has a composition essentially equivalent to: 4.3 g MS Basal salt Mixture [MSP01], 5 ml MS iron 200×, 30 g Sucrose [C12H22O11], 1 g MES [C6H13NO4S], 8 g purified agar, lml B5 vitamins 100×, 2 ml glutamine 25 mg/ml, 0.50 ml zeatin riboside, trans isomers 1 mg/ml, 0.1 ml IAA 1 mg/ml, 0.2 ml GA3); and collecting shoots from said embryos;
   e. growing the collected shoots of d) on germination or elongation medium; and
   f. transferring established shoots of e) to soil, thereby producing a soybean plant having increased resistance to ASR (in a preferred instance the shoots are rooted on elongation or germination medium to form plantlets and subsequently hardened.)

28. The method of embodiment 27, wherein the wild Glycine plant or *Glycine tomentella* plant of step a) comprises in its genome a chromosomal interval corresponding to and defined by (herein, "a chromosomal defined by" means the interval is the span of nucleotide bases from the first nucleotide to final nucleotide of the respective SEQ ID NO:) any one of SEQ ID NOs: 1-5 or a portion thereof where said portion confers increased ASR resistance in a plant.

29. The method of embodiments 27-28, wherein the *Glycine tomentella* plant comprises in its genome an allele associated with ASR resistance wherein said allele corresponds to any of the favorable alleles listed in Tables 1-5 or is a allele or SNP within any one of chromosome intervals comprising any one of SEQ ID NOs: 1-5 wherein said allele or SNP is associated with or closely linked to ASR resistance in a plant.

30. The method of embodiments 27-29, wherein the wild Glycine or *Glycine tomentella* plant is any one of PI441001, PI441008, PI446958, PI509501, PI583970, PI483224 or progeny thereof (in some instances the progeny is a amphidiploid hybrid).

31. The method of embodiment 30, wherein the progeny plant is a wide cross between *Glycine max* and *Glycine tomentella* parental lines.

32. The method of embodiments 27-31, further comprising the step of molecular marker selection where an isolated genomic nucleic acid from any one of: the parent plants of a), the embryo of c) or the shoot or resultant plant of f) is isolated and analyzed (e.g. genotyped) for the presence of a allele that associates with increased ASR resistance and further wherein said allele is closely linked with the chromosome intervals corresponding to and defined by SEQ ID NOs: 1-5 (e.g. any of the favorable alleles as described in any one of Tables 1-5).

33. The method of embodiment 32, wherein the allele corresponds to any of the favorable alleles listed in Tables 1-5.

34. The method of embodiments 27-33, wherein the *Glycine max* plant of a) has a relative maturity of 3.7 to 4.8. or in other variations the *Glycine max* plant may be selected from soybean maturity groups 000 the X 35. The method of embodiments 27-34, wherein the *Glycine max* plant of a) is used as a female plant and said wild Glycine or *Glycine tomentella* plant is the pollen donor; alternatively in some instances the *Glycine max* plant of a) can be uses as the male pollen donor plant and Wild Glycine or *Glycine tomentella* plant is used as a female plant.

36. The method of embodiments 27-35, wherein the pods of b) are treated with a hormone mixture comprising GA3, NAA and Kinetin (in some embodiments 100 mg GA3, 25 mg NAA and 5 mg kinetin/L and further, in some instances, wherein said hormone treatment is sprayed on pods daily until harvest).

37. The method of embodiments 27-36, wherein the pods are collected prior to 19 days after pollination.

38. The method of embodiments 27-37, wherein the embryos and/or shoots are treated with a chromosome doubling agent in any one of steps e)-h) to create amphidiploid plants (or amphidiploid hybrid) capable of being backcrossed with a domestic annual *Glycine* cultivar to produce at least one backcross generation in some instances a BC4 generation, further wherein the amphidiploid plant further comprises in its genome a favorable agronomic trait, such as ASR resistance that was inherited from the wild Glycine or *Glycine tomentella* parent; in other instances the amphidiploid plants are backcrossed with a recurrent *Glycine max* parental line followed by embryo rescue (e.g. as described in embodiments 65-83) to create a BC1 and repeated multiple times to produce a BC4 generation wherein said BC4 generation is fertile (i.e. no need for embryo rescue to generate plants) and capable of producing ASR resistant *Glycine max* progeny plants.

39. The method of embodiment 38, wherein the chromosome doubling agent is either colchicine or trifluralin; further contemplated chromosome doubling agents that may be used in embodiment 38 may comprise oryzalin.

40. The method of embodiments 27-39, wherein the embryos of c) remains on embryo rescue medium for at least about 20 days at about 24° C.

41. The method of embodiments 27-39, wherein the embryos of d) remain on germination or elongation medium for at least about 20 days at about 24° C.

42. The method of embodiment 41, wherein the embryo rescue medium is Soy ER1-1 wherein Soy ER1-1 comprises the following: 3.1 g B5 basal salt, Gamborg's, 1 ml B5 vitamins 1000×, 40 g sucrose [C12H22011], 0.25 g casein hydrolysate, 0.25 ml BAP, 0.75 g MgCl2*6H20, 20 ml glutamine 25 mg/ml, 0.1 g serine [C3H7NO3], 4 ml Asparagine 25 mg/ml and 0.05 ml of IBA 1 mg/ml (herein, "Soy ER1-1").

43. A method of producing a *Glycine max* plant having increased resistance to Asian soybean rust (ASR), the method comprising the steps of:
   a. providing a first *Glycine max* plant comprising in its genome a chromosomal interval corresponding to any one of SEQ ID NOs: 1-5 wherein said first *Glycine max* plant has increased resistance to ASR;
   b. crossing the *Glycine max* plant of a) with a second *Glycine max* plant not comprising said chromosomal interval;
   c. (in some embodiments this step is omitted) selecting a progeny plant from the cross of b) by isolating a nucleic acid from said progeny plant and detecting within said nucleic acid an allele that associates with increased ASR resistance and further wherein said allele is closely linked with the chromosome intervals corresponding to SEQ ID NOs: 1-5,
   d. thereby, producing a *Glycine max* plant having increased resistance to ASR.

44. The method of embodiment 43, wherein the allele in c) corresponds to any of the favorable alleles as depicted in any one of Tables 1-5.

45. The method of embodiments 43-44, wherein either first or second *Glycine max* plant is an elite *Glycine max* plant; further the first or second *Glycine max* plant could also be an elite *Glycine max* plant having commercially significant yield and in further embodiments be a agronomically elite *Glycine max* plant.

46. The method of embodiments 43-45, wherein the progeny plant is backcrossed by one or more generations, in some instances at least four (BC4) backcrosses; in further instances the BC1, BC2, BC3 generation is followed by embryo rescue as described in Example 3 or in embodiments 65-82 below.

47. The method of embodiments 27-46, wherein the chromosome interval corresponds to a *Glycine tomentella* chromosome interval located on *Glycine tomentella* chromosome 5 at an approximate mapping interval of 0.02-1.19 Mb and additionally comprises any one of SEQ ID NOS: 1-5 or a portion thereof wherein portion confers ASR resistance or is associated with ASR resistance.

48. The method of embodiment 47, wherein the *Glycine tomentella* chromosome interval is derived from any one of plant accessions: PI441001, PI441008, PI446958, PI509501, PI583970, PI483224 or a progeny thereof, in some instances the progeny comprises a amphidiploid hybrid plant.

49. The method of embodiment 48, wherein the progeny plant is a wide cross between *Glycine max* and *Glycine tomentella* parental lines.

50. A method of producing a *Glycine max* plant with increased ASR resistance, the method comprising the steps of:
   a) isolating a nucleic acid from a *Glycine max* plant;
   b) detecting in the nucleic acid of a) at least one molecular marker associated with increased ASR wherein said molecular marker is located within 20 cM, 10 cM, ScM, 1 cM 0.5 cM, or closely linked with a chromosomal interval corresponding to a genomic region from a wild Glycine plant or *Glycine tomentella* plant comprising any one of SEQ ID NOs: 1-5, or a portion thereof;
   c) selecting a plant based on the presence of the molecular marker detected in b) additionally crossing the selected plant with a second plant (e.g. *Glycine max* plant) not comprising said chromosomal interval; and
   d) producing a *Glycine max* progeny plant from the plant of c) identified as having said allele associated with increased ASR resistance and/or crossed with a second plant.

51. The method of embodiment 50, wherein the molecular marker is closely linked with or corresponds to any one of the favorable alleles as depicted in Tables 1-5 and/or said molecular marker is within a chromosomal interval from *Glycine tomentella* corresponding to and/or defined by SEQ ID NOs: 1-5.

52. A method of identifying and/or selecting a plant (in some embodiments either a *Glycine max* or a *Glycine tomentella* plant) having a ASR resistance, the method comprising the steps of
   a. isolating a nucleic acid from a soybean plant or plant part;
   b. detecting in the nucleic acid the presence of a molecular marker that associates with increased ASR resistance wherein the molecular marker is located within 20 cM, 10 cM, ScM, 1 cM, 0.5 cM of a marker as described in any one of Tables 1-5 or in another embodiment the molecular marker is closely linked with, in close proximity to, closely associated with or within a chromosomal interval corresponding to and/or comprising any one of SEQ ID NOs: 1-5; and
   c. identifying or selecting a soybean plant having increased ASR resistance on the basis of the molecular marker detected in b), thereby identifying and/or selecting a plant, having ASR resistance.

53. The method of embodiment 52, wherein the molecular marker detected in b) consists of any favorable marker as described in any one of Tables 1-5 or a allele or molecular marker associated with ASR wherein the allele or molecular marker is located within a chromosomal interval comprising and defined by any one of SEQ ID NOs: 1-5.

54. The method of embodiments 50-53, wherein the molecular marker is a single nucleotide polymorphism (SNP), a quantitative trait locus (QTL), an amplified fragment length polymorphism (AFLP), randomly amplified polymorphic DNA (RAPD), a restriction fragment length polymorphism (RFLP) or a microsatellite.
55. The method of any one of embodiments 50-54, wherein the detecting comprises amplifying a marker locus or a portion of the marker locus and detecting the resulting amplified marker amplicon (in some embodiments the amplicon comprises a nucleotide sequence as shown in any one of SEQ ID NOs 1-5; further, in another embodiment, a primer able to anneal to said marker locus and amplify said locus allowing for the detection of the resulting amplified marker amplicon.)
56. The method of embodiment 55, wherein the amplifying comprises: a) admixing an amplification primer or amplification primer pair with a nucleic acid isolated from the first soybean plant or germplasm, wherein the primer or primer pair is complementary or partially complementary to at least a portion of the marker locus, and is capable of initiating DNA polymerization by a DNA polymerase using the soybean nucleic acid as a template; and, b) extending the primer or primer pair in a DNA polymerization reaction comprising a DNA polymerase and a template nucleic acid to generate at least one amplicon; further embodiments, include the primer pair used in said DNA polymerization reaction and/or a composition comprising said primer pair.
57. The method of embodiments 32-56, wherein the nucleic acid is selected from DNA or RNA, in some embodiments isolated genomic DNA and/or RNA.
58. The method of embodiments 55-57, wherein the amplifying comprises employing a polymerase chain reaction (PCR) or ligase chain reaction (LCR) using a nucleic acid isolated from a soybean plant or germplasm as a template in the PCR or LCR, further embodiments wherein said soybean plant is either *Glycine max* or *Glycine tomentella*
59. A primer diagnostic for ASR resistance wherein said primer can be used in a PCR reaction to indicate the presence of an allele associated with ASR resistance, wherein said allele is any favorable allele as described in Tables 1-5 and/or said primer comprises a nucleotide sequence including any of SEQ ID NOs: 1-5 wherein primer is used in a PCR reaction to generate a amplicon diagnostic for at least one allele that is associated with ASR resistance; further a composition comprising said primer.
60. The method of embodiments 27-58, wherein the plant produced or identified by said methods, further confers increased resistance to any one of soy cyst nematode, bacterial pustule, IDC, root knot nematode, frog eye leaf spot, phytopthora, brown stem rot, nematode, rust, smut, *Golovinomyces cichoracearum, Erysiphe cichoracearum, Blumeria graminis, Podosphaera xanthii, Sphaerotheca fuliginea, Pythium ultimum, Uncinula necator, Mycosphaerella pinodes, Magnaporthe grisea, Bipolaris oryzae, Magnaporthe grisea, Rhizoctonia solani, Phytophthora sojae, Schizaphis graminum, Bemisia tabaci, Rhopalosiphum maidis, Deroceras reticulatum, Diatraea saccharalis, Schizaphis graminum* and *Myzus persicae*; or a combination thereof.
61. A plant, seed or plant part produced by the methods of embodiments 27-58 or 60.
62. The plant of embodiment 61, wherein the plant is an elite *Glycine max* plant, in some embodiments the plant is an elite *Glycine max* plant having commercially significant yield.
63. The plant of embodiment 62, wherein the plant is an agronomically elite *Glycine max* plant and in some instances the agronomically elite *Glycine max* plant shows commercially significant yield.
64. The plant of embodiments 61-63, wherein said plant displays no yield drag or negative agronomic effects as compared to a control and/or check plant; or in other instances has susceptible commercial performance as compared to a commercial check.
65. A method for producing at least one hybrid between a first parent plant of a wild perennial *Glycine* species and a second parent plant that is a domestic annual *Glycine* cultivar, wherein said *Glycine* cultivar is capable of being backcrossed with a domestic annual *Glycine* cultivar to produce at least one plant of a first backcross generation, or fertile progeny thereof, said method comprising the steps of:
   a. providing at least one wild glycine plant (wg) and at least one domestic annual *Glycine* parental plant (dg);
   b. allowing parental plants to flower;
   c. crossing said wg plant with dg plant (In most embodiments this cross is a "non-natural cross" thus not able to produce viable/fertile offspring);
   d. generating pods from the cross of c);
   e. isolating embryos from the pods of d) and placing said embryos onto embryo rescue medium, wherein there is no callus induction;
   f. transferring the embryos of e) onto germination medium or elongation medium and collecting shoots from said embryos;
   g. growing the collected shoots of f) on germination or elongation medium; and
   h. transferring established shoots of e) to soil, thereby producing a hybrid between a first parent plant of a wild perennial *Glycine* species and a second parent plant that is a domestic annual *Glycine*; in some embodiments this hybrid is a amphidiploid hybrid capable of being backcrossed with a *Glycine max* plant for at least 1 generation.
66. The method of embodiment 65 wherein said wild Glycine line is selected from the group consisting of *G. canescens, G. argyrea, G. clandestine, G. latrobeana, G. albicans, G. aphyonota, G. arenaria, G. curvata, G. cyrtoloba, G. dolichocarpa, G. falcate, G. gracei, G. hirticaulis, G. lactovirens, G. latifolia, G. microphylla, G. montis*-douglas, *G. peratosa, G. pescadrensis, G. pindanica, G. pullenii, G. rubiginosa, G. stenophita, G. syndetika*, and *G. tomentella.*
67. The method of embodiments 65-66, wherein the wild *Glycine* parental plant is *Glycine tomentella.*
68. The method of embodiments 65-66, wherein the wild perennial *Glycine* carries a desirable agronomic trait such as disease resistance (e.g. ASR) and/or abiotic stress resistance (e.g. drought resistance) and/or insect resistance (e.g. Aphid resistance) and/or higher yield.
69. The method of embodiment 68, wherein the desirable trait is selected from the group consisting of: disease resistance including but not limited to, resistance to: soy cyst nematode, bacterial pustule, root knot nematode, frog eye leaf spot, phytopthora, brown stem rot, nematode, rust, smut, *Golovinomyces cichoracearum, Erysiphe cichoracearum, Blumeria graminis,*

*Podosphaera xanthii, Sphaerotheca fuliginea, Pythium ultimum, Uncinula necator, Mycosphaerella pinodes, Magnaporthe grisea, Bipolaris oryzae, Magnaporthe grisea, Rhizoctonia solani, Phytophthora sojae, Schizaphis graminum, Bemisia tabaci, Rhopalosiphum maidis, Deroceras reticulatum, Diatraea saccharalis, Schizaphis graminum* or *Myzus persicae*; increased yield, increased resistance or tolerance to iron deficiency chlorosis, and increased drought or heat tolerance.

70. The method of embodiments 65-69, wherein the domestic annual *Glycine* is *Glycine max*.

71. The method of embodiments 65-70, wherein the dg plant is used as a female plant and said wg plant is the pollen donor or alternatively the dg plant can be used as a pollen donor (i.e. male line) and wg used as the female line.

72. The method of embodiments 65-71, wherein the pods of d) are treated with a hormone mixture comprising GA3, NAA and Kinetin (in some embodiments 100 mg GA3, 25 mg NAA and 5 mg kinetin/L and further, in some instances, wherein said hormone treatment is sprayed on pods daily until harvest.

73. The method of embodiments 65-72, wherein the pods are collected prior to 19 days after pollination.

74. The method of embodiments 65-73, wherein the embryos and/or shoots are treated with a chromosome doubling agent in any one of steps e)-h) to create amphidiploid plants capable of being backcrossed with a domestic annual *Glycine* cultivar to produce at least one backcross generation.

75. The method of embodiment 74, wherein the chromosome doubling agent is either colchicine, oryzalin or trifluralin.

76. The method of embodiments 65-75, wherein the embryos of e) remain on embryo rescue medium for at least about 20 days at about 24° C.

77. The method of embodiments 65-76, wherein the embryos of f) remain on germination or elongation medium for at least about 20 days at about 24° C.

78. The method of embodiment 76, wherein the embryo rescue medium is Soy ER1-1.

79. The method of embodiments 65-78, wherein the cross of c) does not require the emasculation of flowers.

80. The method of embodiments 65-79, wherein the cross of c) is a non-natural cross wherein no viable and/or fertile offspring would be produced without further intervention such as, for example, steps d)-h).

81. The method of embodiments 65-80, wherein the method further comprises a step i) wherein the hybrid plant of h) is backcrossed at least once with a *Glycine max* plant in most embodiments the backcross retains a favorable inherited agronomic trait from said wg, for example, the favorable agronomic trait could be disease resistance (e.g. ASR) and/or abiotic stress resistance (e.g. drought resistance) and/or insect resistance (e.g. Aphid resistance) and/or higher yield; In further instances the backcross is carried out for four generations (BC4) resulting in a fertile dg progeny plant comprising said favorable inherited agronomic trait wherein the backcross progression follows a wide cross between wg and dg plant followed by embryo rescue as in embodiment 65 thus generating a backcrossed plant which is repeated for BC2, BC3, and in preferred instances BC4 to produce fertile progeny plants comprising said favorable inherited agronomic trait.

82. The method of embodiments 65-81, wherein the method further comprises step j) wherein the hybrid plant of h) is backcrossed multiple times and further wherein each back crossed (BC) generation is selected based on a favorable agronomic trait derived from said wg line; in some instances each backcross is followed by (a-h) for four generations (BC4) thus producing fertile hybrid offspring/progeny plants.

83. The method of embodiments 65-82, wherein the method further comprises step k) counting the number of chromosomes in at least one BC generation and selecting those that have 40 paired chromosomes, 20 chromosome pairs or lines not comprising unpaired chromosomes, or in some instances the plant has more than 20 chromosome pairs.

84. The method of embodiments 65-82, wherein the method further comprises step k) counting the number of chromosomes in at least one BC generation and selecting for lines that have no unpaired chromosomes and carrying these lines forward for further breeding.

85. A amphidiploid plant produced by the method of embodiments 65-85.

86. A domestic annual *Glycine* plant derived from the plant of embodiment 86.

87. A domestic annual *Glycine* plant of embodiment 87, wherein the *Glycine* plant has inherited a desirable agronomic trait from perennial wild *Glycine* parent for example, the desirable agronomic trait could be disease resistance (e.g. ASR) and/or abiotic stress resistance (e.g. drought resistance) and/or insect resistance (e.g. Aphid resistance) and/or higher yield.

88. The domestic annual *Glycine* plant of embodiment 88, wherein the desirable agronomic trait is increased disease resistance to any one of: soy cyst nematode, bacterial pustule, root knot nematode, frog eye leaf spot, phytopthora, brown stem rot, nematode, rust, smut, *Golovinomyces cichoracearum, Erysiphe cichoracearum, Blumeria graminis, Podosphaera xanthii, Sphaerotheca fuliginea, Pythium ultimum, Uncinula necator, Mycosphaerella pinodes, Magnaporthe grisea, Bipolaris oryzae, Magnaporthe grisea, Rhizoctonia solani, Phytophthora sojae, Schizaphis graminum, Bemisia tabaci, Rhopalosiphum maidis, Deroceras reticulatum, Diatraea saccharalis, Schizaphis graminum* or *Myzus persicae.*

89. The domestic annual *Glycine* plant of embodiments 88-89, wherein the desirable agronomic traits is better field or commercial performance in regards to any one of the following: increased yield, lodging, plant height, field emergence, resistance or tolerance to herbicides, bacteria, fungi, viruses and nematodes, drought tolerance, heat tolerance, chilling or freezing tolerance, excessing moisture, salt stress, oxidative stress, food content and makeup, physical appearance, male sterility, dry down, standability, prolificacy, sugar properties, biomass, oil quality or production, protein quality and overall quality.

90. A plant cell, plant part from any of the plants of embodiments 85-90; in some embodiments said plant cell is incapable of producing a plant.

91. A method of controlling ASR in a field comprising the step of planting the seed from any of the plants described in embodiments 1-21; 24-26; 61-64 or 85-89.

Disease Resistant Soybean Plants and Germplasms

The present invention provides disease resistant soybean plants and germplasms. As discussed above, the methods of the present invention may be utilized to identify, produce and/or select a disease resistant soybean plant or germplasm (for example a soybean plant resistant or having increased tolerance to Asian Soybean Rust). In addition, to the methods described above, an Disease resistant soybean plant or germplasm may be produced by any method whereby a marker associated with enhanced disease tolerance is introduced into the soybean plant or germplasm, including, but not limited to, transformation, protoplast transformation or fusion, a double haploid technique, embryo rescue, gene editing and/or by any other nucleic acid transfer system.

In some embodiments, the soybean plant or germplasm comprises a non-naturally occurring variety of soybean. In some embodiments, the soybean plant or germplasm is at least about 50%, 55%, 60%, 65%, 70%, 75%, 80%, 85%, 90%, 95%, 97%, 99% or 100% identical to that of an elite variety of soybean.

The disease resistant soybean plant or germplasm may be the progeny of a cross between an elite variety of soybean and a variety of soybean that comprises an allele associated with enhanced Disease tolerance (e.g. ASR) wherein the allele is within a chromosomal interval selected from the group consisting of:

1) a chromosomal interval derived from PI441001, PI441008, PI446958, PI509501, PI583970, or PI483224 wherein said chromosomal interval corresponds with nucleotide base 1 to nucleotide base 1251375 of SEQ ID NO: 1; or 2) a chromosomal interval derived from PI441001, PI441008, PI446958, PI509501, PI583970, or PI483224 wherein said chromosomal interval corresponds with nucleotide base 1 to nucleotide base 2515428 of SEQ ID NO: 2;

3) a chromosomal interval derived from PI441001, PI441008, PI446958, PI509501, PI583970, or PI483224 wherein said chromosomal interval corresponds with nucleotide base 1 to nucleotide base 365842 of SEQ ID NO: 3; or 4) a chromosomal interval derived from PI441001, PI441008, PI446958, PI509501, PI583970, or PI483224 wherein said chromosomal interval corresponds with nucleotide base 1 to nucleotide base 646429 of SEQ ID NO: 4;

5) a chromosomal interval derived from PI441001, PI441008, PI446958, PI509501, PI583970, or PI483224 wherein said chromosomal interval corresponds with nucleotide base 1 to nucleotide base 750080 of SEQ ID NO: 5; or 6) a chromosomal interval spanning 20 cM, 15 cM, 10 cM, 5 cM, 1 cM, 0.5 cM or in close proximity from a SNP marker that associates with increased ASR resistance in soybean wherein the SNP marker is selected from the group consisting of any SNP marker displayed in Tables 1-5

The disease resistant soybean plant or germplasm may be the progeny of an introgression wherein the recurrent parent is an elite variety of soybean and the donor comprises an allele associated with enhanced disease tolerance and/or resistance wherein the donor carries a chromosomal interval or a portion thereof comprising any one of SEQ ID NOs: 1-4 and wherein the chromosome interval comprises at least one allele selected respectively from Tables 1-5.

The disease resistant soybean plant or germplasm may be the progeny of a cross between a first elite variety of soybean (e.g., a tester line) and the progeny of a cross between a second elite variety of soybean (e.g., a recurrent parent) and a variety of soybean that comprises an allele associated with enhanced ASR tolerance (e.g., a donor).

The disease resistant soybean plant or germplasm may be the progeny of a cross between a first elite variety of soybean and the progeny of an introgression wherein the recurrent parent is a second elite variety of soybean and the donor comprises an allele associated with enhanced ASR tolerance.

A disease resistant soybean plant and germplasm of the present invention may comprise one or more markers of the present invention (e.g. any marker described in Tables 1-5; or any marker in close proximity to any marker as described in Tables 1-5).

In some embodiments, the disease resistant soybean plant or germplasm may comprise within its genome, a marker associated with enhanced ASR tolerance, wherein said marker is located within a chromosomal interval selected from the group consisting of:

1) a chromosomal interval derived from PI441001, PI441008, PI446958, PI509501, PI583970, or PI483224 wherein said chromosomal interval corresponds with nucleotide base 1 to nucleotide base 1251375 of SEQ ID NO: 1; or 2) a chromosomal interval derived from PI441001, PI441008, PI446958, PI509501, PI583970, or PI483224 wherein said chromosomal interval corresponds with nucleotide base 1 to nucleotide base 2515428 of SEQ ID NO: 2;

3) a chromosomal interval derived from PI441001, PI441008, PI446958, PI509501, PI583970, or PI483224 wherein said chromosomal interval corresponds with nucleotide base 1 to nucleotide base 365842 of SEQ ID NO: 3; or 4) a chromosomal interval derived from PI441001, PI441008, PI446958, PI509501, PI583970, or PI483224 wherein said chromosomal interval corresponds with nucleotide base 1 to nucleotide base 646429 of SEQ ID NO: 4;

5) 5) a chromosomal interval derived from PI441001, PI441008, PI446958, PI509501, PI583970, or PI483224 wherein said chromosomal interval corresponds with nucleotide base 1 to nucleotide base 750080 of SEQ ID NO: 5; or 6) a chromosomal interval spanning 20 cM, 15 cM, 10 cM, 5 cM, 1 cM, 0.5 cM or in close proximity from a SNP marker that associates with increased ASR resistance in soybean wherein the SNP marker is selected from the group consisting of any SNP marker displayed in Tables 1-5.

In some embodiments, the disease resistant soybean plant or germplasm may comprise within its genome a marker that comprises, consists essentially of or consists of marker alleles located in at least two different chromosomal intervals. For example, the marker may comprise one or more alleles located in the chromosomal interval defined by and including any combination of two markers in Table 1 and one or more alleles located in the chromosomal interval defined by and including any combination of two markers in Table 2.

Disease Resistant Soybean Seeds

The present invention provides disease resistant soybean seeds. As discussed above, the methods of the present invention may be utilized to identify, produce and/or select a disease resistant soybean seed. In addition to the methods described above, a disease resistant soybean seed may be produced by any method whereby a marker associated with enhanced ASR tolerance is introduced into the soybean seed, including, but not limited to, transformation, protoplast transformation or fusion, a double haploid technique, embryo rescue, genetic editing (e.g. CRISPR or TALEN or MegaNucleases) and/or by any other nucleic acid transfer system.

In some embodiments, the disease resistant soybean seed comprises a non-naturally occurring variety of soybean. In some embodiments, the soybean seed is at least about 50%, 55%, 60%, 65%, 70%, 75%, 80%, 85%, 90%, 95%, 97%, 99% or 100% identical to that of an elite variety of soybean.

The disease resistant soybean seed may be produced by a disease resistant soybean plant identified, produced or selected by the methods of the present invention. In some embodiments, the disease resistant soybean seed is produced by a disease resistant soybean or wild glycine plant (e.g. *Glycine tomentella*) plant comprising any one of chromosomal intervals corresponding to SEQ ID NOs: 1-5.

A disease resistant soybean seed of the present invention may comprise, be selected by or produced by use of one or more markers from Tables 1-5 of the present invention.

In some embodiments, the disease resistant soybean seed may comprise within its genome, a marker associated with enhanced ASR tolerance, wherein said marker is located within a chromosomal interval selected from the group consisting of:

1) a chromosomal interval derived from PI441001, PI441008, PI446958, PI509501, PI583970, or PI483224 wherein said chromosomal interval corresponds with nucleotide base 1 to nucleotide base 1251375 of SEQ ID NO: 1; or 2) a chromosomal interval derived from PI441001, PI441008, PI446958, PI509501, PI583970, or PI483224 wherein said chromosomal interval corresponds with nucleotide base 1 to nucleotide base 2515428 of SEQ ID NO: 2;

3) a chromosomal interval derived from PI441001, PI441008, PI446958, PI509501, PI583970, or PI483224 wherein said chromosomal interval corresponds with nucleotide base 1 to nucleotide base 365842 of SEQ ID NO: 3; or 4) a chromosomal interval derived from PI441001, PI441008, PI446958, PI509501, PI583970, or PI483224 wherein said chromosomal interval corresponds with nucleotide base 1 to nucleotide base 646429 of SEQ ID NO: 4;

5) a chromosomal interval derived from PI441001, PI441008, PI446958, PI509501, PI583970, or PI483224 wherein said chromosomal interval corresponds with nucleotide base 1 to nucleotide base 750080 of SEQ ID NO: 5;

6) a chromosomal interval spanning 20 cM, 15 cM, 10 cM, 5 cM, 1 cM, 0.5 cM or in close proximity from a SNP marker that associates with increased ASR resistance in soybean wherein the SNP marker is selected from the group consisting of any SNP marker displayed in Tables 1-5.

EXAMPLES

The following examples are not intended to be a detailed catalog of all the different ways in which the present invention may be implemented or of all the features that may be added to the present invention. Persons skilled in the art will appreciate that numerous variations and additions to the various embodiments may be made without departing from the present invention. Hence, the following descriptions are intended to illustrate some particular embodiments of the invention, and not to exhaustively specify all permutations, combinations and variations thereof.

Example 1 Identification of ASR Resistant Wild Glycine Lines

Multiple wild glycine (*Glycine tomentella*) lines were evaluated for ASR resistance against sixteen rust strains collected across a diverse range of environments. The rust data were generated using single pustule derived isolates from USDA-ARS (FL Q09, FL Q12, LABR13, FLQ11) and field populations (FL Q15, FLQ16, RTP1, RTP2, Vero, GA15, UBL, BR south and BR central), the screening was carried out in contained facilities. Of the *Glycine tomentella* lines screened for ASR resistance, the following *Glycine tomentella* lines showed broad resistance against all ASR strains tested: PI441001, PI441008, PI446958, PI509501, PI583970, and PI483224.

Each *Glycine tomentella* line was evaluated over a multiple day course of infection and rated at various time points using a rust rating scale based on groupings modified from Burdon and Speer, T A G, 1984 (see FIG. 6). Each *Glycine tomentella* accession was screened >2 times with ~4 plants each time in North & South America using a large diverse panel of rust isolates.

Example 2 Allele Mining & Associations to PI441001, PI441008, PI446958, PI509501, PI583970, or PI483224 ASR Loci Resistant parent lines (i.e. PI441001, PI441008, PI446958, PI509501, PI583970, and PI483224) were crossed with a susceptible *Glycine tomentella* line and F1 plants were generated (See Table 5). F1 plants were self-fertilized to generate F2 seed. F2 seed was harvested from the selfed F1 plant. Around 200 F2 seed were sown and leaf tissue from each plant was collected for genotyping studies. Each line was inoculated with *Phakopsora pachyrhizi* to determine the resistance/susceptible phenotype of each F2 individual. Tissue from 50 resistant F2s and 50 susceptible F2s were combined in separate pools and genomic DNA was prepared from each pool. Illumina sequencing libraries were prepared from DNA for each of the pools and each library was sequenced in two Illumina HiSeq2000 2×100 bp Paired-End (PE) lanes. The average yield per sample was 383 million read pairs, which equals 77 gigabases of sequence per library. The sequencing reads were trimmed to remove bases with PHRED quality scores of <15.

Quality trimmed reads were aligned to the PI441001, PI441008, PI583970, and PI483224 reference genome sequence using GSNAP (WU and NACU 2010) as paired-end fragments. If a pair of reads could not be aligned together, they were treated as singletons for alignment. Reads were used in subsequent analyses if they mapped uniquely to the reference (≤2 mismatches every 36 bp and less than 5 bases for every 75 bp as tails).

SNPs were filtered prior to BSA analysis based on read depth, with SNPs having between 40 and 200× read depth being retained. A Chi-square test was used to select SNPs with significantly different read counts between the two alleles in the two pools. An empirical Bayesian approach (LIU et al. 2012) was used to estimate the conditional probability that there is no recombination between each SNP marker and the causal locus in both the resistant pool and in the susceptible pool. The probability of the linkage between the SNP and the causal gene is the geometric mean of these two conditional probabilities. Around 1000 SNPs were found to have possible linkage to the target locus. A subset of these putatively linked SNPs were used to fine map the locus using phenotyped F2 individuals. See references: LIU, S., C.-T. YEH, H. M. TANG, D. NETTLETON AND P. S. SCHNABLE, 2012 Gene Mapping via Bulked Segregant RNA-Seq (BSR-Seq). PLoS ONE 7: e36406 & Wu, T. D., and S. Nacu, 2010 Fast and SNP-tolerant detection of complex variants and splicing in short reads. Bioinformatics 26: 873-881.

TABLE 5

Plant Crossings and Study Type

| Species | PI# (male) | PI # (female) | Genome Size (Gb) | F2: Resistant to Susceptible Ratio |
|---|---|---|---|---|
| *G. tomentella* | PI441001 | PI441010 | 2 | 3:1 |
| *G. tomentella* | PI441001 | PI441011 | 2 | 3:1 |
| *G. tomentella* | PI441001 | PI441010 | 2 | 3:1 |
| *G. tomentella* | PI583970 | PI441007 | 2 | 3:1 |
| *G. tomentella* | PI583970 | PI441010 | 2 | 3:1 |
| *G. tomentella* | PI583970 | PI441011 | 2 | 3:1 |
| *G. tomentella* | PI448224 | PI441010 | 2 | 3:1 |
| *G. tomentella* | PI441008 | PI441010 | 2 | 7:9 |

1. PI441001 Data2Bio LLC (Ames, Iowa) Lab Methodology for gBSA-Seq Analysis for Tetraploid Soybean.

Chromosome discovery for causal loci in the tetraploid soybean population, PI441001 was carried out using Data2Bio's Genomic Bulked Segregant Analysis (gBSA) technology. It was theorized that ASR resistance is controlled by a single dominant allele. Four libraries were generated from DNA samples extracted from two susceptible tissue pools and two resistant tissue pools. These pools were then sequenced in eight (8) Illumina HiSeq2000 2×100 bp Paired-End (PE) lanes. A summary of the reference genomes used for subsequent analyses, read processing from raw data to quality trimming, alignment, SNP discovery and SNP impact are demonstrated in FIGS. 1-5 for population 441001. After various filtering steps 110,503 informative SNPs were identified in the PI441001 genome as being significantly associated with ASR resistance. A Bayesian approach was then used to calculate trait-associated probabilities. Next, physical maps of trait-associated SNPs (probability cutoff at 0.01) for the top contigs were created (FIG. 1). Two scaffolds, 46840 and 49652, were identified in PI441001 (SEQ ID NOs: 1 and 2 respectively). SNPs from these enriched scaffolds were mapped to the public *Glycine max* genome. In both populations, most of the SNPs from the top scaffolds clustered on small portions of Chr05 and Chr08 (see FIG. 4).

2. PI583970 Data2Bio LLC (Ames, Iowa) Lab Methodology for gBSA-Seq Analysis for Tetraploid Soybean Chromosome discovery for loci in the tetraploid soybean population, PI583970 was carried out using Data2Bio's Genomic Bulked Segregant Analysis (gBSA) technology. Two libraries were created from RNA samples extracted from one susceptible tissue pool and one resistant tissue RNA pool. After various filtering steps 59,014 informative SNPs were identified in the PI583970 genome that were significantly associated with ASR resistance. A Bayesian approach was then used to calculate trait-associated probabilities. Next, a physical map of trait-associated SNPs on contigs was created. The clustering of these SNPs suggests that the resistance loci is located in or near scaffold 000819F (see FIG. 7; Scaffold 001084F is SEQ ID NO: 4). The context sequences associated with these SNPs were also aligned to the public *Glycine max* genome to create a chromosome-level understanding of the mapping interval. The chromosomal positions of the trait-associated (ASR resistance) SNPs were then displayed graphically. Most of the SNPs from scaffold 001084F mapped and clustered on a small region of Chr05 (see FIG. 8). The data suggest that the loci responsible for ASR resistance maps within or near the interval 0.11 to 0.30 Mbp on scaffold 001084F (FIG. 9).

3. PI483224 Data2Bio LLC (Ames, Iowa) Lab Methodology for gBSA-Seq Analysis for Tetraploid Soybean Chromosome discovery for causal loci in the tetraploid soybean population, PI483224 was carried out using Data2Bio's Genomic Bulked Segregant Analysis (gBSA) technology. Two libraries were created from DNA samples extracted from one susceptible tissue pool and one resistant tissue pool (PI483224). After various filtering steps 428,263 informative SNPs were identified in the PI483224 genome to be significantly associated with ASR resistance. A Bayesian approach was then used to calculate trait-associated probabilities. Next, a physical map of trait-associated SNPs on contigs was created. The clustering of these SNPs indicates that the ASR resistance loci is located on or near scaffold 002687F (see FIG. 10). The context sequences associated with these SNPs were also aligned to the public *Glycine max* genome to create a chromosome-level understanding of the mapping interval. The chromosomal positions of the trait-associated (ASR resistant) SNPs were displayed graphically. Most of the SNPs from scaffold 002687F mapped to a small region of Chr05 (See FIG. 11). Data indicates that the ASR loci may map within or near the interval 0.17 to 0.36 MB on scaffold 002687F (see FIG. 12 and SEQ ID NO: 3).

Example 3 Embryo Rescue & Introgression of R Gene Intervals into *Glycine max* Lines Embryo rescue is performed (as described below) and chemical treatment to induce chromosome doubling is applied in order to generate amphidiploid shoots. If the amphidiploid plants are fertile they will be used to backcross with *Glycine max*. Backcrossing with *Glycine max* and subsequent embryo rescue will need to be performed for several generations in order to gradually eliminate the perennial *Glycine tomentella* chromosomes eventually resulting in ASR resistant *Glycine max* plant Wide crosses were carried out using Elite Syngenta soybean (*Glycine max*) lines (RM 3.7 to 4.8). The elite soybean lines are used as the females (pollen recipients) and multiple accessions of *Glycine tomentella* are used as the males or pollen donors. Selecting flowers from the *Glycine tomentella* plant containing anthers at the proper developmental stage is important. New, fully-opened, brightly colored flowers hold anthers with mature pollen. The pollen should appear as loose, yellow dust. These flowers are removed from the *Glycine tomentella* plant and crossed with the elite *Glycine max* plant for pollination. Pollen from the *Glycine tomentella* plants should be used within 30 minutes of flower removal. It is also important to identify and select elite soybean flower buds that are ready for pollination. A soybean flower bud is generally ready when it is larger in size when compared to an immature bud. The sepals of the soybean blossoms are lighter in color and the petals are just beginning to appear. First, use a pair of fine-tipped tweezers to carefully detach the sepals from the flower bud to expose the outer set of petals. Then, gently grasp and remove the petals (5 in total) from the flower exposing the ring of stamens surrounding the pistil. Since the stigma is receptive to pollen 1 day before the anthers begin shedding pollen it is important to recognize the stage development of "female ready, male not ready". When pollinating soybean flowers at this developmental stage it is not necessary to emasculate the female flower. Locate the stigma on the elite soybean flower. Then using 1 male flower, carefully peel off the petals to expose the anthers and gently dust the pollen grains onto the stigma of the soybean flower. Care should be taken not to damage the stigma at any time during this process. Starting the day after pollination a hormone mixture is sprayed onto the pollinated flower and eventual developing F1 pod 1× every day until harvest. The pollinated flower or pod is saturated with a light mist of the hormone mixture, taking care not to cause the flower/pod to prematurely detach from the plant. The mixture contains 100 mg GA3, 25 mg 1-Naphthaleneacetic acid (NAA) and 5 mg kinetin/L distilled water. Application of these hormones aid in the retention of the developing pod and in increased pod growth. The above described wide cross methodology results in success rates significantly higher than that reported in the literature. Further, no emasculation of female flowers is necessary, which saves time and reduces risk of damage to the stigma.

Harvest: Pods from wide crosses are harvested at approximately 14 to 16 days post pollination. (Harvest dates in the literature suggest 19 to 21 days, however the above method allows for faster harvest time and more robust pods). Pods are collected and counted according to wide cross combination to determine crossing success. The average crossing success across multiple soybean females and 5 different accessions of *Glycine tomentella* is approximately 40%. The wide cross pods can contain 1 to 3 seeds but generally 2 seeds are found in each F1 pod. The above described methodology allows for pod harvest at 14 to 16 days after pollination, ~5 days earlier than described in literature.

Embryo rescue: Harvested pods are collected and brought back to the lab to be sterilized. The pods are first rinsed with 70% EtOH for 2 to 3 minutes and then placed in 10% Clorox bleach for an additional 30 minutes on a platform shaker at approximately 130 RPM. Finally, the pods are rinsed multiple times with sterile water to remove any residual bleach. Embryo isolation can begin immediately following pod sterilization or pods can be stored at 4° C. for up to 24 hours prior to embryo isolation. The sterilized pods are next taken to a laminar flow hood where the embryos can be rescued. Individual pods are placed in a sterile petri dish and opened using a scalpel and forceps. An incision is made along the length of the wide cross pod away from the seed. The pod can then be easily opened to expose the seed. Alternatively, two pair of forceps can be used to separate the pod shell. Carefully remove the seed from the pod and place in a sterile petri dish under a dissection microscope. Very fine forceps are needed to isolate the embryo from the seed. With forceps in one hand, gently hold the side of the seed away from the embryo, with the hilum facing up. Use another pair of forceps in the other hand to remove the seed coat from the side of the seed containing the embryo. Peel off the membrane surrounding the embryo and push the embryo up from its bottom side. Embryos should be past the globular developmental stage and preferably past the early heart developmental stage (middle to late heart stage, cotyledon stage and early maturation stage embryos are desired). Isolated embryos are transferred to embryo rescue medium such as Soy ER1-1 (i.e. 3.1 g B5 basal salt, Gamborg's, lml B5 vitamins 1000×, 40 g sucrose [C12H22O11], 0.25 g casein hydrolysate, 0.25 ml BAP, 0.75 g MgCl2*6H20, 20 ml glutamine 25 mg/ml, 0.1 g serine [C3H7NO3], 4 ml Asparagine 25 mg/ml and 0.05 ml of IBA lmg/ml) Murashige and Skoog Medium (MS) and Gamborg's B-5 media (Bridgen, 1994) may also be used as embryo rescue medium. Embryos can be treated to induce chromosome doubling at this time. (See below for chromosome doubling details.) Isolated embryos remain on embryo rescue medium for 21 to 30 days at 24° C. Embryos may remain in the dark for the entire incubation on ER1-1, they also can be incubated in the dark and later completed in the light, or may spend the entire incubation in the light. There is not a callus induction stage in this protocol, shoots are developed directly from the embryos which allows for faster turnaround time, plantlet survival and better quality results. The above described embryo rescue method involves direct shoot regeneration from embryos, rather than regeneration through embryogenesis, thus making plant recovery quicker (shoot recovery in approximately 2-3 months, compared to reported up to 1 year timeline in the literature). Further, the following protocol does not require culture in the dark following transfer to germination medium nor does the above protocol require a transfer to rooting medium.

Chromosome doubling treatments: Either colchicine of trifluralin can be used to induce chromosome doubling. Ideally, late heart stage wide cross embryos (or larger) are chemically treated to induce chromosome doubling at any time from immediately following isolation up to 1 week post isolation. The doubling agent can be mixed in either solid or liquid medium and applied for several hours or up to a few days. Trifluralin is used at a concentration of 10-40 uM in either solid or liquid media. Alternatively, colchicine is used at a concentration of 0.4-1 mg/ml in either solid or liquid media. Following chemical treatment, embryos are transferred to fresh embryo rescue medium.

Shoot regeneration: Developing embryos are transferred from rescue medium to germination medium such as Soy ER GSMv2 (i.e. 3.2 g Schenk and Hilderbrandt Basal salt mixture, 1 g Myo-inositol [C6H1206], 5 ml Thiamine 1 mg/ml, 0.5 ml pyridoxine 1 mg/ml, 10 g sucrose [C12H22O11], and 7.5 g purified agar) for approximately 3 to 5 weeks in the light at 24° C. Alternatively, developing embryos may be transferred from rescue medium to elongation medium such as Soy E1 0 No TCV (i.e. 4.3 g MS Basal salt Mixture [MSP01], 5 ml MS iron 200×, 30 g Sucrose [C12H22011], 1 g MES [C6H13NO4S], 8 g purified agar, 1 ml B5 vitamins 100×, 2 ml glutamine 25 mg/ml, 0.50 ml zeatin riboside, trans isomers 1 mg/ml, 0.1 ml IAA 1 mg/ml, 0.2 ml GA3 5 mg/ml, 1.5 ml timentin 100 mg/ml, 0.3 ml cefotaxime 250 mg/ml, 0.5 ml vancomycin 100 mg/ml) Shoots can be kept on medium for approximately 3 to 5 weeks in the light at 24° C. Developing shoots may be transferred from media plates to Phytocons containing either germination or elongation medium for further shoot development. Established shoots having suitable roots are moved to soil.

Ploidy Analysis: Ploidy analysis is conducted using a flow cytometer. Leaf tissue for ploidy analysis is collected from small shoots either in culture or after establishment in soil. Tissue is collected on dry ice and stored at −80° C. until analysis, or collected on wet ice and analyzed the same day. A sample size of 0.5 $cm^2$ is sufficient. Samples are prepared according to the instructions in the Sysmex kit (Sysmex Inc., Kobe Japan). Each sample set contains an untreated F1 plant (not treated to induce chromosome doubling) as a control.

Example 4 ASR Resistance Trait Introgression

Amphidiploid lines generated from the wide cross (i.e. *Glycine tomentella* crossed with *Glycine max*) followed by embryo rescue as described in Example 3 were backcrossed multiple times with a recurrent elite *Glycine max* lines. It is known in the art that multiple backcrosses are needed to generate fertile hybrid lines, in particular the literature suggests that a BC3 generation is necessary. In this case it was determined that an additional backcrosses are necessary, BC4 in the case of *G. tomentella* x *G. max* to generate fertile hybrid plants. F1 hybrid plants produced by the methods as described above were created from wide crosses comprising PI441001, PI441008, PI446958, PI509501, PI583970, and PI483224. F1 plants were next crossed as a female with a male recurrent *G. max* plant to perform a first backcross (BC1 progeny). BC1 Progeny were further backcrossed for multiple generations (e.g. BC2). BC plants are evaluated for ASR resistance, chromosome numbers and in some cases lines are genotyped through use of molecular markers as described herein to detect the presence of chromosome intervals corresponding to SEQ ID NOs 1-5 or any marker identified in Tables 1-5.

The above examples clearly illustrate the advantages of the invention. Although the present invention has been described with reference to specific details of certain embodiments thereof, it is not intended that such details should be regarded as limitations upon the scope of the invention except as and to the extent that they are included in the accompanying claims.

Throughout this application, various patents, patent publications and non-patent publications are referenced. The disclosures of these patents, patent publications and non-patent publications in their entireties are incorporated by reference herein into this application in order to more fully describe the state of the art to which this invention pertains.

SEQUENCE LISTING (5 sequences)

SEQ ID NO: 1 - DNA, 1251375 bp, Glycine tomentella
  variation 3743: note = n is a, c, g, or t
  variation 6487: note = n is a, c, g, or t
  variation 6714..6843: note = n is a, c, g, or t
  variation 13645..13654: note = n is a, c, g, or t
  variation 18350: note = n is a, c, g, or t
  variation 18754..18802: note = n is a, c, g, or t
  variation 24574..24583: note = n is a, c, g, or t
  variation 25088..25097: note = n is a, c, g, or t
  variation 32135..32193: note = n is a, c, g, or t
  variation 35152: note = n is a, c, g, or t
  variation 43433: note = n is a, c, g, or t
  variation 44013..44022: note = n is a, c, g, or t
  variation 65324..65956: note = n is a, c, g, or t
  variation 73652..73758: note = n is a, c, g, or t
  variation 74056..74065: note = n is a, c, g, or t
  variation 83516..83655: note = n is a, c, g, or t
  variation 96213..96223: note = n is a, c, g, or t
  variation 98450..98461: note = n is a, c, g, or t
  variation 100615..100751: note = n is a, c, g, or t
  variation 104079..104158: note = n is a, c, g, or t
  variation 105730: note = n is a, c, g, or t
  variation 137451..137456: note = n is a, c, g, or t
  variation 149132..149203: note = n is a, c, g, or t
  variation 161633..161642: note = n is a, c, g, or t
  variation 162469..162911: note = n is a, c, g, or t
  variation 163331: note = n is a, c, g, or t
  variation 165117..165210: note = n is a, c, g, or t
  variation 165516..165569: note = n is a, c, g, or t
  variation 189362..189372: note = n is a, c, g, or t
  variation 189972..189981: note = n is a, c, g, or t
  variation 190341..190350: note = n is a, c, g, or t
  variation 207000: note = n is a, c, g, or t
  variation 245708..247592: note = n is a, c, g, or t
  variation 249191..249200: note = n is a, c, g, or t
  variation 250659..251395: note = n is a, c, g, or t
  variation 253730..253989: note = n is a, c, g, or t
  variation 262458: note = n is a, c, g, or t
  variation 270839..270949: note = n is a, c, g, or t
  variation 275550..281035: note = n is a, c, g, or t
  variation 281436..283402: note = n is a, c, g, or t
  variation 293342..293767: note = n is a, c, g, or t
  variation 295911..295920: note = n is a, c, g, or t
  variation 296558..296726: note = n is a, c, g, or t
  variation 302530: note = n is a, c, g, or t
  variation 314836..314915: note = n is a, c, g, or t
  variation 315503..317023: note = n is a, c, g, or t
  variation 326664..326850: note = n is a, c, g, or t
  variation 340015: note = n is a, c, g, or t
  variation 360998..361007: note = n is a, c, g, or t
  variation 363072..363100: note = n is a, c, g, or t
  variation 368600..368911: note = n is a, c, g, or t
  variation 369248..369294: note = n is a, c, g, or t
  variation 370605..370649: note = n is a, c, g, or t
  variation 378006..378736: note = n is a, c, g, or t
  variation 379037..379046: note = n is a, c, g, or t
  variation 383621..383630: note = n is a, c, g, or t
  variation 384720..384729: note = n is a, c, g, or t
  variation 390771..390952: note = n is a, c, g, or t
  variation 409988..409997: note = n is a, c, g, or t
  variation 410222: note = n is a, c, g, or t
  variation 415207: note = n is a, c, g, or t
  variation 428722..428731: note = n is a, c, g, or t
  variation 429005..429014: note = n is a, c, g, or t
  variation 431398..431647: note = n is a, c, g, or t
  variation 432669..432678: note = n is a, c, g, or t
  variation 446511: note = n is a, c, g, or t
  variation 447589..447604: note = n is a, c, g, or t
  variation 447908..447917: note = n is a, c, g, or t
  variation 448306..448315: note = n is a, c, g, or t
  variation 448873..448882: note = n is a, c, g, or t
  variation 450596..450605: note = n is a, c, g, or t
  variation 453870..453901: note = n is a, c, g, or t
  variation 454222..454467: note = n is a, c, g, or t
  variation 454683..454820: note = n is a, c, g, or t
  variation 457674..457733: note = n is a, c, g, or t
  variation 470043..470052: note = n is a, c, g, or t
  variation 470602: note = n is a, c, g, or t
  variation 493592..493605: note = n is a, c, g, or t
  variation 502875..502989: note = n is a, c, g, or t
  variation 511381: note = n is a, c, g, or t
  variation 523112..523158: note = n is a, c, g, or t
  variation 527058..527523: note = n is a, c, g, or t
  variation 543294..543303: note = n is a, c, g, or t
  variation 544118..544127: note = n is a, c, g, or t
  variation 546836..546845: note = n is a, c, g, or t
  variation 547275..547284: note = n is a, c, g, or t
  variation 567418..567477: note = n is a, c, g, or t
  variation 569163: note = n is a, c, g, or t
  variation 572499..572508: note = n is a, c, g, or t
  variation 573364..573373: note = n is a, c, g, or t
  variation 574731..574741: note = n is a, c, g, or t
  variation 578302..578967: note = n is a, c, g, or t
  variation 587637..587646: note = n is a, c, g, or t
  variation 588256..588265: note = n is a, c, g, or t
  variation 590249: note = n is a, c, g, or t
  variation 592172..592177: note = n is a, c, g, or t
  variation 595059..595068: note = n is a, c, g, or t
  variation 597493..597547: note = n is a, c, g, or t
  variation 599073..599455: note = n is a, c, g, or t
  variation 601068..601077: note = n is a, c, g, or t
  variation 602150..602334: note = n is a, c, g, or t
  variation 606659: note = n is a, c, g, or t
  variation 612248..612656: note = n is a, c, g, or t
  variation 619059..619091: note = n is a, c, g, or t
  variation 628824..629230: note = n is a, c, g, or t
  variation 633011..633057: note = n is a, c, g, or t
  variation 634196..634283: note = n is a, c, g, or t
  variation 634585..634658: note = n is a, c, g, or t
  variation 635865..636221: note = n is a, c, g, or t
  variation 644747: note = n is a, c, g, or t
  variation 655918..656003: note = n is a, c, g, or t
  variation 661088: note = n is a, c, g, or t
  variation 678040..678097: note = n is a, c, g, or t
  variation 678825..678834: note = n is a, c, g, or t
  variation 686932..686955: note = n is a, c, g, or t
  variation 687863..687872: note = n is a, c, g, or t
  variation 691642..691651: note = n is a, c, g, or t
  variation 702555..703199: note = n is a, c, g, or t
  variation 714512: note = n is a, c, g, or t
  variation 715825: note = n is a, c, g, or t
  variation 718065..718732: note = n is a, c, g, or t
  variation 721041..721050: note = n is a, c, g, or t
  variation 721388..721397: note = n is a, c, g, or t
  variation 723554..724707: note = n is a, c, g, or t
  variation 745125..745138: note = n is a, c, g, or t
  variation 749380..749432: note = n is a, c, g, or t
  variation 754527..754707: note = n is a, c, g, or t
  variation 761330..761515: note = n is a, c, g, or t
  variation 768966..770481: note = n is a, c, g, or t
  variation 770845..771375: note = n is a, c, g, or t
  variation 774465: note = n is a, c, g, or t
  variation 783479..783488: note = n is a, c, g, or t
  variation 793021..793515: note = n is a, c, g, or t
  variation 795231: note = n is a, c, g, or t
  variation 804966..805735: note = n is a, c, g, or t
  variation 809268..809287: note = n is a, c, g, or t
  variation 812169..812366: note = n is a, c, g, or t
  variation 813540..813789: note = n is a, c, g, or t
  variation 818473: note = n is a, c, g, or t
  variation 823670..823679: note = n is a, c, g, or t
  variation 824379..827421: note = n is a, c, g, or t
  variation 836107..836116: note = n is a, c, g, or t
  variation 836874..836877: note = n is a, c, g, or t
  variation 846128..846239: note = n is a, c, g, or t
  variation 846480..846627: note = n is a, c, g, or t
  variation 854333..854411: note = n is a, c, g, or t
  variation 855187: note = n is a, c, g, or t
  variation 875776..875938: note = n is a, c, g, or t
  variation 877463..877586: note = n is a, c, g, or t
  variation 887712..887721: note = n is a, c, g, or t
  variation 888022..888031: note = n is a, c, g, or t
  variation 888428..888438: note = n is a, c, g, or t
  variation 903022..903047: note = n is a, c, g, or t
  variation 912811..912830: note = n is a, c, g, or t
  variation 913156..913627: note = n is a, c, g, or t
  variation 926097..926119: note = n is a, c, g, or t
  variation 929073..929120: note = n is a, c, g, or t
  variation 931777..931873: note = n is a, c, g, or t
  variation 935381..935535: note = n is a, c, g, or t
  variation 936097: note = n is a, c, g, or t
  variation 942845..942858: note = n is a, c, g, or t
  variation 947497: note = n is a, c, g, or t
  variation 947620..948264: note = n is a, c, g, or t
  variation 956184: note = n is a, c, g, or t
  variation 962446..962890: note = n is a, c, g, or t
  variation 963186..963202: note = n is a, c, g, or t
  variation 980050..980059: note = n is a, c, g, or t
  variation 981369..981378: note = n is a, c, g, or t
  variation 982731..982740: note = n is a, c, g, or t
  variation 986698..987669: note = n is a, c, g, or t
  variation 1000301..1000310: note = n is a, c, g, or t
  variation 1001080..1001089: note = n is a, c, g, or t
  variation 1008462..1008488: note = n is a, c, g, or t
  variation 1008895..1008904: note = n is a, c, g, or t
  variation 1010738..1010754: note = n is a, c, g, or t
  variation 1022521..1022530: note = n is a, c, g, or t
  variation 1024016..1024161: note = n is a, c, g, or t
  variation 1031659..1031738: note = n is a, c, g, or t
  variation 1032206..1032252: note = n is a, c, g, or t
  variation 1036936..1037070: note = n is a, c, g, or t
  variation 1044647..1045077: note = n is a, c, g, or t
  variation 1045394..1045403: note = n is a, c, g, or t
  variation 1049870..1050527: note = n is a, c, g, or t
  variation 1066869..1066879: note = n is a, c, g, or t
  variation 1069789: note = n is a, c, g, or t
  variation 1070584..1070712: note = n is a, c, g, or t
  variation 1085567: note = n is a, c, g, or t
  variation 1087330: note = n is a, c, g, or t
  variation 1095614..1096508: note = n is a, c, g, or t
  variation 1100946: note = n is a, c, g, or t
  variation 1108127..1108174: note = n is a, c, g, or t
  variation 1119361..1119499: note = n is a, c, g, or t
  variation 1127353..1127548: note = n is a, c, g, or t
  variation 1155325..1155359: note = n is a, c, g, or t
  variation 1162753..1162762: note = n is a, c, g, or t
  variation 1163179..1163188: note = n is a, c, g, or t
  variation 1163475..1163484: note = n is a, c, g, or t
  variation 1168942: note = n is a, c, g, or t
  variation 1170213..1170436: note = n is a, c, g, or t
  variation 1170864..1170989: note = n is a, c, g, or t
  variation 1171415..1171424: note = n is a, c, g, or t
  variation 1173346..1173355: note = n is a, c, g, or t
  variation 1175182..1175191: note = n is a, c, g, or t
  variation 1177365..1177826: note = n is a, c, g, or t
  variation 1183611..1183620: note = n is a, c, g, or t
  variation 1185130..1185188: note = n is a, c, g, or t
  variation 1190399: note = n is a, c, g, or t
  variation 1192503..1192599: note = n is a, c, g, or t
  variation 1192893..1193051: note = n is a, c, g, or t
  variation 1194932..1195230: note = n is a, c, g, or t
  variation 1195546..1195555: note = n is a, c, g, or t
  variation 1199449..1199456: note = n is a, c, g, or t
  variation 1201520: note = n is a, c, g, or t
  variation 1202167..1202176: note = n is a, c, g, or t
  variation 1205971..1205980: note = n is a, c, g, or t
  variation 1206280..1206289: note = n is a, c, g, or t
  variation 1211089..1211518: note = n is a, c, g, or t
  variation 1212969..1212979: note = n is a, c, g, or t
  variation 1214399..1215631: note = n is a, c, g, or t
  variation 1216477..1217124: note = n is a, c, g, or t
  variation 1225086..1225303: note = n is a, c, g, or t
  variation 1226695: note = n is a, c, g, or t
  variation 1229361..1229520: note = n is a, c, g, or t
  variation 1232721..1232730: note = n is a, c, g, or t
  variation 1233169..1233178: note = n is a, c, g, or t
  variation 1241251..1241844: note = n is a, c, g, or t
  variation 1242127..1242171: note = n is a, c, g, or t
  variation 1247914..1248947: note = n is a, c, g, or t
  source 1..1251375: mol_type = genomic DNA
tcggaaatgctaaaattaccgacagaattttgtccgtcggaaatttccgacggataattccgtgggtaatttccgacggaaatatccgtcggaaattaccgacggccatatccgtcggaaattacccacggaaatatccgtcggaaatgctaaaattaccgacggaattttgtccgtcgaaaattttcgacggataattccgtgggtaattttcgacggaaatatccgtcggaaaatccgtcagaaattgaattattttccacggtataattaccgacggccatttccgtcggtaatataaatatttccgatggaatttttccgacggaaaataatctgtcggaaattactttccgtcggaaaaatccgtcggaaatgctgaaatttccgacggatttttgtccgtcggaaaaattccgtcggaaatagctttattttttgtagtgaaatggtggttagcaatgatagacatctattgcaatcagtaagtgtttgaggtctaccatatgctatatcattaatggacaggatttagctagcattccttataaagtgaccatgattttgacttctctctgttgccttgtgatgatacttttttcatgcaagcatgtggaagcaattattgttgctattatagtcgaaaagaaattatgttagatttgtggcctcaaaacaacatcctaattatgtctcttttagaagtataatgttgagcagtctcgcagaattatttcgtatatatgcatgtctaagaatatgatgtaaacacactgtctaattactttgcagcacaaaaatgttttttttataacagatttacattgataacaatatttttttaaacattgagataaacattttctattggttgttatataataactgatttcgaaaacacttaaattttagattgattgtattaaaaatttgacatagaaagtacattgatctagaatgtggacactctttacaactttcgaattttttggcaagaatttataatatggtggtatagtaaaccaattttggaaaaaacttttcacatccattcttcgtataaccaatttagattgttgataatttttttcatatttttcattttttacaaaactttttaagtcgattgtgctaagaactaatttagattttttttttctttttaaattgattattagtccagccaatccacaaaatccaatataagttttatgatttcagtaacaaattcctattttcactccaattttttaaccctcttctctagtacgtaagacgaatccaagtttctttggcaaaagtattttcaaacttacattgaagatctacgccccaacaacattgatcatcttcttatatatgattatgattccttcattggctgatacaagtattgtagggtgggatgaaaggatagtaatgtttatagatttgaacaggtgatgttgtgggttctttgatgcaagggttggggtactccttgtaccctctatccatttgtctaataaaattattatttgctgataaaaaaaatataagtatgactccaatacttgttttttttttatatatacatttctccattttcatttttctgaatgtttactgttcttgggtgaatttgtattttaaaacctgacctcattcattaggtgttattatatatgcaactgtatgagataatcttctctctctctgattctataattataacttcactttcaaattatagcctttctctttgtttcaaaccctgaccttgttatatgtttctctcttttaaatttaattttaatttaagagagaagtatgattttttatttttatttttttccttctataactaattaagtgctttttgagaaatttaagaaaactaatccatagcgtatttatgataataaattccttgaaatgggggtccaatatatttaaatttttaaacacgttttttttttctcttttaaaaatcccatttaaattgagttcgtacatttatggcttgcatttcaactccattcttgcattgcatggtcctttcgtttcttgtcttggttgcggagtcaacaagtaaagacgtgctgggtaatgggcatgattgacttgtgtgggagaaagaaaaatactctctcggtgactagtgtgttcatgttctgaagtactaaattatgcaacatttggttgatatcatgtacaatggttttgccaaacctctaaaaagctaagattattttgtcggcttcctggtaagttggccccctaaagtttatcattctgttttttcagttcatattctaagcctttattacacggtcacatgctgctatgggcaattttgcttccaaaggttagtataagatttctagcttttattaaaacatgatcatgaacgcaattcctatgccactaatgaacaagtttaaagtttgtgagtgcaatgcaagaatgtcaaaatttggttagattttcaatttgctcttcaatttgtggccacaaacacacatttgctatgatgatggccccaaatatacctaaactgtcagagaccctattggggattgtctttggatgtgggtgcaattcttgacagcccctgtttagagagcattcttttttattttctaattttcattctgatcaggtgagaatgaattttcttggaccacagcttaaagtgaatatccggccaagttatacataacccttcttttcttgactcatcaattttctttttaaaaagtctcaaactagcattcccaaacaataatttattaatttttcatgcttcaaaataattggtattcttaaaatttagttttttaaaattattttgacaaaaaataataataatatacacttcatgtacattcacacacacacaaaaaaaatccttccgattcttttgagttttgatggtacggtcgccaatttgacccggctcggcccattcaagacattcctaatgcgaaacatacttttagttttaggttgggtcaatttaaattaatttaattgtgcgggttagcatttttttatagctaaatctacttttctttttttacagattttgaaccaaaggttctactttatggacttatattttttaaccaaatgttacatggctataatttaatttatatatatataaataaataaataaataaataataaatagagaatatcaagtgaatttttttttttcattgtcagagagattgaatccaaatgaaattttgtaaatataaatatgaaaaagcaacgtttaattcaacaataactttttaaaaatcaaattacactcatataacttatactcacaatcatatcagtcaattatatggatagtttcatttcaaaacctattgttggattaatttatttattttacatatggatcatatctacaaaaataaccatactaattgtatataaaaaaaacatactaattaaaaaatatgtagttcaattttcattgttctaatacttgagttataatttatattatctttagtgttcttttaagtattgtcaaaattaatatataatcaaatggtttttttcgtatttttcaagtatgtatttaattaattttgatgtttataagttatgtattaaataacttaaattaatatgatttaattataatctatataataagaatttcaacccagtgataaattttggtaaatgcaaattatccaataaaaagttgtttaaaaatgtgagaatttccttaaaaaaantagaatttcctcactgctatcaattttatttatttctcatgatatattttcatttttaacttaattaatatactatcatttttatgataaaataatcttagctcgtgtatattttgtttcaaatgtgacaaatattaatagttactgtaatgtaatattttacacttttatggcatcttactaatttattagaaggaacaaagcaggtaacttttatgtgtgagagactgaaaggtcatagtttacgaataaatttttaaaggaatgccaagcaaagactggggaaaatatcccatctatgatggtacccaaccccatagaaaagctaaggccaacatgaatttattaaagaaagatgagaacaaaatatcatgggaggactaggtcaagacccatgctagagaaatttcaatctatactgagggagtccttgcagatcgtagacaaaaaaatagaaacaaaagaaagggacaccatcccaccaaaaagattgatggatagaaaccgtgaagttagcagtgtaatcttgtaaacgggacaaatattttcttctctagaaatgtgaaaagctttgaaaggaattaaaaaatatatatttattgtgaagatcataaaaaaaaacgtaaaaaatattatgaataatataattttatattttttaatattttttttatttttttaactaatgatctaagaatgttggttagcatttatcataaaagaagattattcaacatttcgttcagatttgttttgatacaaaatttaatatttctttcatttcaaaataaatattatcctaagttgttttatattccttcgtctcattataattggtattctagattatttggcataaacacaaaaaatcactaaatagatgaaagaaaatgacaatttttaaaaaaatattcataccatcattaactatttttgtttttgtaatccatataattaatatcataacagataagtcaaaaaagtaattaatgttgcatttaaaaattaatataaaattattttgagacaattttgtctttttagataacattttttatgggaccaagagactaatagatagataaaagtgaataataattttacacattaaactaatcttaatattaatattatattaaaaaattaaagtaacatttattaaaagtattagttggaagaaaacaactgacattatattaaaaaattaaataaaacacatattttagggaaaaagtatataactgaacacaagtccaatacaatttcccgtcaattagttactgttgaaaaacagtgacgctacccgaaaatgcagaagtctcgtctctttggtaaagatccatacatatataatcaggataaggtaccgaccaagcatcataattttgtttgtatgaacctaaatgatcgctaacaaaacctaatcttcctaattctatgaaatgggtgtacagccatgttcattagtcttcgatggccatatatgacatatctgtcttcctttctaatcactaaccagcagcaactgcactcaccattaagaatttaatttggttaattacagccacatcctggttcgttgtaattatcaattattactttatctcatacactgccaaatcattttgtggcgtaatcagatagaaagtaagtctcaacggtgacgtatagcttgttatacatttgtcgagatgcatgcatacacagtgtaagttacaacatttgaagccgaaactcaacaatacatgaaacatgttcgtcatttttaaattatgataatgatgcgatgaaaatgaaaaggcctcgataatctgtcttcggtttgtggttggctgttatttattttttctttttcttgtttaggtaggaaagtgtgctacatccttctagtattggttgtcatgctttcttgttattttatgtactgacgtgggttagcatgctgccttgaaaaataatgtataacgaaaacaaaagcaggtacaaatattgtgatcacttctagaaggctataaccggttacatctaaggctaatttgaggttaccatattttaattgagacctaatcacagtgtcaacaaaacattttctttaaatgaagaaaaaacctatatataaactcattattcggtaaaaaaaatatgaaaaaagacatcattgtataagttaccaagcattcattttgctacagcggaaattttaaaatttatgtcaacaaattaatttaatttttcaatcacaaatatctaacatatattttaatttttggataagccaattaaaatattttgtagtattttagttgttctggtataaattaaatttacaaaattaagaatatttacagtctaaaattgtatctcaaatttaaatttgtactaatcagtttttatatgagtatgtatgtaatttcatagttacatatatgttacataagaaattaagtaaagtaaaaataaaaattaatattttaatttactttgacttgttaacaaattcttttcataacatgaaaaaatggtataatctttttcatttttatttaataaattctattatgatcttttgctcaattttatttatataattagtatttaataatatattgaaagttgaaacaatgatattttattaattttaataaattaaattttttttatatcactaattgttcttatggtatttttagtaaaggctttttctttgaattctataatattttattattttatatgcataatanaaaaattatatctcaaattgaaatttgtactaatcattttttatatgagtatgtatgtaatttcatagttacatatatgttacataagaaattaagtaaagtaaaaataaaaattaatattttaatttactttgacttgttaacaaattcttttcataacatgaaaaaatggtataatctttttcatttttatttaataaattctattatgatcttttgctcaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctttgaattctataatattttattattttatatgcataatatatatttatatatatatatatatatatatattattcgtttcattctctaataatgaaaatattaaaatggttattcagggttattttttgttataccgaattgctcctatttcttttttacagattatttgatttctttattattttaaaaatgatactaattaatcacacacatttatctttagagaagtaaagtagtgtgttattatacttaacgtacgtaaacaactaatcgacttaacttagtaagaaatttaaacctaatcgcctcttgacagaagtacttcatcttaattcaattaaagatgaagttaacccttccaaatttatttttaaaaaaaataaaggtaaaccataacttacctgtaaatgtgaagcccaaaaaatcatgttaaaccctttgttcttaaaaaacccagctgttaacacttgcatgataagataattgcggtgaggttaacttcacttaccattcacgtaaagggtgtcccaagaattgccagcactaagcaattcaagttacagcacatcgcattggtttctcaaatttgaactgccaaagctttttgcttatacttgtggaaataattagttgacgcctccgaatcaacatcctagtaagcaaaattcaaatggaaatacttttaactttacccttcattattatccaactttcagattttcttcctttactaagttttgtcgacaccgaaattattctctgttgactatgaatcatgacagttaaaaagagaagcattagtgggtgtaggtatagccataagccaattttgcacatttgacttttgaccatctattgctcatggtaggcctttttttgttatttataattattattattctcattttagtagtattttattagtatcatacaataatagtggtagcaataaaaggaaaatgtttttgagtgaactgacataatataataattaattcttggaagtgaaaataacagagaaggttagatggcttcaaaattactcaaaacactgggccagaagtccagcacgtgtagggctcagtgggatatgtgctcgatatacgaggaatgaaagggacccaaagcagaagctaaaatgcgtttaagcaacataataactctaacattggttccctctccttaatcccatttttggttcgttacgctaaaatctcactaatcccaattacttgttagtatagtttattggtaagtaagagcatattcagaaacgagaatgacgcaaatttacgctacttgttgctgccatcacgttttaattcaaccattattttttctcttaaatactacaatattagttaattatattattcaattaggaactagtagcttattctcacagttttttttattgctttgtctcctttagttgtaatatttgctttgacttgcaaaaataagcattaataagtatagtactggcaaatattaagggatgaaagtgtgacgcagggaactcctcggataacttagttaattaaaactgacgttaaagcttaaaagaaatatgaataatagaaaacgtgaataatcagataaatattagttagaacatgtagaaagaagatagggatggcaacaagaattaggagtaggaagacctcttttttttttttcgaatgaaattggacttctaatagcaggatggcgtgccaccaaccatgcattaaagtataaatttaaagtcataataaataaaaaggaaaactaaccaatatattacaaagtgtatttatagtgccatgccaatagcgggatctttggtaagggttagtcacagactatgcgttatgaaacattttctgcgtattttcgaacttagtttgctcaacgagtacaattaattaataaaaggacccgttattcctgtataatgcttgaaactttagcctttgttttcatcgctaaaactagcatcgcctaatcgaatccgactttgttggtcgtcaattttgttattttctaataactgaaattgtttttaagtacccgtttgccaccttattaaataacttggtaattaaaactcaataataagcctatagtaacatgcatttttttttttgtgaaggaacaacttatttagagcctagaaaccctttggaaagcttacacaagcttgatcccacctaaaatagcttatttagcaataatgtatacacaccttacataaatagtgatacaatgtatatacataaatagtgatgcctaatgactatgtgtgtggtcatgtattttttttacttgtttaattttctattcttttcctttacctactttgaaataggtagtgagcttgagatacacatgtgatatatattccccaccattcacaatacactggactgtgtggggatgagatttgaattgcaatgattgtgttccacccactcgccatcttaaccttatctattttctttcgcaaatttttccagatccgttaaaataaatctatggggaatggtgctattagctcgcttcaattgcaaaattgtacaattgaaaccccaggttaatatgcttctacgtggcttaaaagaattggctcaagtagtcaaatagtactatcgtttttgtccctttaaaacaaaagcgtaaaagttgtgggaacataatgactagggtcgcatttggttaagagccagcaggttccaactttccaagttcactaagagacctttttttttgtgttttgtttttttattttctcttttttttagggcgcttcctccgtttgtctgcgtgtgtttgtagttaaatttggccaagttcacttaccatgcacgtaaagttgaaggaaagcatggaatggtagtttgtcctaggactgggaggcataaagcaacttcttgcttacacggccaaagtcgtgagaattgatcaactcaattcaattggcaagaaattgaagaaaaccacatgttctatagtttatttatccaagctatggattcagattcgccaattgataacatgatatctgtctgattcgccccatcaagttactctaagttgggcacaaaattaataatgaatgggtaaaaaaatctcttaccacttcactgccaataactttttttttttttcagtatagagtaaagtggacgaatcaacaattaatatgatgagattgctagtatttgcttgccgctaaatgccaatatgtagaatctgaggatttaggtaggtggcgtcagtagtatacatcctcgcaacttttcaaaccaagaaaccacggtcacatgcttgttgtacggtgtagtaataaatttgcccttttgaccgcttctcttacctagagtgaacaagaaaattgtaactaacaaatacttcggaatttttttttatcgtttaatcatccatcccataaattcaaaaatatatatatatatatctaaataagaaaatactagtttttttttaacaaaagtaagaaaatactacttaatattatgttataattaatttaaaaaaatgatagataaggataaatatttttcttttctacaacaagtgagagagtacatattaattgcactacgcctccgctttctttctggagaaaatgttagaaaaggggaaaagggtagggccgaagataatttgagaaaaaaataaaggctaaattataccttcgatttattatgttttagtgttattttatttagtacatataatttaagaaatttattttaatcatttatatttttaaaagtttcatattattcaatgttaaaaatcttaagttttttaacactgtcaagacccgatgtttcaaatttatgtcggtgataaattacagtgtgactataaaatgtcatgataatattatttagtggatggaggttacaaatttaagtgttaacaagacactaatatttgttaaaagaaaaaaatttgaaacttttttgaaaaattaaaagatcaaaatataattttttaaaaatataaataatcaaaataaaccattttaaaacataaaggtttaaaataaaaactttcaaaacatacaaaatcgaaatgaaacttaaaacataaaaaactaaataaaatttttaaaatttaatgtattaaaataaaataacactaaatatgatgaaacaaaaataacatttaaccaaaaataaaaaggtaaaaagtatgacctaaataattaatttgactcatcttagtaataattaggtcattcacaactcgatttcagtttaataaaaattttacacttgggtttaacttataatctcaaattgcatgagttactagtcaaaattacttaaatcttggacagttttaaattaaacatttttcgaaaaatcaaaatatgaactagaaattaaacagaatgcagttcaagtttagttcatatccttattcagtagggaaacagggaaagatgagattcttaattaaacttaatacagttcaagtttagttcatatcatcattcagtagggaaactgggaaagatgggattcttaattattgctctctttttcctaaataataatgtgagaagagaaaggtgtgcaacacgaaagactatctgtaggtaggctgcataatatacatacgtacgtgtacgttatacatatatggttataataaattgtcggttgtacattttttatacatatattgtcggtgtgactcgtttttcagctgagagcaaattaatctacaagggctaaagtgcagtagttcctgattaaaaaagttacattacaatgaagagtctttggctgcatgcagcatgggaaccgacaactctgccgtccttcgcgttgacctcaatctgactattgtagctgtatattactattagtaagtatacgttgttcataataataaaataataaccatgattttaaattgtgatcacaattatagttatagttgtgttattgtgagtcgaaaaaaaattatattataaatatacaattaatatgacgacaattacaattatgatgagtcaaaatatatatatatatatatatattaaaattgtaaccttaacgacaaattgtaattgcgaaacgttatttaaaatcataacaataattatattaatattttgatttcattactttacaacttaatatttgaataaaataaataagttggtttattatttaggtggcttaccacaatctgaaccaaccaggtaggctcaaaggaaaggatatatatagttacaagtttgaattgaagttgaagtggttttatagtaaatgatatgatatgacactcgtacataacacatgtgcatgtaacactagttaaacaagcaatatgtagcttagaccatactcaactcaactcaaccgtcgtttttgctttggtttagtttagatggtgtatcacgtgcacatgctctcacacaccagtcaccaaagggatccttacgaacaagtgtagtatttggcaaatgcgttaagcaacatcctctgcatttgtctccaaattcctctcacttatttcagtgatgagatatagatatatatggaggcatgcaccgtgcagtggtttataaatgaagtgatctttgttgcttcacttgttagtttaatccttttttaaataatttattagtaccgaatcgatcaatctctgcatcgtacggattgagtaatgagattgacatatttgtacgtcaacccatgatccccatcacacagactctaaaaatatctcaacctccttccaactcgcaaatcgcaattctcattacccgcattcgtggacgcgatcatagcacaaattaaccttttctctttggtacgttaactttatgtttaactttggccaaacgttgcatgtgcttggggatttatatactaattaaattatgactaatactatttctacataaatttctcacagttatttttaaaataaaataaaataaaataagtaacatttttttaaaatttgaatcacatgtattctttattaaagataattttatttaagttaaataagattatagtggacgataaaaattttctctgattaatatgaaaacaataaaaaatactattcttaaattggcgcacagtgattcaaaacaccaattgagtttgaagttggtgcatgcatggtgtgcgctacttcttccatgactggcaattataggggctaattatttaaaataatacaaattaaatcaataattagcaaaatggtgcaagatggaaaatatttagcaaaatggggctgccattcacgcccaattggggcgtgtttaaacacgcccaattggggcgtgtttggcccaaatggtgacacgtggcagggaaaaatgggggtgcagggttttcgcgatttttttcgtaagttatggaaggtcataacttttgactgggacgtccgattgacgcgaaaccggtggccacgcgctcgaaatcgagaggagaaggcctgggcaagtcccaaaggggacttgcccaaaaatttttcccaaacgaggcctctaagtgcctcaaaattgcgatttaagttttggagtcccgaaaatttttttgttttctgatattttatctactcaatcagtgaactgcaagctattctttgtttatctaattactcctctcaatttcgagcgttctgacatagaatacgtcttcatcggacattgctacgagaaattacgatctagggtatcaaatttagggtttcagatttagggattactgttgacgatttagggtgtagggtggcttattctttaggattnnnnnnnnnntgggtttagggtttagggtttagggtttagggtttagggtttagggtttaggggttacggtttgggggttgatggtttagggttttggggtttagggtttaggggtttagggttttggggttttgggttttggggtttggagttggaatgggtccatgtagctgctgcgtccgcccccttcttagtcaatggggcagcaggttcggcatctactaaaaaagagagaatccacttgagtttagggagcaatcctttaatgcccgcaaactgctctctagaagtagcgaaactactgcagcaaagcacttgttacaattgtgatcagcaagggcattggtcttattactgtcattccaaatctcccttgcccacgcgcctaaaccctcgaactggaacccttactttgcccactgcgcctctaagtgcccaccgtgccaccatggcttactagtctctacgtcgagttcgggaagagatcaatttgaaaagaaaaaaaggagacagagaagggccctgatttccatgattaccagtaatgaatggtgctaaaccctaaaccctaaaccctaaacactaaaccctaaaccctaaaccctaaaccataaaccctaaaccccaaaccctaaaccccaaaaccctaaaccatcaaccccaaaccccaaaccccaaaccccaaacctcaaaaccctaaaccctaaaccctaaaccctaaaccctacaccctaaaccctaaaccccaaaaccctaaacccctatacctaaaccctaaaccctaaatcctaaacactacaccctaaaccctaaagaataagccctacaccctaaatcgtcaacactaaatttgataccctaaatcgtaatttctcgtagcaatgtccgatgaagacgtattctatgtcagaacgctcgaaattgagaggagtaattagataaacaaagaatagcttgcagttcactgattgagtagataaaatatcagaaaacaaaaaaattttcgggactccaaaacttaaatcgcaattttgaggcacttagaggcctcgtttaggaaaaatttttgggcaagtcccctttgggacttgctcaggccttctcctctcgatttcgagcgcgtggccaccggtttcgcgtcaatcggacgtcccagtcaaaagttatgaccttccgtaacttacaaaaaaaatcgcgaaaaccctgcacccccatttttccctgccacgtgtcaccatttgggccaaacacgccccaattgggcgtgtttaaacacgccccaattgggcgtgaatggcagccccattttgctaaatattttccatcttgcaccattttgctaattattgatttaatttgtattattttaaataattagcccaattatagggggcacgtagtcaacctaactgattagaaaagctactgtgggatgaatgggtcattgacatggaaatgcaacacatctttttatattattttttcttttgccccagaaaatatggcccgcttttaggtgtcaaaatccagtgccattgtccgtgatttccctttcgatgcctgatagaggttcattatataaccacatataattcgtgcagatgaacccctatttaatggctattttggtggtggcaatggcaatcgttgtcaaaatttaatcataggtcatattcattcaactaagttaagaaaaaagataagaaagattgagtcaacaaaaattttaaaatctaggagatcgacagttagggataattatgttagtaaatatactagatatatatgatgtatgaattatttatagaagtttttacatatacttgattttttaatcgtttatctctttcaatttaatctttttattttattattattattattattattattattattattattacacttgtatgttagtcacgtttttatttgatttgacatatgattagctaacatgggttgatatgagtagttatgatgaatttcgtgtgaactttcacattcccgtctagaggtattaggaaggagtgtctccaatatttttaacttcagttgaaccatagagtagagtctgcttccattataatttaggatttcatcgatatatagcattggtaagcaaagttttttacacagactagtacaagaattgtttttatttatttatttaagatgtaaaatatgtgaagccctgtgtgacaattttaaaaagaaatgtaaggacatacttctagagtatatataatgctgtacgatccactttcttgaaataaactatgacaaattgtgagtatgcatgaaaaaatggacaatatgatttgattacatcaattttttggggagtgaaaattgtgaaaaaaactattcatttttgtgactcttgatatattccctctaaattcgtatataaataaaaataattttatatcaataaaaaaattagttaatattatttaattttttaattttaaataaaaataaattatttctaaaatatttttattaaaatttattatcatgaataaaaatgagtcatttttaaaatataattaaaactaaataaagtgtgttttaagaataataatattaaatatgaaaaattaattaaatttatttataaatccaatatttatgatcacttttttatttttttatatatgagtgcagggagtaatatatatcacattttagacctttgactatgtataagagaagtgatctaaaccaaaacacaatttctattcattaatgattttttttttaaataaaatggtacagttaaaaacttttggatctggtaccaacacgtatacatggtttagacattaatattgcattatgaaatacaatgaacaacgcatatttgatatttgcatcatctttattaaatgaatgctaataccatctacacaagcatctagaaatcataagtataccaactctccctattaattgcgatacatgaagcaagagacagaataattggtctcaagcaagaaggcaaaattatcaaccattgacgaaacaaaactctgctttcccccaagtgtaatttcctagagcaggtagatttcaaaaattgaatttattgggtaaagaagaattgaaaatttcaaaaaattattttattttgaaatagagaaaaaagtattattttttaaataatatgctgatcttcatcattcttttataattcattttatatgtttgagatcttttcacaaaaatcagacattaaactaaaaatcattgctaaagatgtatactaaaaatgttttttaagaaattaaagaaaattaatgtacgacaggtatacacaaaaacacacaagaagcaataaatagtgtgtagtagtattgtttgatacgtttttccttcatttggtttcaagaaaaaatgaaggggggaagggtgagggggagcaagcagagggtgggcgttgcgacacttagcatgtactcagtcgtcttcaaaaatcgtcttgcgtggcatgtgagactagtgacagcaccgtaaggatgtgcctgaaaatgcatccgcgtgccatatttcgacaagagccgtgcatcaatgagagggaacaacttacctgtccagaaacctcccaccaaaaaaaggggccccacttaacatctctccctttacaacttcagagattctgtccaaaattaggagaaagtaagaaagttgtgcaattttgcaataacattccccctactcttggacattacttagataagattgcagccttaacctacctttttaatagcttcactcctaataaacaagccatcacttaggcaggcctgtgtttaggaactttaggaccttagccaatttttttaagaaacttaatattacatattatataaattatttttcaaactaatttttttattttttttaccaattaaactcattttaaatgtttttttatgaatagtaagacatttgtcaaaagtattatatgttgagattgaatttattttttaacttattttttattttttgagttttgaaaaccaagttcccgctttttatttgatttttttctattactataaagtataagaataaaagaaagaagtatcacataatataaataaaaatatttttttaaatctgatatggtattaaaaaaatatgaaaaagaaatagagaaacaatgaaaatgttgaataaatgttatttttaattaaatgaattgataagtcatgcatcaatatctctggttcttaatgttgtcaaaaaaaatttatctctaacattaacaattatgttcctaattaatagtataatttcttataataagctacaaattcaattttcaattatatatatgattttggtatttagttttttcactcctaattgttaattaagacaaataactaactattggataatttttcaatcatagaacatctttgtccgttgcaatttgaacaataggaacagattcatataaaaacttacataataacaattaaaataaaattaagaagcctaaggcaatagtcttaattgcctttcactatccacggccttgcgcttagataatttatcagtcaacatattgatttctgttacaaaattctatttgtgacaaaagttattttgttaatacatcaagatcgttatttttgtatttttttttatcttgataaatttgtattgaaatgtgtattatattatttttaangtaataatgtatttggttaaacggtaattagttctaaatcacaaaacgattaaaatctatacacttttttttttcttgaatcaatcaatttacatggtattaaaccgagtatggggtatttgtggaatgagttagaagggttttatgacttttatctttttctttacctagtttgaaaatgtgatagggtcaattttttaaacttgaatttcatcgtatgttttaattaaaatttataaacttaattgagtttataaaaatatctcaaatcttctttcttctaattatattaaatttgtaaattaagatttaatcttaaatatatttttatagaataatcaaacatctctttaaactaattttactgtcaaaatacttttagaatcctcccactgaaaatccannnnnnnnnnnnnnnnnnnnnnnnnnnnnnnnnnnnnnnnnnnnnnnnnatatatatatatatatatatatatatatatatatatatatatatatatatggaataggactaagtaaattcaagttaatgacataatatagtaatgttaatattatatgtagttaaatcctagaattaaagaagtatataattaaaataaaggtatattttataatttattaaaagttgtattattaatgtataactatttttataggaatttttttttgtctcaaatcattaatgtgctgaattatggatgaactaatgaaccgatgaacctatcatgggatgtcgtggagtcttcgattttgcctctagcattttttatattaacttgtgacacaatccaataatggatgacttcatgggctgcagtactgtgatcaattatttcttctagcaaagctttttgccaattcctgaaagtgaaagctggatagatttatcaggaaactgtgtactgttaaatccacatatgatgtagtacaaaccattagtgaagtggtcgacaaatctctgttcaaaagattttgaaaaaaaaaatatatccgttaaaagtttcagcttgtgctcggagaatatttattgataaaagaaaagaggaatatttgatataaactatgatatgattgcaaatgtgctttctgcaacagtaatgaggagaccagtggccaacttttttttggcttgcagtattttgtatgcagtatggtgcttctgtttctcgtggttgaggagaaattcttagttacatttagagtaagaaatttttttttatctatttattgttcgtcatgtcagtattatgaattattattgttttttacattaatgataatttttaatttttttagataaattaataataatttttattttttctaagtagattactgacataataaacaataaatagatcagagtaaaaaaatatcttacttaatgtgcacttaagaatttttcgtgacggattacatagaaattgttcagaggtgatgatgtcctagcctggacgtgtaaaaaatttgttgaaacttatcaaaattaggtcttaaactgttgaacacgaatttagagtaagattcacagtttttcttatttatttattttagattgaaagtgaggggacattccatcagtatgaaatcattttaattaggtattaatattatatggttataaggattaatcgatattttttctttaaaaaaaaaaacttgtgacaatccatttattcgcaatcttttacttacacggttccctgttaagtagcttttttctttattcctcagttcaattgttgtttccagcagcagtgatgttaacagaagaaagcatggggacaattgacatatgtacacgtcacataaaagaaagaaaataggaaatagaggtaacctttcttcgtggcaggaaaaaacagaagagaataacgaggatgaaaaataataaaaagacaagatgcggataagatgcatatcttgtttatcacaaagagtagcagccagcatgtcagacctgaacacgcctctccactccacctttgctttcaaatgcatatttgtttttctagtactctattatttttttaaaagttttaatgtcagatttttatttatttattaaacgtcagatataatatctacactgcactgcatttttattttccccgttattatttttgttcacgtatgtgttagagattctaaagtcagaagcactaaaatccaaattttagaatacatttgaacttagggtgataaaaggagaccatttattacaatgatttcaataaattgaatatatattttattatgtacttacttttaaaatgtgggtaagcatgaatatcataagcacgaataccatactaatttgtgaaatataattagacttaaggtttaaaatctaatattagagactcaattatcttactatgatcgatacactattcttgatcgtcttaattagttaaacagtctacgattactcaaaacttagtctcaaagacctgaatatgtgttatgctcaatctgcctgcctaacttgttaaagcttaaatttctaactctaactaggcatgacaacgagacccaagctcgtgagtacccgtcaaaacccacgacaaaaattcggggacgggggcgggtttggtattgataatacccaccccgcccccgccataattaaattacaaatttacctttatatatataagaataaaatcctgaaaccctaaccctccccctcatttatcattctcgacgacgatgaaccttggccagcaactttctgaattaattccattttggaagctttgttgctgcaatggacctctactctttgttgtgttttattttaattttggaataatatatatttaaatgatattatattttgggagaaattaaatatgtaggtccataatggttttaattaaattgattgattttgtttaataatttttaaattatgatttcatattttgaatgtgggtttgttattaatttttttgttagctagtcaatttttttccgttttttttcaaaagaaaagtcacattattttttttttaattaatagtaggggtggggcgggggcggggaagggaaaacccgaccccaacgggaacgaggatgagtttggattttaaaacccaacgggaatgggggcgggtgcggtgtctaactctagcgtaggtattaatattatcaacataaaaaatttaagcaagtattattataagtgcttaaacatgtatgtgtggatcgatatacatgtaggacagcacgccatgtgttccaaattggaaagatctcatctaatgggattcggggggtacgagcaatattgcaaatagtacgatatgggattgggttggcgtagatagatcgtagtaggctgataggttgtgcgataaatatttatagatagatagatagagtagtaggagttgctataatctcatacccacacgtccggtcccattcgctcactagccgatgagattggtgatctctgttatggactcaaagattgtcctcatctcctaatacatcatttctaactttttaagaaaattatatgagatatcaagtattttatttgattgacatgttgttgtgaaaattttaaattagaaaattatgaaaatatcataagcgattctcaattttattctgatgtatgtcatccttggacctaaagtcatgagaattcctacattaggagttgtgtgttttaatgtcatcaaatgttgtccatgataaggtgattatatagttggttattggatataaaacaaatagtgaattgggatgtgagtggtctatatgagatttgtccatccttcatacacgactaatatttgtgcgttctctttatactgtaagagaattatgcatgacatgccaaatgtgtagtcaatgagatattgatctcgtttatttgatgtttgcttttagtattaagaaatagataaactggactatacaatattacatgatctatgcctcgtattgaattatgatatttaaaataaaaaaaaaagactaatttgaggtgcttaaatgggtcttgtacacatttgactcatttatactctttccaaatcaagtacttgataaacacctattctctccggtccaatacctttggttgggttcttatcctgacatttaattaataatttatttgtttagttataacaatcttatttataaaataatttaaaaatataattggaaatatgaaaaaaaatatcgcagcatagaatatttttattgataatacaaaatagacattaaattttataaaaatatttttagataatacaaaaatcaaattaattttttttaaattataaaaaaaattgcgtccaaaaaattgaaactaagaaaataataattaactttttgcttgaaatttaaccaataattgagtttgaattgatttggatgtattagatgaaaataaataagggagtaagttgatgatttgagatatgtgagtaggggtgaaaataggttaggccaggtcagactttgataggtctgagtctgactcgcatcattatcattaagcttaagcctgacttgttacatgttaaaaataagttattaaagtctgtatacaaagtctgattaaataaaaataaataattaaaaataaaaaataacataatatatatgtttttcttataagttatcaaatatgatcctataagttatagatatgtttttcttaatcatttatgagattttcaaggtgattttttaaagtgattggtcatctaccttcataataagaaaaaatattttttaaaaaataaatatattatttttaagtttatatatatatattaaataggccagtctgatagacctaacagactttttttaaagtttgagcttgacctttttatttaaacagacttctccaaaagtcttagtctgacctttataataaacaagttagatcaagtcaagctttaactagaccagaccaaaagtccctgagagacaacctgatccattttcacccttatacatgagtaaaaaaaatggatgagattgaactttgaatagaagagtaacttttagaagaatgaatgtgtaaaaaaaatatgtcacttatatttattacttatatttatatacatggtattggtgatatttaatatattagcggtaaaaaaataaatgaaaaataacgttcaaattcaaacggtaaaatacgtgctcctaaattgcaaaaatccaatttgccaacggttacacaggcagacaatttacttttcattttttaattaaaaacgtcacacatgccccactatgacataagtaggaatcggttctggtttgaaaaacacatataggatatgattctcatgcaatagaaatccaatttaagtaccgattattttctatcatatattgtgttggatatactttgcattgcagacggtcttacatacttacacaacaacatatgtcattaaaatgttaaatcacaaacgtttcataattgacataagttataataacttgtctatattaatcaaatggtatatgtctatttttattaaatgatatatgattcaaatctcaattttgcatacaaaataaattatattaaaaaattatcttgtgacaatgaatattatatattaatatcatgatgataaaaaaatatcacaaacatgttttttatttggataacagtgatatattacttgatattgctcattatttagtctttttactaaaaatatttttaaaaaatatatctattaacaaattatatagataatttttgtaataatatgtattaatcaaacaaaaaattaactcgaatgatttaattatgttaaaatttcaattactgattaaaataaaacctttcaaaattaatatagttgaatatatttcactatttattttgcacaaattttttgttaataattttaattttcatgaatattgaatgcaaaaagttaaatcaaccaaatcatcaattaaatcaaataattttattgattgactaaaattaattaattaattatcacaaaatatgttaaaattatcacatatgttgaaattttattaaacataagatttaatttgtattaacaatttagattttatataaattttaagcttttattcagtgttaacgtataattatataatttatgtattatgttaataattcgagttaagattgacgtattatgttttgagttgactctagtcttatttggaatattataaggttttannnnnnnnnnttaatctatttgttatttcattttaattagtaataaaagttagtctatttaatacttatttaggcattattcatctggactagtattttaaagagaagtggtaacaacactttttttttaaactctttttgttattgacttttttttgtataatcactgtgaatcccacatttaaaatacgaaaaagaaaattaataaatgacaactgaatctattaaaattagtgacttttaacaaatttcaatcaattatgataaggattagaaagaatgccgttactatttccctttattaaataaattcagttttaagaaaacatatcatcagtgctaaactaaaccaaaggaattattgataatatttcataagcaacttatgtgtaataggtaattaacattgatggcaattaatgttttgctacttttagttctaacgtttaccatattaactaatagaagatatgtatttttattgtgataaattaaataataaaagttaactattnnnnnnnnnnttatacttacatttagaatacttattatttattataaatcaaatatataactcatgagtaggaatcaaattatacgatataatttaacaattattataacatttgtataacttaatataaaatataaaatgtgaattgtatataaatcattgaattatatttatatatattattaatttcatttgtgtcaaattttttaaaaattgaacaataaaacaaaaataattaaatgatcaatattttattatattttaaaatattaatattacgttgattttaatttatataaatggagtaataaataattttgtattaatatgaaaatttttatataatttatataaacagaatttttaatccaactatgatttttaagataaagttaattttgttataaattttaattatataagataaggtcaattatttatcttatgccaacgtacatattagtataaaaaagttaaatacgggtattaaaaaaaaacaggtaaaagcaaaactgctttttcggacaatatttcgtaaaatagtagttattgccatttactttgctaccacccatctcttacacgcaagtacaaaatttgagcaataaagattttaaaaaaattgggatgggaatgggaccataaaaacaaaaaataaaggggtaaacaagtagaagagaggagtgagtgtaactgaaccagttgctaaatcgtagttttgacctcgaaaggagtttggtcttaaacgagtgcccaggattcggtacctgaaattgcccactccaatgccactgactgctgaaacacgttccgaagggacacgcaccaaacgacacatgtgtctctcacgcgcacgcgagaatcgcgtatgttgtttcaaacctgtggtgaagttgaattttcaaataactcaagttagtcgtttcactcccaacaaatttaaccgcttttaaaacaaactcgacaatttttactgtctctctcataaaaataagtaaaaacacaaaccgaggaagagtataaaaagagaaagagagaggaaggaggaagaactgttcaaaatcaaaatgcagactaaggagaagcatttggcagtacaaaataagagccaattttcaattttaacattcacagcatcgatcaagtaagacgcgacgaggatgcggatctgggtcaacaacgtttgaccagcataaacgatgacattagggtttaattaagtacttgtgggtcccaccttaatatttctcgtgtcccgttattattattatttttttttttacaaattctcaaagaagtatttaaaagccttcggccttgtcgttgatgatgttgtggtccgggtttggagattcattacattacattacccctcttatatataacttgttacctaggttttccttcattctttatctttcaaaagagagacacaacaaaaggaagaaagagtgattaagtagggacatgagaacaaggagaggagcgtgttaccctggagtagtctcaaggatttgttccgatgtgagggtttcgaagaaaataaacaaggatctgcacatccatatgcatatgcatgtccccgccggagactccattatttgtagccggaaaaggcagaagaaaacgccggaaaaaaccgccggcggtgattacgattttttcgagtctttgccggacgacctcgtaatctccatcttctgcaaacttagttccaccgccactaaaccttccgatttcgtcaatgttttaatcacgtgcgtctttactcaaccctcgttctcctccttcccacatttctttgaacgggtttttgattctgttttttttttttttttgaaaaacaacaggtgcaaaagattaaacagattagcacttcattcgcttgtgttatccaaagcctcgcccagaactttcactattaaagcaaacgtttggtgcgaatcggcacacaaattcctcaaacactgtgccgatgccggaaacgttgaagcttgctatactttaggcatggttagtacaaataataatactaattaattaaaaaaaaactgcgaagtgtgaagaaattgttgtttgttattgttattgatgaatgatgaatctaaatttgttgatttggtttctgtttgtgcagattcggttctactgtttgcaaaaccgagggagcggcgcgtcgtttatggcgaaggcggcgattaactctcacgcgcgggctctgtactcgctgggcgtgattcagttcaacggaagcggcggcacgaagagcgacaaggacctacgtgccggcgtggcgctgtgcgccagagcggcgtttctcggccacgtcgacgcgctgcgcgagctcggccactgcctgcaggacggttacggcgtgcggcagaacatcgccgagggacggcggttccttgtgcaggccaacgcgcgcgagctcgccgccgtgctgtccaccggcgccgccgcgcgcacctggctgagttggaatcttcagccgcagcagctccggcaggggtccgggtgtccgcttctcagcgatttcggatgcaacgtgccggcgccggaggtgcatcccgcgagccttttcatggcggagtggttcgccgctcggggcggttcgccggggccggggctgagactctgttctcaagcggggtgcgggaggcccgagacgaggaagcacgagtttcgaaggtgttctgtgtgtggcgacgtgaattattgctcacgcgcgtgccaagcacttgattggaagttccggcacaaggcggagtgcgcccccgtggagcggtggctcgacgaggacggggaagatgtcggtaacgacgagggtgacggagaggtggaggttatggtagatagttagacaatttttaccacggtaacggtaacggaagtcgctttggacggaaaaatgaatctatttttggcgaagtgaaagaaaaagaagaattacctgtgatgatttattcgccgtctcaaaaaggtagaagagagtatatggcttcttttcttttttccttgtatagttcgaaaattctcccgaaaaatacgagaggagattctttttctttttcttttttttttgcaatttcggagtttaaagttaatttagaaattcaatgctaagaggttactagttactactataatttttgttattaatttaatcgatttgaatttaattaatagttttaagttttattgctatattaaaacttattttgcacatttatctacagtcacttgtttgtatttgagatattagtggatacgtcaaaattaaatgtgatttggttgaagattgagatttggtgagctgtgatttgtctctattgatttaatgcggcgccatcgcataaggttgaaaaaggaatagtgaaaataaatctaatcagttcacagacatcaaatttagcattcatacaattttacctcccctcacatgcatgagatgattgcagagggttgattctaggtgatccaacaacttgttagtagcgtaaagaaaattataaaaaaaaaaaggtgttaatgacaaaagattcaaacgaacctatcattgcttgatggcactaattatttgaaagatactgttaaatttgtttctattttattctctgagctagacaaaccaaattgctcagaaaaggtttaagtgaggttaataataataattagttctgtggtctttgagtacaagactaataatcttcactccgacatttgcctgacttgtttacaacatgtttctaataatcgtgatccatttacagtatacttttttaataaggttttttcaaatcccttttacttcaaagttcaattgctttagtggctaaaattcagaaaactctctcgaactgtatagctcatgtataacgaatatagtccatagtttaacttagcaatataactttggaaacacttctaaattatgtttaatgaagtatattcacgtttcaatgtgaaaattctaaagcaactctggtgttgcttttacaaacacggcgggatcgtaccatttgagtctttttttcatgctttttccggacattttcttttccaagtgaagtcccctagtatatgaaagagtgaagaagtgttttcattattgtggaataagaagccttcgtaccttgagatctcaattccagggtttaatagtacatcctaataggggatgaccatacttgttcaatttatctctcatatttgttcacctcggtgaacatttcatgatattgcccaagctgccttcgatatgagtatgaggaattcctaaaaaacaattgtttgaagcctattgatattttggcctcttctaagttgtgtttgatttaggaaaggaggagataaataagagaaattttatactttttatgtgaaattcattcttttatatttattttaattcatttttttttctattttcattatctataccaaatacatccttaacgctagcttaatttatgtctagtcttacaataattttaagatatgttttttttacattaattgaaatgatttattagaaatattataattttcttagatgtttataaaattagttactttttttttactgaagtgtaaaattagttacttgactattataaatttaatctatttgttatttcattttaattagtaataaaagttagtctatttaatacttatttaggcattattcatctggactagtattttaaagagaagtggtaacaacactttttttttaaactctttttgttattgacttttttttgtataatcactgtgaatcccacatttaaaatacgaaaaagaaaattaataaatgacaactgaatctattaaaattagtgacttttaacaaatttcaatcaattatgataaggattagaaagaatgccgttactatttccctttattaaataaattcagttttaagaaaacatatcatcagtgctaaactaaaccaaaggaattattgataatatttcataagcaacttatgtgtaataggtaattaacattgatggcaattaatgttttgctacttttagttctaacgtttaccatattaactaatagaagatatgtatttttattgtgataaattaaataataaaagttaactattaaaataaataaagtagttactttttaaaaaatatataataaatatcataataagatattgaacttactttaggcggaatttttttttctaactatagaaacatcaaattcataaacgatactatgaagttgtaggagagagttattgaatatcgcctaaggagggagatcaatttttccaaaaatcaatttggatttatgccagaaagatgtaccataaaaactattttcttgatacgacaattaaaggaaagatataaggaagaaaaaaaagacttacatatagtatcaatagattttgaaaaaacatatgatagggtctcaagagaagtcttatggtggattcttgagaagaaaaatgtagcattaaagtattttaatacaatcaagaatatatatgatgagactaccatatgtgtaaaaatttgtaatggaatatcaaggtattttcctatgacagtaggtgtttaccaatgttcagctcttagtccttatctctttgccttagtgattgatgaactaacgaaatatattcaagatgaagtgttgtggtgtatgctttttgcagatgatatcatgcttattgataaaaccaaagatgatgttaatagaaaattaaaattgtggagaaacactttggagcctaaatgattcatgataagcaagagtaagagagaatatatgaagtgtgagttttcgcaggtaagagatagtgatcaagacacaatgtatttacttggtcaagaggtacccaagaaatatgtttttagatacttgggatcaattttacaaaaaggtgatgagattgatgacgatgtaaatcatataattagagtagggtggataaaatggtgaagtgcatcgggatatttgcgtgaccgcgacatttcccttaagttaaaaggaaaattctatagaacagctataataccgatagttatatggagtggaatgttgaccaacacataagcaacatgaacataaaataggggtagtagaaatgaagatgttaaggtggatgtgtggttatatgaagataaataagataaaaaattgagatattcgacgaaaggtatcaatgatactgatatgtgaaaagatgagagagcatagattgaggtagtttgagaatgttatgagacgaccactagatgctcccgtaagaataaaagtgtgttaccaagagctcgatacaaagagagatacaggtcgatcgaaatttacctaggaaaaggtagttaaataagacataatggagtgagatatagattgacgaacgatatgtcttaggatggagtggagaaaagttataagcttgatagaggattaactcattagtagttttatgttctagttgttcccttgtttttgttttcttcttcttcatttctttcttattttattttaacttatttttcatttcttttgtcttatttttacttttttctttccctctccttttctctttctttgtcttattttcgatatatcattaaattcatttaccacccgtctcaattaacttgggttaaaggtgcagttgatattgatattaattagttatattttttaatttttctaaataaaagtattagtaattaataataattttggagagtttttttcttctataaattgagtctcaagtaaaggttttactttccttatgtttaggcacaccatggctccacatatgtcgataaaatctgtagagaatcattggtacgatttgatgaatttatgaagttttataagtaggtttatacgcattaagttttatgtacacaattggaaaggtcctttatttctatttctttctatttgacccaatttattatttattacaactcacaaagcaggatattcaattttaaaagattcaatacctaacaaagttattcattaaaaatacgtaaatgacatnnnnnnnnnnnnnnnnnnnnnnnnnnnnnnnnnnnnnnnnnnnnnnnnnnnnnnnnnnncatcttctttttttttttttcatctgcaattataaatgtattaattaacataagaagtgcttaaaaataattacatctccaagattctcacaacactacataatctgacagtgcaaaatcaaaatcagtcaaacaacagaaattattacatcaaagaggagttgaatcttaatatatactcaccaaaacttatataaagaaagatacatcacttcaactctagaatcaaaccagaattcatactcaatcaccctacaaacttaaaatttgatagagaagcaattggatcagcttgccaaagttaacaagtgatacaaaaatctctttgaaaagctttcaaccatgaccatacaaaaaacatgattttgtgtcaaactttctcattgtcaaattcttttccttcaaacaccatttcatttgattgactccatagaattcagaggataacacaccatcccatcacccaccactcatttgcttttctcccaaccaaacaatgcgcatgttgcaaaaaaatgatccaataggcagtgcaaaatttaaacccataatactagactaacgtttccaaatattgtgtgaaataggacatgtaaaaaacaaatagaataaatcctttacctcctctttatagaatgcgtacaataatttttcatctaactttaattatcgctgtcttttttttttttggtgttttggtcaagaggggatcagaaaagatgaaaaagaaaagtaggagacacatttgagaattccaagttgcagtgaattggtgtgggatatgcgcatatttgcatatcatagagtagaatgattttgaaataagtaagctggctggaattttagtcctatataagaacctcaaaatatatttaaaaagggggaaaaatattcgattttgcacagattattagttttaaatggggaaacaaattaatttattgggtttgggaagatggtgagggattgataagagtgcacttattctttctgcaatgttcgttatttattaatttttggtccaggttctttatttatttcagttgcactgaaccccatacaagtgaacgggtggtccaggcccaatacagtaactagtcccatttccaaatatctattcaaattacggagaagaatatcacaaaagggatcatagagaagacgaaaaaagggtaatagtttggcatctttttcaaacaagaaatcttgagttttttcattaattttttcaataaataatctatcactatacttagagaatatggaaataaaaatacaaagaactttgagagacatgcttcttttatttccaggaaacatatttggcatttccttatggggaacattagtactaaaataagaattagggtcacattctaaagagatgggaggcttggcaaaacaaaaggaaaaaaataataatagttagaatggatgatcatatatgttgggtacaatagaattcgtgcattagaaaacaaatttgcttaatgggccagctacggagacaagcttacttgttacatgctaactaccactattttgtcgaaaatattaagaaccttccacgacaggtgggattcttatgcctttgaattgagaatgaattcccctgtttgagcatctaactgttaattttttttcctttcttgctttaataatctctgtttgcttcttgctttggtatctttgcatagcatatgcagttattgccaggtcggttgtcaccatcttatgctttctgtctaatcatttttcatgtcagaattagagggagacaattttaaatcatcttaattaaaggcaatttaactacatagcatcgatttattttttaaactcctgaatgcatattttagattaatgtttagtaaggtattatggactaactaatgttttattgatttaagtagtaagaaatttatttatttataggtaaggagaataatctaatttatttaatcagggaaatattgtagttttttatttaacacctaattagtttccctctattcgagttaaatggagttagttcattttaaaaaaatgatacttttaattatgattttatgccaaagttgatcaaatcttaaattttgattaaaaaaattaattgtcgaataacttgtttcaataacctttgatatttttttttttgttgaaattaatacaaaaactgaataattgaagacttataatatttatcaataatttgacaacttaacttccaagcttaagttatcaagtaataaaattcattaattacttttaatgaaaaattacatatgttaggacgatttctttaatttactttcattttattggtagggtatactttgcaaaatgggaataaatgaaaggagaaaaaacataaactaaaaggtctcctctttgtgattggggtcaaagaaaatgagataagaaagaggggaaatgaatgatgggatcatgcctcaccagacacgaaaaaaaataagaagacaaaaccacgtaaagagagaattatttattttatcctgagaagtaatgaattataaatatttgtatatctaatgcatggataaaaatgtctcggtgataaaatatttttttcgttcacacttttacctaattatatagagacaattcaactttttccctctttattttcttttgatttaaataattttaaattttacttttatttatttatttatttatattctcttttattgaatttcttttatgtttcttctcacgtccaaaatccaaataaagcattcaagaagaaatagctctcctcaccacattacccttatgtagtactacctacattaaaaaaattacaataacattatttatgcctgtattaaccttaaggtagtagtatttctttacctgtaaagaccttataaaacaaacgcaactatttaataaatatttattactattattaaagtgagtggacccatcctaaacnaaacgcaactatttaataagtatttattactattattaaagtgagttgatccatcctaaactattccaattccaattcccacctagcctagccactacacctaccaaaaaagaagacttgttggctattttaaaaatgaattaataaaataaaattttctgtttttataatgagttggtaggccaatcaatttaatattataaataaaaaagaaattaaatgattttaaaaataaataaaataaaataaaaatgaaaagataaataaataagaattgagaaatatgatgaaaattgtgttagaatacgagcttctagttaacgaatgaaaattaaagaaacagaaaaaattgacaggacaactgttccacctttgttctcaacttatcattactcatgaattatatgagtctataaattaatacgaggaacccaacaaataaataaaaatgagtaaatgggttagtatggcacatcaaacccactttattaagattagttttattaacattctttttgtacgagtgtgatgtaaaagataataaaaaataaaaatatatagataatataaaattgaataaatatagatagatgccaagtgttaaaaagtttgtgttagaatacttgcattcctcttatacttcaattttacccattgtttatagttgtatgaatttattgcacttttatgtgttatatatatatatatatatatatatatagatattaaattgcaaagttatattgaaaaaattctgttggagtgagtaatatttatcagggggtgaaaaataaggtgagatttaacttaaggataatagagaccgaatcttattcaccaaaaaaataatagaaaccgaatcctattattttgagtaaatgtccgttaactataatggcttgattattaaattaagcccagaccaatataagtattaaatggctgagctgcatgatgggaactaatgggcttaagaaaattgagcccagacgttattgtaatattggcaaaaaaaaataaaaacttgatccagaagtaggagtgggtttagccacgttgaaaacgcaggcatggaaagcacagtctattttcattgggtgctgatcggaacaaacaggtaatgcagcaaagcactttctcacactgaattttcgcgtttcaacaatttcaattgcactttcatcatagacttcttcgtaatattttctcggaatgttccagattcgtggcttttaccgttgttttgttgtcatgattatgtttttctttctcaatttcgtagtttaggatttcgacatgattaagtgctttattttttttttttaatgattggaagggaatagaagagcggagaagatgggtttcataatggaattcgctgagaacttggtattgaagttgatggaagatccgaaggaaagggatcggaggttcagggagcacgtttatagagtgaaggacaggtgcgagaagacgaaggagatgtggagctaccctatgcgaccctatgggttttggacattcgaacgccacaattctcagcttgcttgggatgcacagattagccaagtggccgggaggagggacccttatgatgatctcctccaacatttctttaccccacctaagtgaggtattgttgttgaaaactgtaatttccaagtatgcagctctcaaatgtcaatgcaaaactggattgtttttggttgattatatttggttttgtctctttgatgaatgacggtcaattactgtgtagaggttattttagtactttgaggctgatgttttgatttgtctgcatgctcttatgattatattgtgtttatggagtgcaactagagatactgtgttttttaaatcctttgggttgggattctggagttgtttaggatgagagttgatggtgaaactctgcagagtctgcacctgtcaggctgtcactgctatggtgtaagctgttatttactatattagaagcgtggtttttagtagctaaaacaaaataagtctgagctttattggggtgagaagggaaaaatggtgaaagttgggaaggcagggaatgaagtgagaaatagtggagtggatgggttttaccaattcttaggctgtgaacatggaaaaagaagtatctacaggcttgctaaaggtagagaaagaaagagtgaaacgcatcaagagttagaagggtaaactaaagtcttgctaactaaacaagttatcaaggaaagatggaagagtcactttcgagtttcaacaagacatcttcaagtgttcctattacatatgctttctcaggtacccttacaatcacctcagtcaagaataatttggcttggtcagccttagttgaactctggtttataggtctggatctctttgacctcatttaaaagtcagcatctgatatttgctcaaaaagtcaaagtcagtgggacatttttgatcaccagctttgtgctctgttatggtgatctatggagcctactattttgggcaatttcagaatcttaaacatgtttttaaccttcagaaacaagtcaaagagctggtgccatgatgcatgcttttgctgatgatatagtactagttggagagttgagagaagaaacaaacgggaaagttgagatgtggagcatttttgagaacacagactttgtataagtagaagttaacatagtatctgaaatgtatgatcagcaaaaagtgcaccagtttgagcttagagctaaaatgggaggccataccacacaagtcgcatgattttaagtgtctaggatccatggtacaacgtgacgggaaaatagagggagatataaaccatagaattcaaaccatttgaatttaaaggagtgcttcaagcaaaacacagtaatgtaaatagaacagtaaatgagagatgagtattatttgtagataacagaaaatacagtagatgataatcctactgcccagagccaagctctttcagagaggttacaattctctctccataacagaattctaaaattcccgatacccctctctctctgacaccttccctaaataccctcagattccatgtcacacttttggcaattctgttactctcttgccagatctttccttttctcacctttgtttttcctagcatataccctggatatcttgggcctctcccttacttctaagcccacactcccattcctatcattattagtgatagaaaagtactactgaagcttcaagggaaaattttactccacaacattaattatagtagttgttatgttgtttaggattgaatgttggagagcagacacacaagatatgcaaggaaataaacttgatgttgcagagcagacatgcaagattataattaggaatgtttgcatttgagtgggggttgaagtagcatgagcatcgattgtggaaaagatggtaattcctgccttaggtagttggggcatgtgtagagaagacttgtaaatacccaatacggagagttgattagatgaagggtagtgcaataattgaggcagagggagataaaaaaccagaaaataaattagatataaatggtttgtcattaggtatgatttacaatagagcattattgttgttcctttaattgctttctttatatgtatatttttctattatagtcttttggaagtttgacgaggtaggtttctagttataattgcagtacctgccgctgtcttctgtactcatatgtggtattctcttttctatgcagtgttgctgaacttgccacaagcattataggtgaaaaggatgaatttgtcgtaatttccccttctaatatcctgtcttgtcgcatgttgcagagattacaactggattgtactgttatttcaaaaataaaggttccatataactatgctgttacagaagaatttttcctctccagaatttacattcttgcacaactgcacttcttggcaattatctgctttatcaatgtttcatgtcattatttagtatttacattgtttgtggatgattcatttctgtcgtcttgtagcctgtagaatgccatatttagaaccttttatgtgttgaatagttcattgttagtttttcatagaatgaggataggttggcagccttaaggtttgctacggaagtaaatagtctatcattgtggtggcaatgttacactgtgtatgtttaaggggaatcccactttccaaagcaggttgaacagggaatccttctcactgtggattcacgttcaatgtgctccaacgtgaaaacaaacgcagctttagtgttggatctttccattaatgtagtgcattgaattttgacacccatcctgtaaatttttattttaaccacaagtctatatgttgaacttctatttcctccaacttccgatcctttcgttgtttcaccaagttgaccttgaaagagatccctgtccaccaaaagaggccggttcactgtggcataattgttatacatgcagaaaacaataaagaaacaacttcaaaacctgcaccattcgaaagccttgtgtctttagatttttaacaaaacaagtgcgaaaatccaataagtacgacaagagttatccataaaataatacgttctgcaaaaaaggaaattatgcagttaatattgtattttcaaacgtataattgttttaattgaaaaataaatctacctcaactatatatcatttcaataaaattagtgatgctcaaatccatcgcataaaacaatggttgttaccaggacaaaatcaacaattaaatttagtttaacagtaggaaaattcaacaaatttcaaaatcacgccaaaagctggacgatatgagcatggcaaaagtcatcatgcagatttagaatgagattttagagaattccttctcaatcattcaaaactattctttgaccaaaaatcaaatcaatacttatttgtttcgatgaccttccctcttccttttcttttttgtagaaagagccaagtctaaagtcaaggaactcttcggtttagctagcagtgctcattacgtcttgaagggcaatcatcgattccaacgagagcataggatgctcctcatgcatttgtgaatgcaaccctgtttcaactctttgaactttgtaatcaacttgtgatgaggaattggcagcctgacctaccctttagtagtaaattagttctgaagcttcaatgtttattccttatattagttataatccctatatttattctgtttaagattttatctctccaccgtacgggacatcaatccataacatgtaagaataatttgaaattttaaagattacgaacgaatttttgatataactacaatcaaaattaaattaaactataagaataaaagtatattctaaccaaataacaataattcttttatgagcctagtattatatttttagtaatactgttcttagttataaaataaatcatttaaaaaccaaaaatatattaaaaatcataataattcgtttttaaaattactattatgctagatataatttttaaaataattattataaatcaacaaaacctgaaaggattagtcaagtgaaataatacaaaatctcgtatttagcacgtagaggcttgtgtccttgggttggagaggcatccctcctaaatttttcaagtgctataaaaaaaatttttttttttggtagatggagaaaaaacaaacaacaaaaacaaaagattacactccagaaacaggctgattcacataatcagctaataacagtccctgagttacacacacaaaaaaaatcttctgctttatcaattagtatttaaatcatattcttattttcttatttattattaagtgtaagtgatttgattgtggcgtccaaggaagaaatgctcttgaaatgtcgtggaatgttaggtgggcaatcccagttccaatagtgagttagtgaccaccctcaatccgcccaagacgacaataaagataatttttatgcaagaaaaggacgaaacaacttcaacttggtgacgtccatttaacgcaaccattgacacaatcccataatgttctacgaacttggttaacttataccatccacacactccgaacccatttcttacacttccatgaacacccacattgcccacaaacttaaacaaatactagccagaagcagattttatgaagaaaatagctaccctattagtagtgctctaagaactctctgccacggaacctgcttcatcttcattcacattgccttctccctgtttaaacgcctttgctatctcatcaattggaatcagaggcaaatagccaaacacggcaaaacccttttcactcgttcccttgaccacattgttgtatttttctgaccagtgtgcagctgtgggaactgccatctctgctactgcatggaatggtggatattggttgagaccagtccacaatttcaccgaaccaaagagcacaatttgcttggactcagtggctacataatttgctgctgctcgtgcccctccagattgagcctcactcactactttctcagctttgtgtgtcacttcctgaaccaaacaagtgacttgggttgcaacctgcttaaccaaagaaggtgcatgctcatcgaatttgtgagcagcttcatccacctgccacaatcatatacccaaaaattaattgcttagcaaatagtagcaatttcccaatccgttcaaacatcaacaagggaatttcatttcaggcatgtcgatgcaagggcatacaaaatttacataaattcattctttttaattttattttgttttaagtactcatggaagacgataggaatcaaacaagacaatttaagggagagaactatacataaaaaaaagtcaaactgtgtgatagtatcaagttctggggtaaacaaaaaaaatcaactgtggatgcatgtacagataacaggttcctcagaaagggtgttattgttatttgccacggttttcaccaattcaactacgtgggggaacgaaacaaatagatcttgatctgaataaaaagataaaaaatcgtcagaaagaaaattcatccttaataattagaaacagaggacaaacaaattgcaagctttaactgatttggttgaaggggtacagcaacaaaagaagaaaaaaacaacaaatcacacaaacaaaactaataaatatagattttcatgaaagaaagagagagaaaccttgttgtcgacaaaaaggaggaggtggttggggacagccttgaatttgtggtagacgggacccagaacggtggttacagtgtcttccacggttccaacagcagatctcaaaggtcccgagttttgctttgcgaagtcgtagatattcgacacacacacaaaggctttaattgccgcaatctttacaaacccaagatgcttcagttcttcttgatcactcttgttctccatatccctctgcacacacaacattattcaaagattaattctatgagatctctgcaaacaaaacatagaaatcgagaaagaaaagagaagaattgcaaacctccaaggtggtggccattattgttttctccgccttggaacttgcacgttagctgttgttgctgcaaatataagctcagtctctcatttggagtgttcatttatagatacaaatgggaatcacatgcaactatattaacataagtaaatgccaacgagtacggactccattcttttttaatccatgtttaaggttgtttttgtaaaaaccaataaatataataattttttattttaataaaatagtcgtagagttttttatttcatttctttctctttcaactccacaataaataatgtatgtgtgaattaattaaagataaaaaaagtaagattataattgataaaggaataattcaggtgatcttgaactttacaaatgacaaataaatagaaacaactttttttttaaaaatccgacaattaaaaatgatcagaaggagtaacttaaaaaatattgattaaagaatttaaaatataattttttttactgaaagatagaaaattgtaatttttatgattttttacgcttttataaaatttatataataaatatttttttaatttcttaaccaattaatctacaataattttttattacctagaccattaacctaatcaagttacttagtactatatagcaattgttaggggtgttcacaggtacgggtcactcatgaatctgaaccaatctgaacagtttgagttgggtcatttatatatttgggtcaaaaccaaaccgaaccggtcntatagcaattgtagtgtagtattaacctcgaaatattaaaagtgaatatatatttactatcatgtctaaacaattccaaaaaaatatgatacgatagccaggtggaatcaggtctggttacttttgttctttaaatacaatcacaaaacaatgccaaaaaaatatttaatttaggatttattatcttttaaaaatacaacaaaaaacaaaaataaagaattgttttaatttacacttaatttcggtagaataagttcaaattttttttattatcataatattagtgtaaagtatcactaattttattaataattaatatatgctagagaatttaactaattcttctcaatcatattctttttatctataaaatttaaatttaatatctttcttaagaaatttaatttcagtgtaactaatactgtaacaatattagtacgttgaaatttaatcacttaagcattattgctttattgcgggatacaatatccccttttttaagtaaaaatgtaggaaaatgagattgtgcctaagtctaaaacaagaatttaaagttttcactccttttttttctgtctgnnnnnnnnnnaaaatttaaatttaatatctttcttaagatatttaatttcagtgtaactaataccgacgatatacgttcaaatttaattacttaagcattattgccttattgcggggatacaatatcccttttttttaagtaaaggaagatgagattgtgcctaagtctaaaacaagaatttaaagttttcactccttttttttctgtctgaggttgtattacttaacctatctcagctttgatatatcctaagtgtattatgattggacttgaggtgcaccaaaacaaataatgagatgccttaaataattatccaagttaaatatcccttcaccgttggattatgtagtctttaatatttttttgtatgctagcccacatgagatattgtcgaataaggccgatcagaaatgccatgaaaaaaattattagcccataccttaacccaggcgtgttatggttttgtatgattctgatttctgaatatcgccatcgtgattttggataaaattaaatgcgacacttttatttattgatatagttttagtttaataaaaactaaagttttaacgtaaatattataaatttattttaataatacgaaacattaataatatatattattatgttaaccattaattggtagatgacgtttttctatagcgattccattcgttattttagaaatattccctccttgttctcttgtactgtattctatcaacgacgacttccaaacaaaagctctacataatatttgaattctatgatttattcccttctttttttcttctttttatttttcttgtcctatgaatggccttatccttccggtgccgatcatattttgtctgtaccaatatctttcccatataatgaatgctacaaattaataaaatcttgatcctaaattgtcacatgaaaatgtaaatacgtcactggaggcttatttttatcctttttttaaataaaaaaggtatctctttttcttttcgatctatttggaaaaaacaacgtgaatgggccatgtaatttctgttctttcttatactttgaaaatatctttaacatggatctcatactgcatacattactgcacgatcaacttaacattcatttacttgtaattatctagttcttgtaactgtattatatcattctcttagcttccatgcatatgcttgtcctctctacttaggcctttacttaaattgagattttctctttaagcctgagttatagagttaggggagttatataatcttgtttttaattgagtctattactatgtatactcttgtggagagtatggagccaaggacttttctggtttattctattgtaaatccctcttatagtttttcactcactccactacaaatggacactgctcacactcttaacttttgtaataattaagcaagacaggcttagaaattatttacaataatttctgtattgtgaggctcaggtcatcattctatagagtaaccttcttgggatattttatgattggagaaacatttttctggtttggtataaaggtaattttggcaaatacaacaaaatttgaatgctagttgaaatacatacacttttggttactttggttaaacctttctcaatacacattaggtatactgaaaggtctcccacctaatgggaagctaaggctgctccaaaacttgaaatggcagaattaaaactaatataattggagagccatgttacaatagagaaccatatccaaccacttaatgcatgaatttgaaaaacttatatcttcagaaaagcaataggaaactggatttcatcttttctatctttgtccagtgtctttgcctaattcagaaagtgtatttcagcattgtctccaaattgtccattggctgggggttggagggtgaggagagtatggattttgatttggaatagagtggtttagtcaatttgggattgcgggaattcaattattttttccaatgggattggtgatccttttcatattgtggaattaaatttaatccttggcattggtttttggctaaatccaataataggagcatttctcatattgagggtattttgaatagtttctagttctattgcggtagtaatggggtactataggatccttggtgttgagaattgattttcaaccccctttttttttgataatttggaatatccttgatactccttttataaagttactagtactcctctgcttaaaacacccactgatggtttgttgaaccagtagaatagacttatacaatgtttgaaaaagaataatatttgtaatggcaggaagacttagactactaaaggtattttagtaaccttgttagctcaagaacatcaaagaatgcaatagcaatgcagactaattatttaagatagtaaacgaattaatgaattatatagtactgataaataagcggtgtactccttgcaagtaatcaaaattaaagaataaataaacatccatttcacagtttccctgacaggtcaaattaatagcaaatatgcaatttcaggtatagaaatccgaaactacctttaaaagatgaatccgtcaatcaatgtaaacaaaaaatattcatcaaattaaaagtaaatcataactaacatcttatgaaaaaagaaagacagagtttaaccttgattggacagacgacattatgttccttcaaagtatcataaacactttccaagctcaaatgctccatgaaaatgtgtacttcaagatttccaacttaatataataatatagtcaagcaagttgataccttaaataccacaagatattgaaattgcactgaccaatgtcttaatacaaatcaggaaattgcagaacaactcatcctgaggataattgaaatgaaaccccaaactctggaagtaactctgtgattggctctgcagcttggaccaaagttggttggtataattgaaggcaaactgtttctaataccatgttcatgaaaaacaactctttggcaagttggaggcgccatctaaacctcatagattctactaccattggatcaaaaacttggttggtgtgttagtataattagcagttgttaaactaataagtttgttgaattttgatgtttgtcttaattatttgactttatgaacgttagatattaatagcattattgagcaagtaaagcaattgacaattgataaagaacagaagttattgagaaattaggtaatatcttgataattgtataggtgaagtcagacagccaaaattcatctcattgaattcttgcttattgcagtatattgaattttttagctttctagctagttgcattcttcatctttttagattctcttgtttaaatcacatcccctttttcgtttatcatctaaaaactaagaattaggttaaactgatacttaaacaataatccttgtaagatcatatcttagaatcctttataattctaaattacttgttgatgtgtttagttgcccaacaagaaaacttaatagcaagtaaaattagatccgatcaaatccttagtttgttctctacaagatgccaaagtaaattttccaatcatgatgaacaagctcgatatgaccacccgtttgaataggtaaaaagcaaaaaacatacatttaaacataggtttaaatgttgagtaaagctcaacaacaacaattactcacaaatcgacttaatcttattttcaataaattataacattcaattgttttaagttttaacaaatactagtatgtgagaatgtatgatgcaacatgcaataatcaaacaggtactacttgcacaaggacttgaaaattgaaatcactgtacatacgttgatcgtggacatttcaaaggcaacaaaacaaacttaatcacaaattgcattaatgacttcccttgtgaaaagataacgtagaatctttggcaatttcgcatataaaatgatcaattaatggttcatgggcacgcctaagagaatatgttaactttaaggttatgctacgtggggacccaattcaataagacaatagatttgtggagcattaacatgattattggaagtgtgagtatgtaattacttcaacaggaataaaagggctttgccttttatactgttggagactacgcgaaacgaatattgatttggattagaaaagcctaaaactttggggacgtgacttaaatatctttaatcactttaatagtttaaagaacctggcttttatccaagacatcatattctaataatcattttgtcaatagaaaatgaattgcacaccacttaaagaacctcagacttagaaaatgcataccatatgagattcccaatattccactaacttgatattggggagacgacgaatagagaagtagaatagtacgtacttcgaaatctgttaccgtcctttcttcctaattaagttagctttgcacgtaaaaatgatcttattggattttatcatttagaacagtgttacagaaaaatatttaacacatttctttttaaagaaattttactaaaatatttgaatctttcttttataatgaactcatataaaattcacctacccataaagagtatattaaaataatattatgtgaaaatgtatgctgctagtatatatatatatatatatataggtaaatctcacttgaaaaaaattattctgccaccataaatgagacctagctaccaatttacataaggatgtatcagcaacatgtacttaactaaagtaaattaatattcattcaattcaatttattttttaaaatggttaattttcaaaattgtaaatatagcataatctgaaaagattaaatgatttattttttaaaaaacgaaagtgttttccatatctttagggattaatttaagtcatccttttttatgctttaaaaagaagtattatgcttaatatacaatgtgtttaaaaagttccgcgtgaaagataaaatcaaaacttaaagacaatacggatagatagataggagaggttaagaatgagcatgggaaaaaaataaaactttgtttttattatcaatccaattactgataaaattcaacacaagttaataaatagataactttataaatatattgacttttgaccatgccaatatataaaaaaaattattgagagaaaaaaaaatctattttgataatctctacaaagaaattttgattatctattgggagacatctttagtgcacacgtaacaaattgacccaatttaattactgagaaatgatagggagactttctctatactctcttttcaatattcttcatgtgattgagtgaaatttgttaaaaatcattaatattgatgagtctcacttatcatttaatgattctctctttatggattgtttaaaattatactattataataaacatatataagttatttgactgtaatgtgacattttggaattaattaatcggagataagaaattcaaaatgagttatttaaattgaacttgtcttaacctttaggctatatcatcctaaagtactattacatgaaagaatcttatcaacatataaatccgtagttcataatacgtaataaaaaaaaaattaagtgatagaggcctcgaaccatctattctaccatagagaaacggtagacaataactcccccgaacacaaatgatcacaaccggaaatgctctgatatgtgcatcgttttggcctggatttacgcctagagcggtttaatgaccattaattacatcagcctcaatcactgagagaatcaaataactttctgactaattaatccacaacagctcaaaaacaaaataagccaaagtggccagtgcacacttgctcctgtgacgcacaatagacaaattgcctaaaaaacaagcaaccacccgttggaattgcacgaacaaaatgaccatttattaccacaaaaatatgacaccacgcaccatgcaacggagaaatgcaatacataagtaattagaaggtgcacaccattgaggaaaacactcttttctaggatttttttttgtcatttcttgattcttaccgatttagtgttagattctttgtgggtaagtcattagtcatcaccgatattcgctagaaaatgcaggaagaactacatatatagtagacttgctacaaagatttcaacttactgggacaaggaagaacatatatagtagacttgctacaaaaattttaaaatacaattaaagaatttaatacaatgacaataaaaataatattattgttgtctttaattaaatagaacaactttttttaacttaaagtttttttagttaaataatctaaactcacttttttaattaacaatttttttaaaagggaaatttaacgtgggtaaggaaacagaggacaatttattttttaaaataattatataaaaaataaaataaaatattaagacactaaatttatgttaactttttattttaaaaattagcaaattaaatattatatattaaaaatgataatttgccctcccttattctacaaattaacctcagttcataaacatcttaacagacggtgtgatttatccgttccatacatccagtttggaagttacaatcatacagaatataaaataaataaaaggaaaggaaggggagggtaaaaatttaaaagaaaaaatgtagcagaaaaaagaaagaaaagtgcattatgttcgtcaaagtttggttattactataggcatccaaagttcaaaaacatatatatacagggtttcagaaaaatgtataacatatggggttactcaaactccaaaaaaaaaatagataaaagaaaactataaaataggttgttgtaactgatcagtagtagacagaaaaagtaacactatttacatgctaaaggtcgaaatagaaaaaaggtggattaatttttcttatttttttcgaagatacgggaggtttaaagtgtaatgcttttagaagttacgtataaatgtatcataaaaaaaatagacagctaaagatagtgataaccagtaggagttgctttaagttgagaaatgattatgataaaggcttaagctttggttagtgacttagtggtgggacatctccagcaaaaacttgaaactagatctttacggtaaaatgatttcgatggcatcccctatatatgatttgttttatatcaattcatatcatataggtgacaatagctagtgagccataatttttaacattatttaaaattaattagatttgttttataaaattgtgcatgcaggtgggttaacccattggatttgctattcagccagctgcgcgcgtctcatggtatttaacccaaagcgatattgaaatgagacgcaaacatacaagaagaaaaatgcatacattacattacaatagtttacattttacaatttaaagatacataaagccttcttaagccactctcttcttagacccacctcctgtcaactggcactggatatttattttaataatttgataccctttaaaaataaagtgaaataaaacttagagataagctccctaattgtacgataaactcatctctaaatatttcactagatatttgagtaacaaatttaacatcaagcatcagatactcgatcatcctaattgcacactaaacatggttcggttcaagggcttacgattatttttatttatttatctacgaaccactagggatcgcagaggtgtcttcatttccatggaaagcctaaggcattcggaaagatccacggtttgcgcgggaagccatatgaagtggcgaagaaggtgcgcgagccagagatgggccgtggccaagcccaaggcccggccaggacacaccctacgtccagccccgaagggtgcaagcctcaagtccgatcccatgatggagacatcttctttgaggaacctctcgggcttgaaagcccacgggtcttcccagatggacgagtcatgcgaaatggcccacatgttaaccattgctgttgtgccagctggcacgaggactttgtccacatggacatcatggaccgcaaggcgagcccatgatagtagcgggcctggtgggtgcagccggagaacttctttcactatggcctggaggtaagggagattcgcaatatccgagtctagcacgtgactgttttggccgacgcacgtgtcgatttcttcgcgggctttcttttgtaagtcttggtgtaaaaccatccttgccataacccattcaaggagtattgcaactgtgtctgttcctcgaaataccatttcctgctcaaaacaacaagatcatatatatccacatatataagcacatccacccattaggcctacatgaacaataagctaatgaatttatgtcactcccaatctgaatcttataaagaaagaatgagatatgcaaccactgggttacttgttaaaatatgttgacatcatacccctacatcaaaggtttttatttctctaaaatacgtccaatattaaaataagggcttgtagatgtcaaaactaattaaagtctcactgagaaaatatttatagtggcatggcgcgcactagattattattctttatcatgatgattgatgaggtactgatagtgaataatatatataagttaatgttttagaaatttcttgaatatatggtcatttcatcaacaatttaacctaggggactttctctactgtgtagctatgtgtcgtacaattaatgaatttatgcatgttaattaacaagttttaagatgataagtaaaataatatactaatccttatttgcgttttttgagggaaatataacgtatggaaaaagatgcatggttatattttatttatattattatccatgggatgagagagaggtccaccactgagtgtggggttttgagagaagaaaaatgattctaggtagatagagtacttacccacagaatagccaccagatctgaatcagccaatctttcttctttgggcaaggatagcaaagtgctaagaaaatcattcttcccaacaaaaccaccctctctttttcgctcttccacaatttgccccaccacactaccaaccttagccgccaacttgtggcaccttctcttcaccccatgaaaatccaaaaacttgaaaggaaaataatcccccaagttaaacatcgcaatcaactcgtacccttccctaaccatatcccccaactcctcactcttatcgttactgccaaaaacactctccaaaatattacaaagtgacccttcctgaaataccctccgaacctccaccacccccttctcctccatctccctccacgcgctcttcaccatgtcgtcacccacgcgctgtcggagaccctccaagccatgaatcctcctcggagagaacatgtgaaacgccgcgatcctacgtaggtgtcgccagtaggttccggaaggagcgaaaccaatggcacgctcgaacatgagagcgcgtgccgattcttttatcggacgatccgaaaacgatgaacccaacaagatttctctagcggtctcggggtggctgcttataacaacgggagtaggccccagactcagcgccattaacctctttgcgttcagggaagtggctaaagccgcaagtttttggtgagctaaagagcccatgaggggcagagtcccaagtatgggccagcccataggcccagtaagttttttattggtttgataatagtgatagtttctccatgcaaagcctccggggacaagccagtagttaagggaaattgcgaagagggttataaagaggatggttgttccaattccaaggcaaagacaaacagcgagtgttgttgaaggtaggagaaagaagaatgttgccgtgggtttcatgtttggtcaaaagaggaggaagaaaaaaaacggtgttattgttatccagagatggacgtgtgtcatgggatatagagcatgtggggatcaattggaatatataggggtggaaagtggataagttaaaagagcccatggttaaggtgaccatggttaagaaccccaggtgctatcttgttatgacgtgaagctgcactataacatttaactttatgagaatcagacccacatcttccgttcctttttttctctttttaaacatcttgattttaggaaagaaaaaataatattttaatagggaaaaattttcaccaataaatcataaataatcatataaatgaatatgacatcacactttaatctaaaatcttaaggtttaggtttatggattttttcttcacttatatgatgttcaacattcttattcctatacgatgtgagacttcatctcatatttgtactccaacaatctatccctcaagtataagtttcatctacataatagtctctccctcaattggaagtcattttcatccacgagtatttttagggtggccttagagctctcatgctatagatacttgcattgtcgcgccactcacgagatacaccgcatggacctaccgtcgggaagacttttgatgcaagaaatccccatgccaatgattcaccatcgtcatcttactcgttcgagctagtcaccaagtcgaacctgatatcggttgttagcaatatcaccttgaattctaaaggaaatgagagaaatcacacacacaaatacaaacacaagagatttaacaaggtttggcaagtgcgcctatgtcctcgggagcaaagtgatttttttaaaccattaaattcagaatatggtaaagtaactccagggtgggagagctactcctttgatgggtgttgcaatgattctatttgcgatatttctatctattattttggagatttataattcgtccattttactctacggaatttctatgaattagattcacaagaatcgagtaattaatttttctatccattattgtttggtagttcattccattttgatcatggaatttcgtggtttttgtatttttggaatatgagtgtgtgagttgttttaattgatcctattgaaagtacaaaacataaaatggatttgtcatcttgatagagatgacacttcgaggtgaaatcctacatcgtgtaggaatgagagggttaaacaccatataagtgaaggaaaacataagcgttaagattttgggggtaaagtgtagtctcgagttcacttatgtggttgctcataacttattggtgtaaatgtccttggtgtttaccccctctatttcccaacaattggtatgagagtcgatggttcgacttggtgaccggtttgaacgagtaagatggcgacgatgaatccctggcatgaggatcccttgtatcaaaagtcttcctagaggtgagtccaaaaagcgtgtctcgtgggtggagcgaaggtgcaaatatttagagcatgtctcgaggggaaggctaccttgtggatgagactcacacttgagggaagattattagagtataagtgtgaggtgaagtctcacatcgtgtaggaatgagaaggttaaataccatataagtgaaggaaagatccatagatttgaaccttaagattttgagttaagacgtgatgtcatattcaatagataattttactaaatacttatgattcaataaaataactttcaacatctaaccaactttttaactatttttatcaaacataaccataatttcatttaattaagttatattattattatgcacacttacgtaaatatattttactttatcatttaataacatattatcatatatattaagttaattattttgtattagttaacattgtgaaaattattatactgatgatgtacaaaaatcaaaatcttattattatgtgtacgaaggtctcagtaccctagtggttcttactatatgtgtgtgatttagtaagtttgaccagtaactcactaattaaatcaacgtcttagtaacctctaataatatattgacactaaatcagcaagtcgagtttaataatattaatttaataatttataccagtaaaaaaatattaatttatatttgattaatataacaaaaggattttctttccaaactcacgtattgttgaatcattataataatggtttaacaatcacaccacttatagaataaaataaagaatgagaatattcagatgcattatccttatatattaggtacattgctttaatttacacttatttcaaatgctttatagatcatctttatattgaatttttgtacctaaattattttattttcatgtacgttaataaagcattgcggcctgactcaaaccaattcgtgtttatccatctagggccttttaatggctataatgtcacacccagccccaaaatatttggccaatttcttggaggcttttatgagtggagaaattatacttcctagttaagtagtgatgaccaattctcatgggatgtacttggtaagttggtgttcgatcagttcatcattgacttttgccatattgtccattggcatgtatctagttggcaattaccatatttgagcttgatttttgtttattttctatttgttaaaactaattggtaagagtaattttcaaaaactgtttttaaattaatatttctatcttaatttaaaataaaggaaaataagttttttttttaatattgcctcattttcttcttctttttctagtctttaaaactagttttgaaaatcattttataaatgatttttggagacaaaaatcaaacacatctcatatcactttggatttcttaaacaaatatttattgaaaaattaagaaagcaattcttttatgaaaaaaaacctttaaaaattgagatgaataattattattttttggagggcgtcaccttgatgaaataaattaattttaacttaaacaataaattgaattaattattcatttttaaaagcgaattacttgctttttataaatacttatagcaaagtttatttaaagtggtatttgataaagagtttgagtttttaatattttattttccttgcatttcttctacatcttctcctattttatattttttgtgatactatttattattcattacttattttatttattataattaagattaagatgaattgatcaagcatgtacataatcagataaggtcattatagttaagaaaaaatactgacattttttaacactttttattattattacagttataataaaaggataattaactagttcgcttcggtgatatgaatactaaattctttcatgcgcagactcttgtgaggagaaagaggaataagattcatgatttattctttgatgatggaacttggcatattgatccgaatgatcttcgtcaggagactaccaggtattttcattctattttctcagaagatagttctccttctcattcttcctttgaggttcagaatatcccccaattgaatgaggatgggaatcttgatctttctgctcctgttacggttgatgaagtcagaatagctgtgatgggcataaaatcattcaaggctcctggccctgatggtttcaaccattcttttacaagcaatattggcctatcgtaattgatctctggaaacttgttagagatgccttcctttatggcactgctgacccgggcctccttgaaaccttgcttgttcttattcctaaagtggaaaatccaaaccatttgaaagaatttcgcccattagcctttgtaatgtggcctataaggtgattgtagttagactccgtcctttcttaactgagcttattgacccctttcaaggaagttttatccttcgatgaggtactatggataaccttgttctagcctaagaagtggtccatcacattcatcaatgcaagtctagttctggagtgcttgctttgaaaattgaccttgaaaaagcttatgaccgcttaagatgggatttccctccgagtatcattcgccttgtcatgtgggtgtaagtggttcaaatttagctgtattgtggaatggttcgaagcttgataacttttctccagctcgaggtctcaggcaaggggatcatctttccccttaattatttgtttgttctctgtatggagaggctagcattgaggattgatgagcttagggagaataatacctggctccctatctccctttccagagggggtcctcctttgactcacttgttctttgcaaatgatgttcacctcttctgtaaagctacggaagatgatttggggtgtgggattgagggattctggtttggctaacatatctctccttggtaattaagatgatttggcagttgattcattctcaagataaaccttcgtgcaaggttcaccgtcaagattggtgaaggatcttcttccttcttttttgatgattggctcggtataggccgaatctccaacatggtgtcgtttgtccatatatatctcagatacctagcttcgtttatgtgaggtctggtcaaatgttggattgaatctgaatgatgtttatacagtacttcctgatcaagtaaggaatcaagttctgagactgcgtattccttctattagaactggcaaggacttctttagttggattagtgactgttcttcgtgaactcttaagaaggggctagaattgctctcctatctttgtacctcgtcatgcaaatggagtagtggatacactgactcgttggggagctcaaaggattggttgggatcacagttggaagcatcccccgaatggagcccttcttgcactaaggaaggacaatagttaatttctttttccttgctttctgtcttttattccattgtacccaaaaaaaaaaaaaaattaagtcggttacatgaatgaatgacaagatttttcctaacaatttcaatcattgtccctcttagtctctctttcaaaagatcaataatttataagtaagataaattgcctatttcttgttctaaggtgttagacgatgccactataattcttgaaaataaagaaatataaaaagaatctaaaaatgcaacacattcgcccatttgctgcatgtaatgtgttacttaagtgataataattatgtctagaaattaaaattatattaaataattaagtttacatatttagacaaaacatttaacaatttgaagaatttatttaaatttttcttaattcagaaccataaaacaaagcttaacattttcaacaccatgatttatcacttattatattataagtatatctatagaccgatttataaaataaaaaaaaaaaggtgttaataggatttcgtatcaggttagtgtatgtttgatttgcaattataaatattacaacatacattctaatacaaatccaacatataaaaataaaataaaagtaaaaagaaaggttttgatccgttaataaaattactttttcctcaaacataattttataacggattctcaaacaatgctcatgctcttctgctctccatcctttacagccaaaagaaaatcaaccagaagcagcacaaagtgaatggagagaaaaggaaaaatgaagaagaaattagaaagatgtaaagaagttggaaagagctggagacagtcttggctgcacatgaacctagtcatgcatgttcgtcctggaacatgtgagtggaaagtgaaaacaaagacctgctatttatttattattattgtttaaaattcgaaccgaccaactcaaagtcacagtaaccccttcataagcaacgaatgttgatgacatgaattaatcatttgatattttacaaattactataatgcaaaagttgtgtagcatgtacatagcataggttatagcctctgccatgtttgtcgctttagaggcagaatgtgcatatacaatctattgactctgagactaagatttgctgagccccccccgacaagcttgtataaagtttccacttctccatgttaccgggcaaccatatttaatttagtcaccggtcaacaacattatgcaattctaagttatttttggaaagaaaaaaaataataatttgttttttaaaaaaattaatatttttccaaaaataaattcaattaaacacaaattaaatataaattctcatacacgagtgagaaataacattcatgttcttgttccccattttatttatattgcgtaactgtgacttagccgcacatgccacagataaggaagagcaacgtcatgccttcacttttcacaatgcttggattcagtaggaaaaaaaaaaaaagtgggaaatattcctgttttggaggggtggaggtttcacctgattagcagtttagcagtctgtttggcgaaacagcgagaaaaggaacacagtgaaaggaaataggaaagtgaaaaataaataagaaatatgatgatttttttattaaagagaaatattaaaaaaataatgtaaaattatttggtttgtataaaaagataaaatatttttttattaaatatataaaaaaataatattttactttcacgtaatgtgtagcacacaggtcattatgagtatatgatagattatacagcacacataataaattatcaacacaaacataacaatttttcatggcattggcttaatttggttgattttagtgtgcatatatataatcgattatatgcacctacaaggacgatagtcaattaaaatatgcatataatcgacttatcaaatccatcaagagctgcgcaagggtttagcaagatgagcaagtgtgagaacaaacaaggattagtttaggaaattaaacactgtatgtccatttccaacctgtttctcttctcttaagcgagggaataagaccatagtaaaaaccataactttaaacttatcacctttctatttcatttatattaaacaacaccatttttttttatcatcattacgttttctactccctccactcattttttatgtatttctatgctaatacactgtaaataaagttatgtttgaatatataatgatgaaggacaaaaaataaaatagaattaaatgaaaataaaacaatgctattattttactgcttagatgttttaaaatgaaagaaacgagtatatcccatattctaaattttacaaataatgatattggaattttatcagtttcatttcattattttatcagcaatacaaacaataaaacttgaaatcattatatttcatttttgttttttccatccaatatatatagcctaataatgaactcacttctagacttagataacctggtgcggcccattggtctgattcaaattcggtgacttgccttttgggttagtttggtgaactatagaactgctttttgtgtaatatggttgacttgtttctaattttaattttcggcctttagtcaaaataatttttttgaagttaatttattttgcctgggaaagttttgactccaatgttaaattacatgttttaaatattataattaaattatattctatttaaaatatataacattttaatattatattctgtttttttattactttttaaaggtttttttaaattccttgacttattaaattaattgataatgttatcctttttgtgaatcgacctccgatccgaatcacacacctatgctcaactatgtccacatatataatattcatgaaaatgcaatgacaagtttatctttaacaattatagattcttcttttagtgtaagctttttggattactttgctttccattttcttctctttttagtatgtgaaaggacaatcccaataatatgccttaagccacatttctcattgccatgtgttactgcaaatcttacggaatgatttttcccagcatccaataatgcaatgtgcaaacacatccactcatttcacagttggaatgagcaaaaactggacatgtgtttcaccgtggcatgtgctgtttacctcgcagctgaaccggtcacaatcatgtttgtggttttggccaactgtgtttgtttcaatttattataaatttaattttgtatcattaacataaaaaatgaattataaaaatattttatatttaaaataatgttttaaaatatatttaaataattatttttactttaatataaatactttttaaattatgaatcttatatgcatgattgattgcacttttgatcctcaagtattataagataaggatgtcaatcgaatttttaagaattgtaattttctaattaaaactttttttataataaaaaccgcacatttctcgcataattgtgatgtatacatgggaatcaattaataaaattaaaatataaggaattaaaatttcatatttaaaatacagaagagcctaattgacataattcaaatttaggtattaaaacaaacatactttcatttatattatatcactttttatttaaaatatttatatcatttaatatacatatttaatatacatttttttttcattcgtacttttattttcactcatcaaacaatttaaaaaatcaattcactttctattttttcttcttctttctttttactttcttctccaaaccaaacatactattagttggtgttatttagtaatgaaagacaaaattcttttacacatcaagattagaaattaaagtatgttttatcacatttaattaataattttcatatataaaaggattaaatatgtttttggtatcgaataatatttaaattttacatttaatctataatattttttttcttgacttctgatccctgaaaaaattatattttatctctttcatcacattgactttgttaacttaatacatcaccatttgattaaaaaaacaccagtggttgtgataaaaaaattaaaagatcaaagaaaaattcaaaaatatttcagaaatcatgtatattctctctagtacgcatgaaaactttttagatggttcaagtattctctttacctcgtgtgtcgcagatattaaaaaaaaaaaaaaaattcttttagtcgttgtattctaattttgagatggtattaaacctccttttaaggagtactattgtgcaactcaatgaatcgccttgaattagtggctaaattaaacctgaatccaattacagatcatttaagcaaaccattgatatgtgctataataagaaacatggttatctcacaacccatcaggaaaagttgttcaatggataattgtacaacccttagagaatacatctcagatggtgactagagtcaaagagggtatggagagcacaagtttcttcttgattccagagtggcataaggctttgttggtattgctactagactctcgtcacacagtacaaatccaataacttactcagacgtcaagtattgtgtgtaacttgtttgggtcttctgagccaatttaatgggtactcaacactgggattatttagtatttaccatcatatatatgtgcatgtcattccctacataagtttcaatgtcatagaaaaataaagcctgtctaagttaagttgtaagatggtgtgaaaccaacaaattttaattcttactaacatgtcaatagcatgttaaattttttaataaattcttttcaattaattttagaattttgtgattggatcgccagagactaacaccgtaatcttcttccattaaataatattggcgtgggaacctctatccatgaattctctttcactcccatgccacacactctctctttgaattttgtttttcccaaatcattatctctaaaatgactaaatcccctatgtaatggtttgcatccatatggctaattttcctagtcttgtcttgcatcaaaatggtagtatacttgctttgtcctcagacagtggaaatgaagcacttgaataaatcaagtaatcgtacgtttttattccaattctgtctcatttctttgcttgatcactttttcatgtgcatcctttatttgtatgtctaccgcattggtgaaatggtagtgggggtactactgattaactatttataagttataaccatgggcatggcatagagtacttttggtctctcctttttttgcttcttacctgtgtttaggagcatgccatgattgtctttcaattattatgtgttaaataatattgctcttatcctttttgaacaattatactttttatgtaacgagtattttagaaggaatttcatcttcgttcttgaaatcatatgtatgtcagtggaatgcaatttaaactcggcattgtgctgcttcttttttttcatttaatagagatcttgtgcgcacgtttagaagaccttttctttttggtagttctaggagacctttatttcagagtgaataatcacttattttgaaaaagttatctcacaaaattgaaataaaacaagagattatttttctcaaaataagttgaactaatagatacataagtattcacctaattgaattataaattaataatgggatagagatatcaagtttatgcttgtccatgcgataccacaagtttgtgacagatgttaacgaagtgagttccattacattgattaagatagatatgctaataaaggtttttataatgcagcagatatattaatgtgctgttgtgagagaaaagaagaaaatgagcgcagtactgtgtgaatgtgtgcgactgtgcgagatgtggaatgcaatctaatagtctattagaatcaaaaaagcaattaaagaaacagaaaccagttgaagtggttgggtagttattgcttcttttttttttaacaaagatttaacagtattagttttaaggatttaataacaaaattttagaattataaattatagagatttaaataaaattataatttaacccaagaaaattttcttaacaattaagaaaaaaatacatataaagataacaaaaaattgatttaatttaaaataatcaagaaatatttttttttagttacgtcatcttcatgttgatgcttacaaatgttgcttgattaagttaagcaacgttacttgctagacaaaatttattattgtaatatttcttatacaagtactgttccttatataagtaagtttttttctcaccaaaaaaatataagcaagttttttttctttcaaggaaagatatgtccttaaaatttgttaatgttttttttgttttaaaagagagaaattaatacatgttaagatagataaaattaagttaagtatttactttaaaaattttagtattatagtaaatttttgtgtaaattacttaaatttatatgatgtcataggattcataaaagataagtaaactcatttaagtaattatgtactgtggatgttactagtagttaaaccaattttaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaataaatttacctatgtaactaataaaaattattaccaatacttgaaaataacatttgcataactataggcaacagagtatcaaaaatcgtagatgacatattacaaaattttataaaaaaaaacattacaaaccatttatagtcaattaattatgcattatcaatgtaataaattcataatttaattaactaaaaaatgtttgatatatatgatattgcatattatcattatttaaaagatataaaagattggatttcatataaggatataaaacaaaaataaatataaatacaatatacaatattttacaattggatttggtttaatttccacaatagaaactggaaaacaaactataccaaacaaatgttttgtcatttaaaattttgagaataaactttttaacatctttaataatcataataatacatatttttaatttctatatgttgttaaatttgcttttagttttctaaaaaaaagttattggttttagtctataaatttaaaattttgaaaaatattatttattgtcatatattaataatataatactaccactatgtcacatcaaaattatcactaatatatgacacattaccactatgtgataacaatcaccatttaaaaaatatatatgaaggaagaaataaggaaaataggattgagtaaaggatatgtctgaaaactgaaaagtggagaaataaaaaagaaaatgaaagtgatattaactaaaactgtacacaacatgtctcatagtacaagacttggctctgcctttttgagtgttaggccctcataaacgtacttgtagtatgcttgctagcgagttggcttctttttcaagttcagtggctaacccaatatggttggcatcaacccttctttaggtcatgcatgcttttttaattatatatatattttttttttgccgacagtttgaatttcttttgtcatcctcgacaaaataatagcattctgttaagtcttcaacaaatgagtattgttactagtttattctattcatcttatccttacgtatccatctaatttttagctatatattctctataagcattacctatatattttgattaatacacacacatatatatatatatatacacacacatacagcattatagctgggggtggggggtttcctaggcggttttcttggtcatatattcgtcgcgagtacgtggttacaaatttgaagcaccgttatgcattatccatataatacaaatttctattgtgtcactacaagttaattattggggttctgttgtatagtttccagcaatttctaatgtatcactacaagttaattattggggttctattgtatagtttccagcaaatcatacaatttaaaatcatactaggaccacaaaggaattttagttacatttaactattcaaaatactatgggatcacagataaatcaaatctgtaaagtgttgaatactataaatagtaaattataaccgggattcttcctagatccaacttccagaatgcagtgtgatcttttgaaaaagcaaggaagattttggctgacgaaagcgtccaaaatatattcagcatatatccaatattttctatgcaattcttgttaatgttgtgattgttgttcctttgtcatagtaaaatatcttcagcaatgtttatatcaattatttgtatactaatgttgaagaagacgcgtggctatcttcgcacccattcaatctaattgctcttgtcgttttagcataggggagggctccatttttctgcaagcatgaaatccaggatctaaaatactagaattatagtatttagaatccccgttaaccaatatgcatatcattgcgtagtgaagtgatgattggatgaaattaaagcaccaaatgaatggccaattaagagttatagcaaattctcatattatttgaatatttaaatcagatactaatgaattatattgttaaaagaataattaatatttctatttttatgaaaaaataaatattaaaaaaaacatgtaaaatgagaccaaccaatgctattacacaatgtctcaaaagaaagatcatcaacacatgcaacaccaaaagaatttctacagaagacggtttattaaatataaatatgtaaaaggtgggttgtctttgaaggagagaaaatgagagctataccctgtagcagatacttccggagacccttggaagaaaacttaagtggaagaaaacttttagatactttaacatatataatcctaggtgcatatcatagattaattatagactcatacgcccatgatcgacccaatatatatttgtgaacgttaatgggaattaataattaattaaattgtatttgtttgaaatcaccttcccctctaaatggaaagtgacccataggccgcctcaagcacctcttgaagtcttgatcataccattaaaagaaagtggtgggccttgttgaccatgaccagcaatgcaaccctgagaatagttattatcatcgttcaatttcctatacatacgtgtaatctagcaaatcaaagataaattaaaggtgcattaattctactcatgattacactttccttgatatttttgtggtgtttgttttcatgttgtttgattgagaattatgtcaagaatgcgtgtaattaaaatgacatctttagtaatatttcaggaaacacttgtcctctctacagatgcaaattctattttctttatgttgctaaaatcctgtttagtgagttccttttttagggatgtaccttaagtttcaaggattagttgagagctaagattggattaaattacttatcatttaagctgagtacaataattttttttaagtaagtctctattgatactcctaatatgttattaacaatattttcggtaatattagaggtatcttctcaatttacaatttttaggtaatatttttaagttaacttttttaggtcgatcctgagtcgaatttaattctagctttttaagcgtataatattatatatatatatatatatatatataataaagaacagtgttatatgatacaataaaattatttagaaattttatgggtggaataaaatccatattttagtacttttcaatccatgaaatattcacttagaaaatagtctctagaatgtacttgatagattttggaaataaatttttgaaccatttacccatttccaaaatcaatttgagaacgtagtttttaaaaaaataattttagaaaaatattacaaaaattacaaaaaaggaggtgtctaagtaaaaagatgaaacaaatagcaattgctctatttttttgtctttgttgtttctcctaaatggtttgaactcgatccatctcattcattttttatattcaatttttggcatttgtatcctgctccttccaatatgaatcctacacctcccagaaagtgactcattataaattgacttattatactcactatgaaactaaagatactgatatcttggaagcattccaataaactactcaatatgataagtaaatcccatttaatggtaaaaaaataatgaaacaacggtatcttaaaataacttattaaataactagtgccggaaatacttttaatttcatgcatacgtgaagcaataggcttaatttaattaccttgaggagtgctggacttctgaggatgcccttttgcttatgagttctccatgttggaaaataagtctccatgattaaggggttaaagtacagagaaaattagagtgtggatagatgaaaaaagaaaaaaaaatattatttgatatctactcatatagagagtagaaaagttaaaatataaattactcttgattaatgttattgcgtttgttcgaattttctttgctttgtcatagtctagaaggattgttatacaaatgaaaaacgaaaccggttcaaacttcaaacgttcgcgtcacggcctcttctgtattcttaactcatagtcaatgatcaatttctcttaaattaaaaaaaaaaaaatcaacaagtgaaaacttgtttattaaagttccaaacaattgaaagtcatgtgacttgtttcgctgaagaacctcaagagcttctgtaactttaagttcccattattgaaaaaattagtagtgacggcatgttattggtttgagtacaccaattttacaaagcatatacatcatactcctaacatgttgttagtttgagtaatacaagacttagattttgttaaataaaatcttgagtttaaaatttatgaaagaaaaaacaattaaaagaaaaaatttcattataagtgatcaattaaattttttagcaaaaactaattattaataaaattaataaatatttcacaccaacattaatattatatatatacacgttgtacgtgacgaaaagagaagagaggatgatgctggaaaggttatttaaatgctaaaaggatgcaatacaaaaatattcaaggaagagttatataatatgtatgattgttttgactgaatttttattttccttgttctttttctcctcttttaaaagttaatttaaaataattaaattaattttcttaaataaaaaatgattgaaatgttgatgaataaaaaaaagagcaataaaattgaaaaaaaaataataaggcatgccattttgttgccgtaacataaagaaacgtgcctgtgattttacacgggtttagtcaccaacttgtactactaccattcccaagctaagcttgagaattttttccgttaaacttgagagtttctctgaaaggaagaggtgctgatagaaactaaaccataaaaagtttgctcatactacttatatatagggatcgaaatgttaaaatggtgtaattataagaactaaaacatcgagcgttagatatgttattgccacatcaccgctacgtcaatgtcatactaccacaatgttaaaagctttagagcagatttgacgacaaaaattaaaatgtaattaaaaaatgtatatgcaaagacttaaacgtgtaatttctaaatatataaatcaaaacttaaaaataatacaaatgcaggaatcaaatgaattttcgaaattcagtccatttctcctttggaaatttaccaaggtttgaaccggaccgaccgggtgggaccttggatttgaaacggatgacatcttgtgtctggatattaatggaaaaaaaaaaaaacgacaatgcatggttgctgcattatcttctttaatcccttgattcatttcctgcataaggttggtcctttgaacattgctctcattattgtttttttgggttttcttgcagcaattgctacttactggttcactttttggccttgctaccttctcccacttgactattgaagctcttggagacacagcagtggtaacaaaataacataaaaaaaggtggataatttggagatttttaaaattataggtttaaatatcattttaatccttgtaatttagtgatttttttttattttagttgttacaaaaatctgttttttacttttagtccttacaaattatatttattttatttttcatcattatgacactttagataactttttttcattattcaaagcatagttatcaatcgtggatagcaaagcagagcaaccactctcaaaattggaatagcggatagcgggatgattgttattttaatatttttatatatattaaaaagtttataatataaatatataagctgaagaaaggaaaaaagatgaaaggagtaagttgagaatttatagaaaatgggaggtgaaaaaatcaagtcccattgtggagatatgctagagcccaatgtttcaatataagtccaaaatttctcacagaccacacttgctccacattataaaaaattgtcatatttgctcccaaaatttctcacagaccaaccacttacttcaaccttttcgccccttttcacacttctctctctcacttgcatcagtgcatcagcatcacacacaaacaaacactcccaatctctctctctatccgactctaatctcgtgatgctccgttgcgcaaccaccgcctctccatcgacgtgtcggtgactcccatggcggattcagccttcgcaaaggtgtggaagaaagtgagcccagacatcgacccgccgaagacgccactagcgtacatgaagcccagaccacccactccctcagctctcccatccaagttcacagtcaacttcgtcttacctgtgactggtgagcgcgaacaacgggccgacgatgatgagaacggcggtcaaagcgaacagtgaatcgtggacgcatcactgcgatcgcgcgcgcgacgccaccatcctatcacgggcacaacagccgcagccgttaaacgcaccgctactctactccttatagtggcacatgtccgctccgctgcaatcgcgaccacgaggcccgctattaataactatggttcaaagctctaaagtattttaaggactaaaaacaaaataaacataatttgtaaaaaataaaaaaattacaaggaagaaaaataaaaataaaaacattaaattgcaaggacaaaaatgtattcaaaccaaaattataaaattaaaaggaggtacaggaagaaatatgtgggctgcaagaagtaacggcccggcaaagtttatcacaatgattttgtttggacttagacctattggacctcctcccattatcgggtcattaagtagagggatagctaatttataagtaatcttggggttaaatccaattctaagagaagcgaacaagccaataacaaaagctattatcaaaatctcttataagctattatcgaaatctcttataagtagaggtataaaacctgcaaagcattacaaactaatttatttgcctttgttctccacaatcctgccttctttctatagtttcttggctataaagtctaaacatatactgaacacaagttgtgtccacccaaaaacaccacccaaagatttgtgcacacacacacacacacaacttgtccccccaaaaacaccagtaactagttggtcaccacccacacactcactgaaccatctttcattattgttgttatgtatcccttccctttaattaaagagattaaagacatcggcaaagagttacaccatccccgatcgaaagaattgttgattcaatgcgagtatcattcgctatataggtgttgaattcgagtgtaggcttcctattttgccaaaatctatcttccattttatcgttgttctcagacatagccaccgtaccaagccataaggtgttgtcgtatgcaattattccacctttcttcaccaattttaacagcagctcgtgatactttataaaatttttcttgtcagcgtccacaaacacgtaatcaaatgtatcttcatgtttgccctgcaatttatcgcagtttatttttatttttcattctttaaatatcaattcaaagacaatagataaaggatgttgaataaaatacaaaactcactttgtttagaactactttatatatagagagagacacacgcgcatacacaaactcatttttataaatgtaggggacaaaatcaagataataaataaaacataagcttaataaaaatgtaaagaataaatgatgtaattgatatatatatatatatatatatatataaattgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttgtatttgtaatatagaaatgtctttttctaaaattagctgtatgaaatatgggcaccggatataccgctgaaacttactgtactgtataatggctgatgtttataatatgaaatagaaaaatgctaggtgaagacatttgggacgggatacactgatgtaatttcgaactaaatttgctacagcaacatctattttattctcgttaatgatgtgattgtttgtgtgtgatcatggagcggaatgctggccagcacataggcaacatgagcataaaatagaggtagcagaaatnnnnnnnnnnaaaggatgttgaataaaatacaaaactcactttgtttagaactactttatatatagagagagagacacacgcgcatacacacactcatttttataaatgtaggggacaaattcaagataataaataaaacttaagcttaataaaaatgtaaagaataaatgatgtaattgatatatataaattgtcaaagaaaaataaataaaatatgtatcataagttatttttaatttttatttaaatattttttacaaatttcctattaattactagtttacataaattaatatcatatcaaactttcattatctttcgattaatcattaaatgaaatttaaaatgagacacttaatttaaacaattaaacaaatgtaaagattggatataattttttaaaataaaagagactaaattacaaataagtcaaaatatgaaatctaaaaatgttatcaagccaaaaaaaaaaaaaacacttacatttataagatcatggagggcagatagtgcatccgcttggataaagtcaattttgtgctccactcctgccttctgaatgaagggcaatccaatcccgtaagcttctctatcgacatcaatcgctattatctgcaacattcgcaaaatccttttcacactttattcattattttatatttcatatgtacatatttgtgtaagtttagaaaacatccataagaataaatgaaagcatgataacaaatacagtatatgaaaaaattgttgattcgtgtgctagccgtggctgagattacataggaaaaaaaaaggaaaatgtttgatcgacactcaaatgttgaaaaagttaagagaaagaagtgaagatgtaatagataagatgatgtgataagagagaaagtaagagaaaataaaggttgtcaatgaagtagttacactgttgtgatatccaaaaacaaaaattactataaaaaaatgttaatgtgataccttgccatcagaaggaagagcgagagctgtagaaagaagagaataacccgtgaaaactccaatttctaatgttttctttgcgttcatgatttttagaagaatagataggaattgggcctcatccacgggtacattcatcatgctcctgccagtgccaccatacatacatacatatcactatttttttggtattaagggggccaatggcccaaaaacaagaaagacttagggtctgtttagataagattctttagaaatacttttaaaagaagaaaataagaaggaaaaaataagatgagttttttcaaaagcaaaaataaacttttcattatctaatttttagaagctcaccgatataacttcctaaaagatgagatgacatctacaaaatgagttaatggaaaactcattttaacttatggagaagttcatttcattattttcttcttactttcttcctctaaaagtgcttctagagaaacttacatccaaacaggcccttaataagacattgcacaaggtgctgaactagttgttttacacatgttaggtgtgtgtctaatagaagacttgctcccatctgtgttgcatttcactcacccaattggagggggtaccatctaaattcaatgaggctgggtggtatatgcagcatttgatttagcgatcctttcagcattcaattgcatttgaatttgattatacacaatagaattccttatgtgccaaatctcatatatatacagcagctacaaacagacttggccaagaaaaaatggtgtcatgcaagggaggatttaaagggcctttactgttttaaatcaggaggagggacatcgagggatttccaaagttgaacaagagcaacacaatttcaaaagatgtgggagagagattcacaaagtctattacatataataggacagatagtgtgatagaggtagatggggtcagatgtattctaggaggtgtaaatagtaatgaagctgtttagttaatagaataaggagttagttacagttaactaactcaggaaatgtataaatagaagtgaggataaggaagagggatcacaagagagtgctaggaggttgtgatatcccttgaaagaatcacattgtaagctgcaggagtttactccaattctaatagaaagttcattctaattcctattcgatttcctctgatccagttcctattaactggtatcagagctccaatcttggggctttgtgccgtagatgagaacgaagaagatggaggctagaattgaggcattggagcgcgctatggaggagtcacacgagaatagccatctgaaccaagtcgcgatcgagagttgattgggtttgatggagaatctgcttcagcgattggcggcgacgctggacaattcagatagggaggatacaattcgcgtgaaggagagaaaaggaagaagcaaggaaagaaacgaagaagtagcacgaaattggaggcaaatggagttgcccttgtttgcgggtgatgacccagtgggggtgggtcgcgaggatcaaaaggtatttctggttacaggaggtgagagaggaagagaaattagaagcggttttggtggctctggaaggagaagctctgtcgtggtttcaatggtgggaagaatggagcaagaaccggtcttgggagggattcaaggtggaggtggtgcagaggttccaaggagcaggaatcacaatcattttcaggctttgctagctctgaaacagggggatagtgtacaggagtacattgggtagttccaaaaacaggttggagctggaagagggttggatgagaaatttctaaaggaaattttcttgaaaggtttaaaggaggaaatagggagagaggtgatgatacatgagcccaaatccttgttggacaccatgattaaagcccgatagattgaggagaagaacagggtcttgggcaatttaccaagaagtgggaaattgaacaattattttcaaagacccaatttctttggtccaagaactaggagagtggcagccaggaggagttaaaggaggggaacaaacaggggtggtgaaagctggaggagaagggtggaataggaggaagcctatgcaaaggctgtctcctatggaggtgagtgaaaaaatgagaaaaggggaatgcttcacttgcaatgaaaaataccatccaaatcatgtatgtaaaaataagcagttaaggatcatgattatggaggaggatgaggaaggcaatgatgaggaggaatttgaaaaagaagaaactgataagaaggaagagttgtaccagctttcactatacagtattcagggatttatcaataaaaaatctcttaagttgtggggagaagtaaagggaaggaaggtggtggtgttgattgattgtggtgccactcacaattttatatcattggcattggttaaagaattgcagctagaagtgactcctacacagccctattttatggaagttggtgatggacataaggtgaggtgtaaggggatgtgtaaggatttatccatagaattacaagggttaaaattggttcaaaattgctatctttttgaactagggggagctgagttggtgttaggggtggaatggttggctggattgggggaagttaaggccaatttcgaaaagatgacaataattgtgaaggttcaggacaaagagatggagctaaaagctgaaccagagttgattaagtctgctgttagtttgaagttgattaatgggagcttggaggaagaggatcagaggtttttggtggatgttaaagaagcagaaaaagtagaaaaaagagcagcagtacctgaagaaattcagcagatattgcagcagtttgaaggggtttttactgagccaacagaattgcctcctcatagggacagagatcatgctatcacactgcagcctggtaacaaaatccctaattgtaggccttataaatatccaaactatcaaaaagatgaaattgaaagattagtggagaaatgttgaaagctggaattattagggctagcactagtccttttgccagccctgtaattttggtaaagaaaaaagataatagttggagattttgtgtggattataggctattaaacaaaattattgttcctgataggtttcctattcctattattgaagaattattagatgaaattggaggtgcacaatggttttctaagctagacctaagagctggataccatcaaattagaataaaggatgaggatgttcataagacagcttttagaacacatgaagggcattatgaatttttagttatgccttttgggttgactaatgctccctcaacatttcaagtattaatgaatgaagtgctcaggccatttttgaggcagtttgtactagttttctttgatgatattctagtttacagcaaggacacggatgaacacaaactgcaccttcaggcagtgttacagatactgcaacaacaagagttgcatgtgaatgagaagaaatgcaattgggcccaagaatcattggaatatttgggtcatttgatttcagggaagggagtgcaggcagatcctaataaattagcagctatgagcaaatggcctatacctaaggacattaagagtttgagaggattcttaggtttaacaggatattatagaagatttgtgaaggattatgggaaatgggcacaaccattgaatgctttgttgaaaaaagatgcatttaaatggactaaggaggctgagaaatcatttgagaagttgaaagaagtgatgagtgaattacctatgctaatggtccctgatttctctaaaccttttgtgctggaaactgatgcatcaggagtgggcttaggggctgtgttgttacaggagggcaggcctttggctttttggagtatggctttatcaggaaggggacagcttaaatcagtttatgaaagggaactgatggcagtggtattagctgtgaaaagatggagacattacttgttgggagggaagtttatcataaagattgatcaacaaagcttaaagtttctaaatgaccaaaaattgttgactgaggaacaatttaaatgggctgcaaagctgattggatacaatttcgagattcaatataggcctggaaaagaaaacattgtggctgatgctttgtcaagacaatttcatttttctgctatctctttggtacaagaggaggagtgggcagattgggaagaagaattaaaggcaaattagcagttgtatgagtggagaaacctgggtatgaagtgaaaggagggagattgtattacaagggcagattggtgttaccaaagaattctgctagaattcctctaattttgaaagaattgcataattctcatataggagggcattcaggattttttagaacacataaaagggtgactgatgtggttttttggcaaggaatgaagaaagctattaaggagtatgtagctgaatgtgatgtatgccaaaagaataagagtagtaccttgtctccagctggtttacttcaaccattacctattccaaccaaggtatggtctgatatatccatggattttattggtggattaccaaaggcacaaggaaaagatactattctagtaatagtagataggctgactaaatatgcacactttctggctttgtgtcatccatacacagctaaagaagtagctgagatgtttgttcaaggagttgttaggctgcatggctttcctacctctatagtttctgatagagataggctgttcatgagtttattttggaaggaactatttaagaaggctggaactgagctgaaaatgagttctgcttaccatccacaaacagatgggcagacagaggtagtaaataggtgcttggaggtctacttgagatgcatgacaggcagtaaaccaaagtagtggccagctcatttagtttgggcagagttttggttcaacactaactataatatttctgccaagatgtctccttttgaagcactttatggacagaaacctcctttattgataaaaggagctaatattccttccaagttggaggaagtcaatcaactgtgcaaggacagagatgagcttttgcaggaattgagagaaaatctgttgagatcacaagatcaaatgaggaagcatgctaacaagcatagaagggagttaagttttgagattggagattggatttttctaagaatacaaccctatagaatgaagtcattggccagaaagccaaatgaaaaattgagtcctagattctatggaccttataaagtcatccagaagataggtgcagtggcttacaaattggaacttcctgctgagagtaaaattcaccctgtttttcatgtatcattgcttaagaaatcagttaaagcaaactgttcaccacaaccattgccagcagtaatgaatgcgcagtgggaacttcaaatgaaaccagaaagggttatgcagcaaaggcaaaatgaaaaggagcagcaagaagtattgatcaaatggcaaggtctacctcaccatgagaacagctgggagttggctgaagaaatgaaggtgtttccagaattggaccttgaggacaaggtccagcttcaaggggagggtattgatagaggtagatggggtcagatgtattctaggaggtgtaaatagtaatgaagatgtttagttaatagaataaggagttagttacagtcaactaactcaggaaatgtataaatagaagtgaggataaggaagagggatcacgagagagtgctaggaggttgtgatatccctcgaaagaatcacattgtaagctgcaggagtttactccaattctaatagaaagttcattctaattcctattcgatttcctctgatccagttcctatgatagtgattgttataatgtcccttttaacaagggccaatttagcaacacaatctgtataactggtttggggatagagaaagcggtcaaatgataggctgtgttgttggttgaaaacaccatcaggggtaaggttccagatgaatttgtcatccccaagattaggtcttggaggtacagaagctataatatccaaacaatctaaaatgggaagcaagtgagaaaatttagataaattccataggccaccctcatcaacatactataataatcttggatgacacctatccacctaaattgacactcatttaatttgcaattgcccatctaccacctttcataatccactcccaagtactttgaatcgccctccaaacctttgagcaattttgtttctttttcattagtggtctgaaacctgatgtttggcgaagttccaattccaaggccttagcatgactgacattcttagaaacaaataatctggtttttgttatagaggccttctggccagaggcttaagacatcaaggcacttcatgatagtatccatatgatatattaatagaggcttcccccaaaagaaggaggccatccgcaaagctaaatcactatgtatgatgtaccgttccttgaccaaatgtgttacttagagcatctttagtggtaaatcttaaattgggatcttagactacttgttagtggatcctatagtatcacataggattaaagatctctcaagatctctctaattttttcctttaacggtagatctcattttgagatcttagggagagagaaagaaagagaaaatttattcttttttgaacaatgtgcagatctttaggaatcttgtacaagaactcattctccatgttagagatctctccacttcctttattgggagatctagtgaatatcagatcttgagttcaagatttttacttaagatctaacactaaagatgctcttacatgcttaattaaaaaaaatcaaaaagaagaaaaggaaaaaactgtaagattgatccagttaactaattagtaattataagttcataacagctttgaattaattttacacatgcaactagataaattgtacgtaactgtaacttacttaaccccgtatttctgctgtgttgtctctcggagttgcttcaattgctcgtgctctttgggatagccactcgtttcaaagatgtactaggtaaaaaacatgcagaaaaatacagttaatgtgtactttgtatattgtaaggaagcacaaagtatgttgattgaattaggaagatcacacgagccgtatacatcagaataaatggtttgcgagaagttagattttctgaatggagatgaagatatgcaaattcttttcatattgattttgggcaaacgatgaagctagactgataattgattaataaaaaaatattttacacaaaattgataaatggggcttgtggggttgctgatagtgccgatcacagaacaaacatgatggtcgaggtgtttcattttgcttgcagagaaagaattgatgattatagcaaattaagggttataatattatattacatgtatgagattgatttcaagtgtatatgcatacatgaagcaataggcttaatttaattaccttaaggagtgctggacttttgaggatgcccttctgtgctgatgagccctccatggttgaaatacagagcaaattgcagggtgtctttagatgaataatgaacttctcaatttagtggctgtagagtgtagagaagaatataaggaacttcttttttataaataagaatataaggaacttgagcgttgacctttgagatcagaagcaccattccctacgtggcagtcggccacacttcccgtcattctaaaatgaaaacaacaattacttgacacacttagttttagagatttttagcagtagatcataaattgatatcttacattattttttttttttggtagatttcgtagcaatattaagtagaattgaagatttttttctttttttttcagtgtaaatctcattttaagatttaatgagaaaaagaaagaaaaaatattttttttaaataatatgtatatttttagaaaaaaattacaaaatttatttttttttcttctttattagaaaatttagtgaagatcaaaactgaaattcaagatctctattcaagatctagtattaaagatgtttttaagtctaaagaggaagaaaaaacagaaataataaaattataaataagacagataatttgataatttaagaaaaaagatatcaaacaagtatttgtatttgtaatatagaaatgtctttttctaaaattagctgtatgaaatatgggcaccggatataccgctgaaacttactgtactgtataatggctgatgtttataatatgaaatagaaaaatgctaggtgaagacatttgggacgggatacactgatgtaatttcgaactaaatttgctacagcaacatctattttattctcgttaatgatgtgattgtttgtgtgtgatcatggagcggaatgctggccagcacataggcaacatgagcataaaatagaggtagcagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattgaaaattttagtgttatattagcaacattaattattttttaatgtaattgagctattactttttgctttattttcgatttatcattgggttcatctaccaccgaccccaattaatttgggttaaaggtgctgttgatgttgttgatgttgatgtttgtgtgtgatcatctcataaattttttgatggaatgacaagtcaatggattatcataaatatttgttacttgattgaagaatctaaaatcattttttatttattttacatagactaaaaaaatctttaaaagacaaacaaaaaataagatatttataaggaccagattgttatataagttaaaatcaaattacaaacaaccaacatcaaatggaaaatgtacaaaaaatgtaagcaaaaagtaaatgaattttaggattaaacttagttctttagcatgaatggagatgtacaaattataaagtgaactgtcgaacgacaaagtggaaattgaaatccctttctcacgtatctcaccccttcctcctgagagcaaaccttcgtttgcacaactagaaaaaaaccacctcatgagagcaaatcttcagttgcacaactagaaaaaaatcacttaatcccagtgtccggaggctccacgctatgcacaggtaaaggggaggctgttttcggattcgaacccatgatcaacagatcaccaagacacaactttaccgctgtgtcagggctcgccccttcctcctgagagcaaatcttcggttgcacaactagaaagtccatatttaatcgaaatgacccagaagaggaaatacaacaattgtctaggaagtggcaatgttcatgaacatcaagcccccaagtgagatgtcactaaatgcccaccaaattagaagccaatgccaaaacaaataacagattaaaacttattcaaaaatctgaatttcaaaatgttgagataagaagatggattaatgatattcctccctttcagggattgtcactgtaactgaagaatgtacaagatcaacacgaaagctccaaaaatcatctcctctgccaccaatctgggatttttaacctccggtttctatgaacagaaagtttgacccctggaagcttgtgcttgacctgtctccacagcatatcaacagcatcttctctttttggaggatattggaattcataatgatgggagatgttttttagttgcctccacatttcagtccatttctcctttggaaatttacgaagttgatcgatcatgtagccaggctgtaatgcctctttgaaagagaagaaaaccgagaactgggagtagtcgatctcatcctcaaatgggagttcaatttgatcactcacaatgacaggaatgcaatgactcacaatggcatcaaaaagccgacaagatgatggtgtgtctcctgctggatgcaaacagaactttgatgaacgcatccctttagatgactgttgtatcaagagcagtggataaaggaacactatagttaatgattttagcatgatacgaaaagattaaaaaaaattgactataattcctctcccctagcaaagatagtaactcatcttggttatattgcaaaaaaagtttcaaagtctttccaccctcaaaatgaagcatgtttttgattcaggatatcatatgaatgtttttgagacagagaaagtgagaaatctaaaactagtaatatttcaccaatgcaagatttatcagatttggtgggggggagctcgcaaacaattcattttgtctacagaaagcaaattgtatctcaacattcaagttctcagagtcagaatgcatggggaatacaatatgtagagaagtgcagcacatgggtagttcttattgtgtaagttatctgaaatatctttcgcttttttaaaggaatcctggcctttaatttacaatgaagaagaaaatagttgtaaaatcaatcttttaaatggttaaccacaaatattccagctacaggtaaagtaagcaaagatcaattacataactatactgcataccgcttttatgttctcttctgtagcaacacttcgctcatagtgaacatcatcataaccagccaatatctttgctagtttaacacggacaatccctttctgcaaacatcacagacgccacagaatcaattatcatggaatttaaagaaggaaaaagctcctctaaacttagattggctttaaagtgagcaagtatgggtatatccacctttggattttaccgagttaagatcacaatgcactttacttgctcactttaaagacaaaattactttagaagaaccttgtccaattaagaaacacattattcgtacaactaactctcagttagacatacatctttcctgtaagtcctccctcggaagaaaagcaatgtggagcgagactcgtatggatcttgaggctcatcatctgtaaaagagtccacaacatgcacatatggggacaccacatctttgttcaaattagacatgcccctaggatagcgaccaaaatccacaacaacctgaatcgattcattcaactgatctcgtaggaacctaaaggcattggggtgcgtcatgggaaatacatggtctctacctccagacctctgccagtacttggatttctttaataattccattaaatcaacctgacaccagaaacaagccctgtttaacattgacaacagagatttgtaaaacaatagctatgatgcacagatacaggtacaagtacaaacttacaacaccctgcatttctgaaaaaaaaaaaaaaatacaatgtaagcatggcaagaaactgtataacatacataaaatcccttacatatcaactcaagaaacaattcaaaacaaaaaagctaacaattgtcataacacatcataaataagtggagaaaacagcttttatgttccgcagcacaaatttcaaacatgacggaacactagctgttcgagatccctctcgggaggattcagacctacaattaagaataaagccaatgtgctagcccaacggaatcaagcacaatagctgacatataaggcctaacatcaagaatcttctggcactacaccaatcccagtatagtcgcaatgtaccaaatctgatgccaaagttcgtttcgcagactcaacggatttcacagggttgacccttggaggtatttctcacgcctcatcaagtaagaagcaccacaatagcctataggagaataatataaataaatcatataaataggcccattttccaactttacaatctctcattctcctcctgcagctacaattctcaaacactgacttagcgatggaatctatgcaggtacataagcagagttcaactcgtgcgatcctgagaagacttcattatgatatcccaaccttctagactggtgtgaagcgaacattagcattcatcaaattcttatgatttttcagcatctaatgccgtttaacaaacatcctgtatcgtaaatcttcacgtgatcttactaatcgcaatctaaggctaaacatgcaaagcctagctgtgaaaaataactctcatagcatagcatctgaatgattcacaaatcaattcggaaaaattgagaaacctagctaggagaaacgtagcgaagcacctgcaattggcgatctatctgcgtggcgggatccttcatggtgtgaccatgcgtgttgaagctgagcgacgagaagaacggcacgaagaacgcttgggcgagttccggatccgaaatcctaaccgcttctctgcccccgccgacgttgaggagcgaccccatcatccagtactccacgctgtgctgcttcttcagtccccagttcaccggccacgccggccattcctcgacggtgacgggcgtctccgccgagctccggcggtcaatcatgccgacgttgaatcggcgagggagatcgtacatgaaaacccgaagaggcgggtcgggtgcacagggagcaggtgcacccgcgggtaactttaggcgagggaagaaataagatcgaatgtcgagggtacctatgaaaattgagtaagaaaggacgagcaagagcacgaaaatgaacgagagaaccacttttccatacattgcaggttcttcttcttcttcttcttcttctaaatattttggggaataatagtgagcctgattgatgcttgtacgttatcttcttcttctgctgctgctgctgcagcttctgttacgagttgctttcttagctctgcgatcagttgcggtgtccatgaatcatctatatcagccaaatgtgaaggccaagaagatgcattgcttccagagtgagcttatgtcgttttcttttctaatttctaattttaatcatctaatgggatggaaaaaaaaaatactattattttttataaaaaaataaatagtttatatattaatggtgagaatagtttttatactattatataatcacaaattttattattaaaattaataatattgaaagtataaaatattttatgctagcaacacataattctttttttaactcagaaaaaaaaacaattttttatataatcactaattaataaataaatataagtctattttattcattaaaatataacctctttattttggaggtaataaatctgcaaacattgacaaaaatttacgattgaaagaagaactttgattttcttctcattcacttgtagttgatttttgtccgcatcccttataacaattaaaaaattgcatgtgcactttggtcggtttgatttgtgaatgcagtattctttttttaaaataatatatttttgaatgtagtattcacggatcaggatctggcagatttgaccttttaaaagaaatttgcatgtgcactttcgtggttttgaatgcagtgttcacgatctgatagacttgagttgacctttaaaaattagatctagtatgttttgatacactaacattttgagttaatgctgtaaaaaaaatcttaatttgaatgagtgttctattcgggtattcggtcatccgaataaccaaatacacaccctcaattacctgaaaaagacatacttaagtaagtcgtatatccctacacaaacaaggaattcgattattcggatacttgtatatctgcaacacaaaactgatgagaaacaagctcgtatgatactcggatgcctgtaaccaggtggcgatggttggaaaaacatacccgttgacgggagcatattgtcccaacctttttggtcttaaacagataagcgaacacccttttcgataatattttttttttgttttatctcatcacaactttatttattttctaatattttttttgcatatgtgagcatgaaatatcatgctagtaagatgtctaaagagatgaacataacaattgatgggaaggaggggctagcgaaagaaaagaagaagggaccataatacaagtcgggcctcatcgacccaccttatattatactattgaatgttataagagtaatgtttaaacctattatataacctcttgtattttgcttgtaatctctttatttgcttatttgaattcaattgacattagatctcttatctatgttcataacattatcaaattgaaaagtcaaattttatcacgtgacaaccgttagttgttacatcatcatcaaaagtatcatgtaaacacaactatttgacttaatggggaaagctaacaatgagactaatttattgcattttttgcaatctcaataataattttttttcatctttcaaagacctaattgttagaacttaacaaattaaagaatgaatatgaatatttaccttcaaataatgaaattattgaatgtcgaaagaatacctatggcatggaattggaattaaccgtggttaagataacaaaattgtgagacgtggttggaattggaataatgatagtgaattagggagtttaagaaagaggaaaaaggatgtttcagttacaatatttaaatagtgacgaggaaaaagaatctaataaaatttggaaatatgcatatgataagaagagagaaagagatgtgatcatgcaaaaaagagaagaggagattttgattatctatagttttttttttaaattacatagttatcctttactctacatgaagtttaatataaagaaaattggttattttgtcaaacataaaaggtgcatggtgctaatatatacttactaatttttaagtgagtttatgttttttttttgtttttgttttttgtgaacgagaagggcaaaacgcgttccaaacgatcaattaaaacccacacgggaaaacaaccgacattacatgggccaaaacatatgtagacataaaaggtaaaacaaaatcatgaactctcatatgagtgggtctatattagcaaatcccatatataatattatatagatatattaagattttttttatatatatttgatttgattcggtctttgtttgagcccaaaatgatatggaagcaactattaacactaccatattttctattgatagtttgacactaccaacttttgtgaatctcttttttacccattcaccaaattcctacacccttctcatcccctcataatttttatcgagccaccccacccctgtcctctagcactaccacacacctccatcttcgttcagatctagcattgtcgtgcacccctacctcgcccaaacccatgttcgccaccttcactgtgccactagtccaccaccaaacctatagctactacaccatctttgctctagctttgaaccacaacaccaccacaatccaacaacgtcacgcgatcgccttacctaggacctatgatccctgcacatgcaacctcaacatccaaggcttcacatgtgtgactcccctgcaccaccgctcacatccatagttgccactaaatagccttattgttcttgtctaagaggtagtaatatttgaccatacaaaattgtgttttcgttggtggagaaaaaaatataataaaaacatgatttcattatacactatacaaaaacatgattacatcatatattttttttcaccatcacttaattcaatggaaacaagattccgttgtacaagtgaacaatgaaatcatgtttccataaaaatgacattttttcaagatttatttttaatgcacacctaggtagtgccaatagcaaatccagtattgttaactgttgctctcaaatgacattttaaaggggtattttcaggtttgaatgaaattgaccgtgggctggaatagatgttgggccttattctccaccatagttccataacgctgaattacgaactagggttttaaactcattatattatataaactccgtcaatcttactctggagttgctgacaagccaattctttgtgttggtgctaaatccctagtaagccgccatggtatgcactccacctctagtcctttcacttgcttactccaatccgtgttttcatatcatgcttaatattattgtttgcacatctgtttctgcaggtcaagtactcaagggagcctgacaatccaaccaagtgtaggcttcattaataatcacttttttgcgtttgtagaatcgacacttattattctctaaacgacggcgtttatagtctctcccaatctcagcatttttttttttatcgtttttcatatgcagcttgcaaggctagaggcgccgaccttagggttcattttaaggtactgagtcccgttacattggttttctgtttaataattttctgaaagtcgaaaagtaaatttcatttgaatagcaatgccatcaatgtataatcaattgtcgacaactcacatcaatgatatatatatatatatataaatatatatatatatatatatacatttttttttttgcatacactttgtttcttgactgagtatggtttgtctgatcaatggaaacatggatttggatttatacttaacagatcctgatgataaaagcggggcctttttatcctgtttgagcatggccctagatagcttgttttgataaatcacaaagcctggtttatagagcttttcaaataatctaaccagagtggtggcttgggaaaaaagatctagaaactgaaggttttttttcctgaagctaatccaaatgaaccttgtcacccccttccccttaactgcattaactttacttgaggctgtccattttgctctagtttaacttgatttggattgtgtgggaaaaccttttctaaataaaaaatgaagtggaataaacctgatgaaaaaagcaggggcatgttgcctgtgtgagcaggcctctcataaccttcagggatataataaccattgttattgggtgaacctctgttctctgtttgtgactgaaaggttcagtaaatgatggaacccatggtttaaaaaactgatgaaaacttattttaacaaatgaatgaagttgaataaacctgatgaaaaaagcaggggcgtgttgcctttgtgagcttgcctctcgtaaccttcagggatataataaccattgttattgggtgaacctctgttcactatttatgactgaaaggttcagtaaatgatggaacacatagtgaaatctgatgaaaaccttttttaataaaagaatgaagttgaataatcctgatgaaaaaagcaggggcatgttgcctgtgtgagcaggcctctcgtaatcttcagggatatgataaccattgttattgggtgaactgctgttccctatttatgactgaaaggttcagtaaatgatggaacacatagtgaaatctgatgaaacttttttaataaaagaatgaagttgaataatcctgatgaaaaaagcaggggcatgttgcctgtgtgagcatgcctctcgtaaccttcagggatataataatcattgttattgggtgaacctctgttctctgtttgtgacagaaaggttcagtaaatgatggaacacaatgcttttgttgcatcatgaatttgattcattctgagcttgatttttttatttcttttgatgttttgtttttaaaaacagcagaaaattgatgctttacccaatggagggaggcagtagttaatatatctttcttttttgtgaatgatgtttcattgatgctagaacaatactattgagtttattttattctgagttatatcattttcctagacacgagacattaccttttacattgtacttacagaacactagggaaactgcctttgcaatcaggaagttgcccttggttaaagctaaaaggtacttggaagacgttcttgcgcacaagcaggccattccattcagacgtttctgtcgtggtgttggaaggacagcccaagcaaagaacagacactcaaatggccaaggacggtggcctgtcaagtcagcaaaattcatccttgatttgctaaaaaatgctgagagcaatgctgaagtatgtctatatatactcttttttttccttttccatatggctattttatgatttccaaactaactgaaaattgtttcttttcaggtgaaaggtttggatgttgatgcgctttacatttctcatatccaagtcaatcaagcacagaagcaaagacgccgaacataccgagcccatggaagaatcaatcgtatgtctaaaatgtcgagatttttgttttaatggcttgttatcattttcacggttttatttatggagactgtctttgcagcttatatgtcatctccgtgccacatagagttgatattatctgaaaaagaagaacctgtgaagaaggaggtatttgattcatctagttttgttgattctcccccatttttttcaatgattcattatctaattcctattctttttttggtttgtagcccgagactaagttagcaacaagcaagaaatcccaagctcttcgaagtggcgcttcgtcttagattactaataaattgtttgaggcccaattttctagattatgtcaagtggagagttttggttgttttatttttgttatggtttgatatgattttcatactatcttcaaattaatttgagttaattgaaaaacttagtacttggtatgttttccttcggatggattacttaacattagttttaaaagaaatactaaatattagaacataaatcgatggttaagtggtactgaattattttttttctgttttctttccataattctttcgaataccttctattcaaaaaaggtaaccgaggcgcgtcttgctggttgaaaactatttttaaaccccctcttaggcctgggttgggcccaggcttttgagaatttctgtaagggtttcctttggggttaaagccctacaattcttagtttaagctttttttttaacgtcatgtaattagcttgggttgttgaagcatttctaaaaaattctaagggtattccagtaaaagtgtaaagctaataaatgatatataatggttttgtaaacgtgatattgtttagtgtttttggtgggtggtgaggaggtggcatcgtaaacagccagcacttattagctagttatcatgtttggcgtttttggtcagttttaatgtttttctttggttgatgaacaagtgctgttgttgaaaataaagatttttctttggagtaattattaaatttttagttgttatttacataaaagagagaagtataagaagtatgaaatgaaataataatagtcagagatacaaaatgttataacacgagttggtttttttctttctattattcaattgtaattgattttaattgaaatggattatgtgtaagtttttttcgaaaacaaggaattataaaaatgtaatataacattaataggattttattcatcgtaattaatttttggatgatgcaagaaaatataccatgacataagtttgttaatgtgaatttttttaaagtcagcgttaatataaaatcacccacattgggattccttcatctgatcattgtggcttgtggataaaggtgaatgatgggacttttagacaaactcctttgctattttaagttcattggtgcttggattgatcatccagagttccaaccagtcgttcgtaatgcgtgacatattggagacacttagaatgaaaatattgaaagacttactgggtcccttaggacttggaaccatgggcggacttacatgtaatgggggtggttaaattctgaaagtaaattacgaatatattcctgattttaaattttttaatatagatattcttttattttttttctgcagcaaaatatattctttttttttgcagtaaaatgttataaatagatatattttagattttatctttaattgttatctttaattgatagttattatttttagctattatctttagttatctttatctttagttgatctctttaaatagagacctcttgtattactttaattgatagttattatctataactattatctttagttattatctttggttatctttatctttagttgatctctttaaatagagacctcttgtattaatgtgacacacaattcatattctacatattcctattttcaagtcaaaacgtgttctttctccctattttcaattcatattctatatattctacatattcctttaggataaaaagatatttaggttctttttttacaaagtcaagtggtagtagtactaaacgttctcgatgtgaatcttcttcatctattgatttagttcaagataaatcaaatgagtgttcaagaaaggaaaataatttgtatgttcctgatctgggtaaaaaacttcctattacgaaggaattccaaaaaataaggcctagaaggatgacattatagttatttttatggatatgtatttgaacttttgaacattgtaattatttttctagatatgtatttgaacttttgagtgccccccttgatttattttctggatccgtccctgcttggaactgtaactgttttggtggcaatttcaagaaaatgttgttggccagacttcagggtattcagaacaacttattctctaatagtagtccaggtttgattgctttgagacaaaaactctggaatgtttatatccaaatctctaaccaggaggaactgtattggtaccaactatcttgttcgaattggctgaagttgggtgatagaaatacccggtttttttcaccaatctttctttaacaagaggagcaaaactagaactgatgcccttaaatgacgatgatattgggtctatgatgataacgatatccagaatatggttattaaccattacatcgagctttttgcctctgaaagccatgatgttatgatgctataatcagtggcagatctagaaaagtaattaagggggatactagtagtgtccacacacatttagtagcttaaagtttatggttgcataatagtttgttttccttaatatttacacaaagaagcatcaatgcaacatattgattataaactttttcaaattcaaaacattctaatccaaatacacgttattatttgtgcttagcccacgtgccatatgatttgcatttatcnnnnnnnnnnnggggggggggggggggtgctttaaacgtaggtgtgcctctacaatcattccattccttccctccgattaaggaagaggatcttttgttgataaacagtgacttctttgtttaagaaactaagcatggtttatcatcctctatattttaagtctcaatgggagtatattgggcaatctatttttgagtatattctgaaagtcaaagaagaccctaaacttatagctttagtcaacaaaaccctccccaccttggtctctaaaggagctgatccttcatatatatcgcaatttagacccattgctctttgcaatgtgatatataaaattgccaaccgtgttaacattattctcccatacgtggtagggccccttcaaaccagcttcattaagggtagaaattcggttgataacttcattattctccaagagcttgttcattcttctcaagctgaatttgcagaatgttcacttcgaaatggattccttgactgcggttaaaaagatggctagatagcttggcctaaccatttaggaaatttcatctaggatatcttgaaccaaatacaagtgctaacttcttggctggtttggcccaagggaactactatcctacacttctggattccattcctattatgttgagggttatcatcgaggagaacactaggggcctgaccctccctagaatggttgcggtgtagtcattccttttctttcccttttatccaaaaaattaaaacaacaaattcatattatgataatttcattgtttttcatcaatcgagtacatctattttctaattacatttgaagttatttatactgcaaacttgaatctagattattgggtttgatggtggagtgttaagtggaaagaatgatttaatattttagtaaaagcaataactgaattaaatatttttaatctttatctgattaataatttgtttacaatttttttgttccttttcatgttatcattaatatttttaagtattgataagaaaggtatacttaagatttaagagtttactcacgcatcttattcatttaagttaactaaatcatcttctgataagacttaaaatctaaacctttagtcaaaataaagaaaaagtaaaagaatactgaacttttttttttaaccttaaatttattatttaaaaagcaaaataaaggggttgaaatagttttgtggtataaactcgaggaggttgaattgagtacctcactttgctacactctccggcgttcaatagacttcaccatcttcctcttctgtctaccccaaaggtatcgtttcaccaccctcactttctctttcttttgattctcctcccttagcattcacacacacacacacacacacacacacgtgccaaacccattcgctcgactacgctttctgggggttttatttcactgaacatcccgatgcttatacgactcgtcgtgtttctacaattgaactttatattcactttttatcgcaattttaccttttccccaaattttaaagcataacctagaccggggctttcacacaacacaggttacggctgccccagatctgatctagaaatttatgttattacagagataatttctcaagttcttgatgttgtgggaaattttagacaaatgcggctaatgtggccgaaattgtggtcacgtcgattcctaaaaccttgatgtcgcggttcttgattttgatttttagcattgtattatatgatctcaattaacgtgtagggttgctgatgctgtgtattttccccttaattgttgttgattagattaggatggattggctagggcaaaagctggcggagcaactgatgcagataatgctgcttgcatttgctgtgattgcatttgtaggtggatatgtcatggcttctttccaaatgatgattctcatatatgctgggggtgtggttttcaccaccttgctcactgtccccaattggccccttttcaatcgccaccctcttacgtggttggatccaagtgaggtggaaaagcatcccaagccactaccatctgccaatgtaactcaaaagaagaaacctgttaagaagtaggtttttttatttttatttttttacatttttggggataatatatctttgaagtacatgatactttgacagtaatttgaagttcttaacctctttccccttcagtcgatattacagtgtacaaccatatatttactctcttttannnnnnnnnnnnttttttttttttttttttttttttttttttttttttttttttacctattttcttgattttaggcttttgattatatgataggggaagagagttctgacccttgatggtttgtggttttagttttagtgtgcaattttgatgatcaggtgattacccaaaggacaaaacttaaatgcagttctgtagtgtttttggtgttgttttctaattagaatcagagttttacctcgataatctgtttaatgaaggtttccatcaaaggtcaacatagttctgaagctccaattatgattggagaacaacaccaaaagcacttatgaaattgcatttaagttttgtcctaagccaaaccaagtgatatcataagccattcaagatataacctatctatagattcatgaatcaattttttggtcgttaggcttttgatggttgatagaccttgttgatttgtttattcagctgatgctcttcaattttaaaggaatttacacagtttgttttatgctaacttgcacttttggtcttcctactttctcaatttcatgaatttcaatcttcattttttttttccatgaatttgatcctagctattgtgcaattatgatccttatgtaaacttaacatccaatatttaaaggaaataaattgttgaaattgagataattggtgcccaaaatgcaattaagtctgttttatattgttttctaaatccattacgaggattcttctctctaactgtgtctgacttttcttttctttgattgagctacaatattggtctgtcatggtttatggatttcaaagaaattggtttcatatctcaggccaaagggtttttgtagcttaggtaatatgtaagttgcaaatttggaagcttttatttttgttgtagtcttggatgttaatgtgctcttctcttgttttgctgtcacttctgagtttttttctttctttcctcttaagtcagggacaatgttgttaaaatcgtgagaaaaatcgtataatcgcgcaccatcttgcgattttgcaggtgattctcgtgctgaatcgtgttaaagatcggagggtgttccagatcacgatctttcgcgtgagaaaaaacccattttgatctgtctcaatctttaggggttggcttgtgggccgtatttattatgggttgggtttcacttcgaaacccatattttctgactcggcccagttcacaaagcagagaaaaagaaacaccttatttcagtcattctttgcaactctcttcatcccctagggttcacctttcaagcttttcgtcctctgttcttcgttggttgttttgcccaggatcttcccttgttcttcatctgaaactgatacctccagcgccctattcttcatctcaaacttgaggatttcagttttttctctaatcttcatctgaaactgagagcttgctgggttcttcatctccctcgtttctgccttttgttccccgattcttcttgcatttcgtttttcattctccagaagttttaattctaatagtacgtgttctcgtttgtcatttttacggtttgtgttttgctgccacaaatgcacatgttaatattttttttgtctacctaaaatcacaacatcttttatcaattgtgttctgattttgacttttgtggttttgtctatcattaaaaatttaaatgtattttttttatcaagtgctcattttagtgcgaaaaataaatatacctcttgaacattttgggcctttggctgaataattaaaattttagcttgatgctaattgagaaagtgcttctctttggttctttcttggaatcttgattctcataaaaaaaaatccattttttgtaatggatctaccttaactgcttaactcgtcaattcatttgaattgtcacattattcttccacctctagtcttgatctatctttttctatttcctttttattttaatgaaaatcccctatatgatgatgatgctgaaattggattattattagggtttttatcataacatatcttcgtgatttgcatcgtgtttataaattcgatgagtatttcaaatatttcacatagaagttctcacacttgccaaaataagcaaattcaaacatgttattcagttttgtctccaaaattgaattcatgttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttttactgctatttcacaatcttataaacttcaattttttttaagctagcttatagctagtaattttttttattacatttctctttaatatctttaatataacttcattttttatattagtggttaaaatctctagtacctaaaatatatttttacctaaagtatataatttatgtgaaaaactttagaaacatgtttcttttgttatttcatactttcagctatttaatagttaactttgtcgaacatttctaattaaataatttaacttatcaagtttttaattagtttatgtcaactagttttgttgaatgtaataacaatatttttcatttttaatcctacaaatataagaaattttgttttaaactcttgcaattacattcacgtaaattatagcagtttttttttttttaatccgtgtcatctctatgaggaccaaataagtgatgacaaatattataggataaaaactaaaataaaatttacaaagatgcaaaaagtcatcatttttgcagcaacgtaaaatatattgatgaagtcatttcttgaattaagtatatgtttagtaaaacaattataatcatttagcaatattaataaatatcttggcaatagctaacctaaatgtttaatacttgacacttggtgacaaaaataatttttttggatgatttaagtcatgggttctcttaaatactgtcacggtgggtttgcatggagcatcatgcactcacgcaattgacaacgttctaagaacaaacataaggcaaattaggatgatataaaggtacacgttcattttaattttcctctctcaatatatttcgttcattcattagaatgtcaagaatccttgaaagtgaccacatcaaaccttaattcaaaggatttggctgaagattagctactccggtgtgtgtgtgtatatatatattactcccttcaacagatggagaacatgtactaaatttagtgtgaagcgcaacatttgattgaaagtagtcgttttcattgtaaggatgtctttacataaaaatatatatttcattttttcttacatctttttaaattaactaaacaaagattttttttttcttcatttttttagtcaaaacaactgaaaagtattttttttctctttccttcaactttttcccatactgttcctttcctcatttttttagttatatctagattgatgagagaaaattaaataaagagacgaatattatgttctactatttaaattataaaacgaggatggaatataatatatagaatgagaactttatcaccttggaatattacggtttggttggagtcccttcttcagtccaattggaggttggcatcctcctcaatatcgttgtaaggatgagttattttgtattgaaaactatgtgatcagttttattaggagacaaaccaattgggtggctcgtcaccttgctaaagcaactcaattccatgttagccaccaaatttatgaatagattcccacttgtattgtatcatacattatcaatgaaatgacttaaatttcttttaaaaaatgagaactttattctattttagtttttccacaatatatctaaataatgaaatataatgaatttgattctattatactacaaacatagcctcatttcaaaacatggcacaaaactctccgttccagacatatctgaagcagatatgccccaagaattctagagattgagacaacaccaagaattctgcatcaacaaacgtagttgtaaatagtctgattcacgagagaatagttgatgtttattggacaccagagtgttcaacgtccggttcaccacacacatgtacatgcaacaatattatcatagtaacttcaaagttgaaccacacttttgaattatagcaaataatgatgtagcaatcaacgcatgctgcaatccaaattcaacacatcattaattggaatctcaaaatctgtggtgatctatgcatactccatcaatagaatcaactattggcctaagtttcacaaagatttcacacttcgctgactaaaagtgggaatataattctgattctttgagcgactggttttatttaatcggcgagtcgtaatagaaaaagaaccaaaatcatagattctagtgggacaacgaaacatacccagaacaggttcatttctagggaaaaaaattgtcataatctactctggttttatttaaggaaagagtaatccttgtccacttgtaattattagtatatgttcgcttacaggaaagagtcaatttttttaatttataaaaaatatcatttcaatctttaaaattatgtacacacaaaaattctttaaattattaaataaaggttattttagtctttgcatataaaatatttgcttctctaaacacatgcaccaaatgaatgtctcaatccttttctcaccaagactgaataatgaattgcactgacgacaataggcattttaacattttaaaaaatgaaaaaaaaatatttttatgacataagaaggaattgattagattaagaaaatccggtacaataaattaataactatgcccccgaagcatgcacatcacttgatttctaatcatatatatgtagaatataagtagaaaattttgactagagagataaaacttatctcaataatttttactcctcgaaattattaattaactttcagttgacagatatatcttagttaaaaaatcagggcagggatcggttatcatttgtcatcatgcaattgtgttgctttcttaattagcagtcaagatatttcattccaaggagttaattagctaaaaattccaaaaccgatccataaaaataaataactagaaaactaatgtcaactatcctgaatttttataggttctttcaatttttactttatatatgatatgatatgatattcctttcggaccaaatcgcgagaagaattggttattgcgtcacttggactttagcatttattaagccaactgtcgctcttttacagcataaatcaaggacgtttataggtttgaattaattccatgaatttagcaaatcaaccaaaacatttcagactttcagttgtgtcggtttgacttatgtgtacactttgcactaaattaaactaatgaaacttaatatcaagtatatacatagcagtgatcaagttaatgtaacattaacttttttttagttacttttattttcactattgttttttaaagatctggtacttctaatgaataacttatcctaactatttcctaaaaaaataaaactaatcctaactattggaagaaaaaaaataattctannnnnnnnnnnnnnnnnnnnnnnnnnnnnnnnnnnnnnnnnnnnnnnnnnnnnnnnnnnnnnnnnnnnnnnnnnnnnnnnctatgcttaatgtactctttttagcttaaaagttaatctaaagttaaagttaaaaataaaaaactttaaaatactgttagactcaaatacaactaaattttaattacttgatattatttaatgttataatctaaaaaatatattttaattaattaaagttctagtccaataattattttttatttttaatattaagtttcaatggagaacaccttagaaaaaacatatatatattttttaaatatgaccacaagaattaaatgacattaactagctttcttaattaatgtagttttagataaaatttaagatctggcgtctgagactaattttaagaattcagaaattataagaatttagtaaggattaaaattatgcaatatggcattatatataaattaaaatatatgataacacaaataacaatcaagctaattttttttttggtacaggtcaattttcaattattgagtgttatttggtatggaacaaatttgcacaacttttctttccactaataaaataaaaagatcacggaaattagaggaggtaaagacagaaggaaacaaaactccaatcaaaagcgttattatgtgaaaacaacgaattgatcattttcctatcaatggcattattctcattaaatttatgcaagaaaaatcgttctgtgaaaattacgaattgatcattttcctaccattagcattattcttattaattttaataaagtaaaaaaatctggctcgtacaagaccacaaatgtcaacaataagaggaaaaagtcgagaaagaagatagggcacattgcatatccaccaatggctcattacaacatgactagatcaataagtggttcttgattatcattgatggagatggaataaaaagtaatggtgcttgcttgaaaaggaaaatatttgtgctgtagatagatacaatattctattaaccaaaaataaaaaaatacaatattctgcaagataatcagtaagttattattgagacaataggctaaacaaaaaaaatttccgacttacgctagtgcatgtaaaaaaaataaaaatatttatcacttaaactaatcaatgatcatgcaccatgattttgacaagagttgttattgtatgatattattaacaaaaatcgtacacgaattattaatgtcatgacttaattataaaataatctattagtatgaaaataaaatataataaatatattttaagataaccacaaaccataattgatgtggctcaagtgactttgaatacagcaaaaattatatatgcacatttgataatatatccattaaattaaaaaaaaatgtagtttggaaatatgaaatttatttatatgcactataatatcaaacttatttacacaaacatttaataggatttatcttatcgttactttatgttaatgaataagatgtcgtgataaaataatcaaatcctattgcatgtatgtaaaagaaggttttacattaacactgcaaataaattaaattattagaatatcccttttaacattcataaaaagtttaataatctttagattattaagtgcatntatatatatatatatatatatatatatatatataaacctttttattgttatcttgttaacttttttcatcaatagaaaattcacaatagactttatgaaaagaaatataatatattgtatacttcaattttcaacaggttaaactgagttgatgagacatttttttttcaatctttaaatagatctaacatactattcaaacaaatcataattcataacctataatgagaaaaattatcttaacagaggtgcatactgtcatcatgttaagaaattccaattgcaaactcttgctgtttactttatcaacaaaacaagtcctgccgtggtgagattgtgtcagtgttatccgaatatcttgtctccaaccgttttggtacctaaataaatcctataaattccactttgcttcttacagcgccaccaacaactccaataactctatattgactacacaaactacccttctctcatttcttttttcctttcaacctcattattattcttgtaagttcctctttctttttataattcacaattcatgtttagttctcttattattccaattcctgtttttttacttgctacagatctaccaagtgctattttgaatccgatttgtttacacactcttattgtttgtctcttgctttattatatctacacatttgattcttgtttcctgtactgtatgtactctttgtcaagttaattggttgtcttaaaattgtttgtcctctcttcagaaccaaaggacaatgctaaaaacgtgtgttcgtgttttctgaaacctcagcttcgatttggattccttttttttttatttttttatttctcattgatctcagtgttctcaacagctgaggtttatttacacttgcaaatttattaagatcctgtgataaagtctcatttataaatacataagaaaataaaagctctttttattaactagtgatctcgaatttgtagtcttttaattgcagctaagagtgtcctgggtttattcaataagtggtctcaaatttgtattgaggataaacaactatgttaaggagagttttgttattcataatagtcttattatgtttggcttaaatagtattatctcctcgtgcttcgaggaggatactgttaggcataccaataaaatcaatatgaatctcttgtaatgaaaggttctttcttttggattggtggattttgatgtgttttttccttcttttttttaaaaaaaaaaaaaactcttgttagcttcatttctttataaacgcatctagtggctacttttgctccgggtttttgtgcaagaggacaattgataccttgtaggtttcaattgagtggttttaatatgacttcatctatgtctggatttaattcaataggggcaaaggtttatttatttatttaaaacatttctcacttagttcttttctgtagtttcttacttgctttgttttagatcacaatcttttgtggaatttctggaaaaactggaaggtggagttttgttagatggtagttccttgctatatttttagattatagtgcttacaaacatttagtatgctttcatgtccaagtgatatctgtaaaaggaatagtgatttgtttttgttaacccagcagattgaacatttttcaattgaagtctcgttccccaattgaataatcaatttttctaaatactgtgctacttttttccctctccagtttgattcattcagctgatatggagttaaagaaaatgaaagttacaggtggctaaggcttggcaagttctatggcctactctggtatgactttacattttttgctaatgaatattttggtaaatttttatttttaattttaataacttttttccttaatttatagatacttgggcaatgtgcgagggaaaatacaactctggaagcttaagatataatttgcggaaaggcagtaggagggattattgtaggagcataacttctgttatggaatttgaatcagattggataaagcacagaaagtcatcttcttataccgctcatgttattcgttctgcgacatctgttataccttggtcttgtagaaacccaattggtgaagggtatcatgaatttctttaattagttgtactcactactctgtaagacattttcacattgtttggttgattggtcgtgacttgccaacgaaatttctgtacatcttcgttgcacatcatatatgtgattgcgaatttgaaaaatacctggttttgtggctgaaaagaagagattcacagagccaaatatgtgttttaccaatttggccaaccatgataaaccaactcttacaaaaaacactcattgcttgaggtccgagtttctggatgatgatgatggtagtagccccatcctacctgggctgcctgatgatgtttcaaagcaatgccttgcactcgtgcctcgttcgaacttcccggccatgggtggtgtctgtaagagatggaggtgctttattcgaagcaaagaatttataaccgtgcggaagttggctgggatgcatgaggaatggctctatatcttgacagcaggtagtgaaggaaaagggagccattgggaggtcatggattgcctcggtcataatcgtcgatctcttccaccaatgcctggtccggcaaaggctggctttgggctagtggttcttaatggaaagctccttgttatggctggttattcatcaattgatggaactgcatctgtctcagcagaggtttaccaatatgattcttgccttaacaggtatgcttttcggctgtaaatttacctggatgccttaggaacttattacacttgatatgataattcctgctatataatggagttaatggaggatcatttttttcctgtatatttttgtatgggaaaaaatgatcctgctgccggttctcttgtttattatactttatccatttctgggatgtgttgattttagaaattaggactgaggtgcctgtatgtctatgcttagaagtctttctggtaaaaggttttaacttttctgacatgtgtttttttctccatctgtttcactcaaaacagtagaaagtgggaaataaagactataaagcttggatggaatggcttgacacaaattgactcttttattgtatgattttaatttcccagttatgtaaatgttaaaatggttttcaagaataaaaaaatcattgtcaacgttgttacatgaattctaaaacatgaagtatgcttgatcatacatcagcctcacttttatggtgtgctttacacctgtatttatttgcttacgctccttcttgtataaatcactgtgtaattgataaagttgcatcactttctctatgatgaccttttattattgatctagctatatattctgagttaccatgacatgtcacctttattgcaaggaaccatcttagcacagtgctattattaaactttgtaattgcaattgcagctggagcagattgtcaagcatgaatgtggctcggtatgactttgcttgtgctgaagttaatggcttggtttatgcagttggaggctgcagcacaactggtgacagcctctccagtgcagagatgtatgatccggataccgacaagtggacgccgatagagagccttcgcccgagatggggttgctttgcctgtggatttgaggggaagctctatgtcatgggtggaaggtcaagcttcacaattggaaactccaagtttgttgatgtctacaaccctgagaagcacgggtggtgtgagatgaaaaatgggtgtgtgatggtcactgctcatgcagtgctagaaaagaagttgttctgtatggagtggaagaaccagcggaagttagcaatattcaatccagaggacaattcatggaaaatggtaccggtccctttgacagggagttcaagcataggttttcggttcgggctattagatggtaagttgttgctgttctcactggaggaagagcattcttataagactttgttgtatgatccaaatgcagcaccaggatctgagtggcagacttctgatataaggccatctggtttgtgcttatgcagtgtaactattaaggcctgaaaagttggctgcttccgaatttagaaaccttgagagagctaaggattttgttgttttactaggattttgaatagtagttagtaattttgaacgtgactcgatgttaatttagtgtttttgcttgttcttgttagttttatcatgtcatgtcatgtctctgatttatggttggattatttctacaattattcatgtaaccatcgattttgaccaagcactacaaattatggtgggcgagtttctttttctttttcatcttccttattttgtgttctcttggtaatattagaaagtgctaattggtaaggttggtaggataactttgacaaataaatgtgtccattttaagtaggtggtcagagttcaattttctgactcgtatttatggaaaaagtatttgatggaaaaagttattattttttatttaacttccattcctttgcaaggaaaaaaaacaatcatgtaatatattttttttaatcaaaacgcactcacaaagtttgaaaattgtatattattcaagacttaaatgtgtatctaatctatgttagtttattttaaaaaataattatttattaattttatgaaagatttttgaaaaaaataatgggtagatgatttataatccctttgtaaatccttgttcttgaataaggagagcttaccctcattcaaaacttttatgttccaaaaaacacttatataattgatatttgtagaaaatggatgttcatctggcccgtatctatagttttttttcttctaataaataatattgacaaatctgtgtacatcatgagtattgatactgagcacttgatttaatagatgaaagttgcttgcttgatataccttggtaagaattgcacatgatttatattaagggaaatgacagagttttgaaatgtagaagaaaaatggtaatgaacagtatgaatctttcacaaaagaaaatgatcatgggaaagttataacttataatggaggactgagcagatctgtcgatatgcttttgtgatatttaagataatataaggcgggctaggtgctgttacgaaaattacttttcctaatgaagtaactttggatgatagtcacttacactgatatttaatattttgttgatctgctgtatccagtagtaaaaaatatttgattagaagaaaaaaaaaatgatatagaaaattcttgaaatgcgataaacaatgaaatccttgaggaggtgcaaattttgaattcagcaactcttaattcttgacataatgtaatccatgaggaggtgaacattatgattgcagaacactttctcctagtactaccggtaccagaaatacgagaacattctcttacactcttacttacaatgaggtcatttagtgagcaacaagaaatagcttagcagcccgagaagtattgaagtgttacactaccttgattcttgctgctctcttgagcatgtattagaatttgttgctgaaagagtagaagacttcttgggatgtattaaaaaaaatggacgtaatgaatatgaatatattttatttatattctctttcaacgatgtagtattatttaattttttgttaaaacataattatataactcaaaacaaaaaaagagagaagaaagtaataaaaaatatcaacacatgttatactaatctaacaaataaaaggtatttcaatttaatataagagacaataaaaatatacattattaaaaaggattatgacttaagttttgaatccacaattgtcgatcaaaatacatagttaacattataaaaaaattaataattaatatttgtcgataaaaaaattgacaacccacattttgtagaataatacttaaaacaagtattaacataaatgcataaaacttaacaaaatacaattattattattacatttaaatatatatatatatatatattatataaagtttaattacttatttgattcttatagttatataaattttaacttagtttttatacttaaaaaccatctcttttaatccttatgttagttttcattatgagtttaaacggtagggattaaaaggaatataaaatgatcagattaaaaaggattaaaaataatatgtgtaaggattaaaatacatgatttaaagtgtaagaattaaggtaaaattttgtataattataaaaatcaaatgagtaattaaactttaatataatactattatatgaaaaattttgtttttaagaaaaattttgagggccaattatctatgcctatataatggatatatgtctattaaaaaaaattagagggactctcttcgtcctcaaataacttaagtaaaaattatgtcagttgtatatgcataatcaactattacgtaagtaggagataataggttgatttggtggtgaaggagaaaagaaaaggagatagattgtaggtttgaatttctcactaacaaaaattaataaattatcgactaatatttgttgataaataaaaaactcttaataagtaagcaacaaatcacgtagatatacagttcttgtttgagttgggactattacatttatattctcaattcctcgcgcgaattgtttgggttagggctactaaatttatattcttaatttcctgcgtgaatattggcaagaattgattaaaattttagcatggactcatcaacacacacctttgtctaatttgattcaatggaaagataaatcagtgactctttccgtaatgcaaccaagattgattggactagtcaactttttcataagttatattttacttatggagtgttcttaattttctcggcaaatttagttaaataactttaacgaaagtcttttaattcaagacttttttggaaatttaatactttcaaatacatccagtaatcgcgaattaagctttcaagtaacaaaatagttatttagcctttatctgttcttcctatccctgttatttttggagtgaacgagtatctaaaagaaaaaaaagtaaatagtatttaagatttgaagttacgtgaaggtgacctcctgcccaaaggtgactaaacatggcaataggtactcagtaggcccataacccataaatgcaatcattttcaagcccaaataaaaccaacaatccaaatcaaattatcataatgcttgcacgccaaaatcaggaaatttcagtgcgtcaattcactcaccaaaaactctgaccagcagcagtcgttaaaacaaaataatatttttgttcgttcctcttagccgctattgccttcaattcaaccatttgcatcataggcacacactggaccgaacaaaaaccatttgatcaatttatataaattataagttaaactaaacttaacacttaccaacagaaacaacaaacacaattcagcttctcctcctaggaaacgctgctgacatggctttcgggtcttccgaggatgtctcaggagtcaaattgcttttccttctggcggtcatgtacggactcttgtcggcgctgacatactccgtcatccacatgaagttcgtgaaccctctcgggaacgacgcgccgctcgatcgattctccgaagccagaaccgtacaacacgttcgaatgttgtcgcaagagatcgacggtcgtcaagtgagccatttttttgttttttaatttcgaaatgtgaaacttgatcatggtatttgcgtttttaattgtatattgtttacagttagggatcttaactgtgtgacatgatgatgtcaatcgctttcgaacaggtggaatctgatagcgcttttttcatcgccatcggtgttatgaactgagaaatgttattcgtacaataacttttaaatattttatatagcaattttaagtagaagaaaaaatagaacatacatgacactgtaaatccaattacaaactagtatcaaatatggtaagtttactgataactaatttaaaatagttgtcagtgtaaaaacttttagtctaacagtatatactcgttaaactcttatttttatctcttttgtcacattatttgttacatctcatatttctctcttaatcacagataatatttctcttatgaatctggcatgcttttgtgaattgacttatggtgcatttattattaggaagggcgtcctggattgaaacaggcagcaaaatatattaagggtcagttggaagtaataaaggagcgagctagctccactgtcaggttgcaatactttattattattattattattatttgtcacacacttctttttctcatttgcctttttggcccacttatttatttaacacactttttagtgtatgtttattatttttttttctttctcggagtctgattttattttatttccaatattttacttgcagaattgagattgaggagacaactgtgagtggctccttcaatatgttgtttttgggccataacatagctctgggatacagaaatcacactaatattcttatgaggtaccttggctgttcaatataatcatttgtattagattcagttatgttattaggatttataaataatattcttcagcaatagattacaccctatacttaagcaattttcacatttcatacatgaacttccttgttttaagcctgtagtttgtccattgcttactttttaaggaaaatatcaccactaaagatgcaaacttaatatatgttagggcaatgtattccataattcaagtattatctgaattcaacccatagttgataggtcaccagtcaccactttgttatccaaactgaccaacaaagtgatacatttgctaggattcaactactgaattgagtataaaccagacataaaataaaggtatggatgccttgtcaaagaccaatgcatgcaactaaatgtccacaatataggaagggcattctggagtggccagaactcatgctagaattgcagcataatttcattggaaagggataaggaaagatgttccgcaatttgtaagcaaatgtttcacataccagcaagctaaatttagtaacatgaaagcaataatgtaatttcaaccttttccaatatccaattacatgtagaggacatagaggcatggatttttaactggcctacaactatcagtctaacactacactaggatgcactgtcctgttaatatttatcgatcatttgtctaagtaaggccactttgcagtcagaataactaactattcaagtttgccaattgcagaacagttcattcacaatgggcagtttattgaatcattttctttctggttgtggcttattaaacattaaagatattgctgtgttttttacttgtaccacactcagtgctatcttactctgttttttctcacaccagtttaaatttttctatggaatttatgcatattcctccagcaaattcaaagttgtattagtatcattctgtttcccttcttacatttactcccacccttcctcttattttcagttccctgctgtgatgttaatttctagcaaagaaagacataattaggaacaccatacttgaagtgtgtttagctcacatgcactacatgtgttataaattataactggcattaatcatgaaccaaagttaagggttaagtgacacagagaattgaaagggctatttgagaagggtgaaactacatgggagataaagtgtaattatccctttgtttgaattacatccctgaaagttggttaacattgaaactgttaacaagtgtttggttttttaggtgggatttcatgtgaccctttttttaactgttttgtcataatgttgaaaaaaatacctcataattataaattagaagtgttaagatgtctcacactgactaggaataaggctagaatacttcttataaggcttgggcaatcctcacccttgagttggtttttggtgtgagcagagttgtcaatagcagtgtagcggccaagggctgcaataagcactgccaaagcatcacacttcaaaatttttaaaatagcagtcatcccactatgcgctatactgctatcgtgttcttaagttcagccgctgcatgctgctatctttgacccgtaacaatggatttgagttaacatgtcctgctacattagctagtaatatgggcagaatactccttataatgcataagcaatcttctccccttgacttaggttttggggttgagttaggcctagttcatttctaataagaagtaataggatccaacaaggtaaaagagggtgagaaaaaaaggtattagataagcttgcttctataatctgagataatcctatcaatggggtcacttgctagtaacttacaataacactgtaagaatcatacagttatctaatagttttaaatataaacaatgttcagagggttaattgaaaagaaaacagagctttataaatgtaatgcaaaatttgaatgaagttcatggggtggtggtaatctggatttacccttcttgcaataaacaatgttattttgatgcaatctctctctgtctgtttactttttttaaaaaaaaaattgttgcaaatgatatttgtcctaacacgcgcacacgtcgcccagaaaagtgatatataccatttcttaactttagagtgggagtgaacataaggtgggaactaacatgacactcttaatataaattaagaaggctccttgaagaagggttttgcaaagactgataaaaaattgtgttctcattagtagataatgatatgcaatctaaaggtctttgaaatatggacatttggatataatgatttgttattgaacatattatgtcaaaagtcaagactatagtgaatcattattgtaccttgagtggctacacatattttctgtacatcatgtaaacaacaaagtttgacatatctgtcttagtttaaggaatgttgactgcatttcatttttattttactataggatatcatctgtggattccaaagagactgatgcatccgttttagtgaatgggcattttgatagtccccttggttcccctggtgctggtgactgtggttcatgtgttggtgagtagtggctacatttgatgtcgtctttgaatttaagagattattatatttgggaaatctaccttgtcaccttgagcattctaaatcttattgttcatctgatttccccacttttcagcatctatgctggaaattgcaagactaattgtcgactctggttgggctccctaccgcccggttattttcctttttaatggtgctgaggaactttttatgttggtaggatgttgtctgtggaagatgaatggttattcatgaatggattttaccatgatgaaactaatgaggtattgtttgcttttgatgcttaagggttcacatggattcatgaagctgcacaaatggcatgacactataggagcttttataaatgtggaggcatctgggactggagggcctggtaaatgtgaagcaaaatttctattattagtagtaggataataagctaatcttcaatatctcagtccatcaccttatgatgtgtgctatacaggacattttcactgaataatgttgctaaaattaacagatttagtttgccaatctggacccagttcttggccttctaatgtctatgcagaagcagcaatataccctatggctaatagtgcagcccaggttttgtttctcttttaacctccctatatctataatactctactgtgttgcttagccattgttttccccttttgtatttactaattcaaacatgaattttctaatttaacatacaggatgtttttcctgttattcctggagatacagattaccgaatattttcccaagactatgggaatattcctgggcttgacattatctttctacttggtggttatttttaccatacctcctctgatacagtagagagactattgtatgtatcctatgtgcttggtttggtacaagatatttgattgaaattgcaaatgtgtttgatgtattactctgtctcagacctggaagcatccaagcacgtggagagaatttgttcagcataatcaagacttttactaattctgctaagctacaaaacacctataaaacaaattctagtgaagttacagctagcacattcaacgatgagcgggctgtattttttgattatttctcatggtttatggtatgcactgaagttggtagattcctgcttttgctaatgatctgatactcctagcaatatgatcttcataattgggccatctttctctttgttgtcttatatataaattatggattttcagatattttatcctagatgggtagctaaaattcttcacagtattcctgtcttcttctttcttgttatgcccttcatgcatggtaggtcacattcttggtcagcagcattgtgtgattttataaaaggtaaattagtacatgcttactttcatttacttctttgtaagatgtttctaattgatctccttgttaatcactttaattttttcccataatctccataatctatattctaggagatttttttggcgagttatcctagaataatttaaatattatttgtagacactttgaataatattttgtaatttgttggacttgcaggatttttgttccatgctgttgggattatattggccgttgttgttcctgttgcattttctatgctgagattactgttttcttctcagacaatgaattggtatgttcatttaacgttaactttaggcttcttgtagttagtgacagatttttttcttgtttaactttggtttcttgtagttagtgccagaatttttctttcttaatcaaattatacagtgggagaacaaagtatgataagtgccttttttttgtggccattgaagtatctgaggtgtaataatttaaaaatcttaatgcattttctgtgatcatgtgttaacataattgatgaaacccaggtttgctcatccatactttgctttcgcgatgtttataccttgtgcacttgttggacttttaattccaagaattatctggagaaactttcctctttctcaagatatttccattgtcaagacatcgaaagaggtattgcagcacatattgaaatgggtttaacaagtctattgtgatccatgtttcatagttttttttttttttttgatgaaatgattcattaataaacatttactttattgtttgggtctcaagctttacttagcaaatcttaagttgcttttgaagagtacgagttttatatcttggttcttctagttatcaaatgaaatttattgtccgatagaaaggcttaaaacttccaacaagcagtgtctacaaaatcagcatacctactttggcttgtgctgccttcatgcgtgatctttataaatatgattgtgtggtcttgtgaatttgaacatattcttcatgagtgattccattttgttacgagtctgaacttactttttgatttgacacataattgccaggcgctatctgatgaagcaaggttctggggagcatttgggttctatgccgtattaactttggtgtgcagatttaataaatagtcatgcaccaacacacatgcacatacacatatatatacacacacagcatgatttaatgtattctctttaatacttttgtgtggctaaacaactttagtaaaagcaggcttatcttgtagctgggttgagtggaggctttgtgactttttttgtgtgtgcttccctgcttcctgcatggatatccttctgcttgtcagtcaaatactttggacaacagtcactcaggttggttgtgaattcttatgtaattgtaatcattgtatttactattttcgtacaaataattgtgtgtcttgcttcatcttcggtcgtactgccactaatgtcattgactcccttcacattatgatagatttgtcttgcgtgtttgctgtttttatatgcacgctattatttaatctattttcattttgcatctgctattcatctccataattttttttttactctccaggtcaacaatgttttacatactacctctagttccatgccttgcgtattctgtttattttggtggctttcttacccagtttctgatagagaagatgggaatgatgggttctcttccactaccatatggttagtttatatatacacactccagtaattaaatatatgcatagtagattggccagtaattaaattaacttataatagagtggtttttaaggcctgggatgataactggaccattgtgatggaatcactaagctttatgctactgcatttgaataagtacatttataagtttatttatttaaaatcaaatgaaatgtatgtatgggattatctcgcttgaggtttcctttattgtaactcatcactttgtatcatgctagcaatttcataatggtcaaaatgcttgtggctgaccataacttcttcttgcagggcactatgttcccgatgttattgtggctgcattaattggaattgtaactggttggtgcacaggccctctaatgcccatatgtgggcattggttagccaggtcatccatcttgcaatttctgctacatcttagtgtgtttgctttggcattatcatctcagttctttccttacactatgtctgcacccaagaggattgtttttcagcatactttcctaactgcaggtattgattatcagaaatggcagtatggtggcaattataattttcttgatactctctgaagtaatcaattaatctagtgtctataattgcttatataagatcctcttatttgttttcttttccattatcattgtagtaccccaaatatcacctttttccccctctttgatctaatttctaacatttttcctatggtttggcaggctcaagtcagattatggaatccacttatgatttttctgtaactgactccaattctttactattccttttcaaacattcacctagagtggcaaaggaattgaatattacttcagagttttcatttgaatccacatcattgtctaaacgcaatgattggatggtaagttgcatgctgatataactatatgaatctttttctcacaggcagtttttcatctcactcaaataaaatgggaaagagtgaaataatatttttgtccacgtttattggttgttctttaattaatgaagttcaaggttgagtcagactcttcagtagttgcaaaatttcaagttggtgatctagctggtctgtttatttgttcagtagttgccatatttgtttatattacatgtattaaccacttttagatatactgttgttatcatataaattcattagtacaaaaacaactgttttttttttatatatttaagcttgtgatttcatgaaattaactttctctttgcaggcaatttttccagtttcttttctcttctcaaatagtctcaagttccctgcaaaaagggatgatattttgaaacagtatgaattctttcccaaattgtctgttcaaaatccatctttaaatcccgaaaagggacccagaagagttcacttggagctttatttagggtgagtggatcatggtaccagcatagttaatttacagagttaaaaatgcatggtgtgatttcttgtttttaataccttggcctagtgtggaaatcttgattatactaattgtttagttgcataaaacctttttccatgttggtatcatactataacagtcaaggcgtgagaattagtgcaggggtcacaaattgtgatggtagttggactagtagtctaatttttttcaacttggttgatcttgtctccataaagtattttattatttcaatcattgtgaatttttgtctataaaaaaataactttcatctgacagtttttagctgcaatttgttttcgttggtctgaaatctgtttgacaccaaggtggtgatctgaaaaaagttgaaagaaaatgaaatcttaaaatacctaactttttactttgttttcatgtacaattattttcatttcagttccttggaagaggtttgggttgcggttctcaacatcactggtcctttatcaagttggtcatttgcagataatttgcttccaggtatgaaaattgtttcctccacttagttaggcgcaaactcaattctaagatagtattaaaatctatcccagtggttattggtggtcctatgagacctgttattgaatcattatcagatcacctacaaatatttaatcttacaaacttcatacttcagatgtctaattctcagcatgaggagggtatattggaaatcccatattgactagtatgtggccaaaatagtgtatataacttaccttataaattagcttttggggttttgttaagctgactcagatgtctaatcctcgacatgagtaggttaggttgaaaatcccatattaactagtgatgtagtcaaaatagtgtatcattgtatataacttatctcatgagttagcattttgggttgagttaagttaaactcaaaattctaaggggggtgattaaatgttttcattgcctaatgtagcctgcatttgcacaggaaccgaaacctatggtggtggtccacaatcatatatatgtcgtctcagtggacctagcgatgggaattggaccttctggttagaggtaaaatttgatgctgtattaaacttctctttactataacagcgtaattttattttgtttgataatgtcaggctaacagctctgaagcattaagagtggacctagcggttttagaccaaaagttggttgatccagtaaagagattgaagaatctttttccagactgggttgatgttgttgcatattctagttttatgtctagctatatcttctaattctttatgtaaacatttttagaagaaagagcaaacatggcatttatagatgcaaaaccaaaaccaaaatttgatactagatctggactgtcacaaatacgtctttcctgaatttggcttttttggggggaaaaaattaggagaagctatccctattacaggctgcagaatgcaaagtcatagggaatgcttatagtttatcaagaataaaataaaaataatttttttgctgaagcttaagagttaaaccaatgggttgcaaccgaaatgctcttttggtgctgaacaataattgaaaatcaatgtttcgaaattcatccattcccaattaacgacagtcaagcttcctggtacgtaagaaggcttaacttctaaattaatctcttttgtctgcgtttgttcatcttaagtttgattcgttgtgagttctgcagcatttgttgttcagtgtaacagaacctctttattagttataaacttcatcgttgaagattggtggtttggcctcattcaaaacttttacgtagccgaaaacaattgtattaatagatattttgcagaaaatggatgttcattaggcctatatctttttcattttgttttacttttaaataatattgaaatctcatgcaaatcatgagcatttatagtaaggcaaaggactcagtttttaaacaaataaatggaaagtattgatctttgacaaaagaaaatgataatgggaagttacaatggactattgagcagatatgtcgattttgtaatatttaggataagttaaggggagctaggtgcaattacgaaaattaaatttcagatgaagtttaatttgggtgatagtccggcttttacacttggacaccctatatactctttttttccgggaatatatttatggactagcttgtggtcatgggtccatttttgtagaaaatgtcggttataataataaatttagtttactatttaatattttgttgatctgtatccactagtcaatatttgattaaacaacaacgttacatgcactcttactgcgttggtattcatggacgaaaaatgagaaggaagcaaggaatgtttttcgcaaatagactctccaccaagctgtgtttatcctaaatatttccatatgcttctgccatgattaatactacaagcgttgtccaaccagtaaatggatgtgccccttttcccttacccttcgtctgttcgtactgttcccacaaaaatcccgtatgttgataattgcgcactatatttctgcagtaaagagaaaatatattatctaaaaaaacaaccaataactttaaacaggatttcaatcgaactgaatacagtcgacaatacctaattaaattgcttctcaattcttcgtagatggttttagctttctcttgatatggcccattctctacaagattcaacccaaagattagtttcaggaagaggaaggtataaaatatagtgggaatattagcagatattttgccttggccagtccatattacctttggagtaatggtggagcgctgaaagaattctgtaattcatgtttatccaaattggacctctccagtatggagggtcatgctctgtgttgtgtttcatgtacaaggaactgtgtaataagaaatattatttttggttcactataatcaacatatgctgaataatgtcgttcaattatatccattaaaaaatgcattagagcatagggtgcaccttgttttggcaagagaacgtaatccatagttggtccataagaggctgcgatttgaaatgagttcaagctgcttttccagaatccgtgatccctgaatgaaacagaaaataaacatctatgaactgaaatcattcaagcaacgaataaattcttagttcattgcataaaaagacatgttaatgagaattaatgcacatcacttacagatggaatgatcctccccatgaacgggaataaactaacataaccaatgtgaggaaccaatctcaatacaggcatatccataacattccggagaagttggcgagtagcataattttgtgctgcctcaggttctttccatttaagttgaacctatcatggttatgtaaagaaaatctcattcttggtcatgaatagggaacccatgtattggtaatcttgcaacagtatgcataaataatactaaatacaaataactatatactctaccttctctgtatgatttccaaaatcaaagtaagcaccatatgcatcatcaaaatgcatctgtatggacatcaagaacaaattaggcatacacactattattgtagcaaataactattaaaagtcaactgcatagtttgctttcaattttctttttattaaaaatcatttaaaaacaaaaggaaacttagattatcattattttctccatgtcaaacaccatatgttatccatgataaacacatagaatcttccatggaacaattgctgccaatagataggaaaaatagttggaaatttcaattgtcaagagaaaacttgaaaaaaagattccatgttaatgcagtgtgttcataatcaaaggtttttatatataaaagatgttcacattcttcaataattccataataataaacttggagaaggcctagatgagtatcccccacaaggatgagcctcattttctatgaaaagtcaagaaaaaagaaaaacccaggaatgtgtgaaagttttctaaatataaaaagttttctttcccataaaacagtaatttgttttccatgtttaaaattcaacttatctataactgtatgtgctaagaaagttttcttttctcttaattccccctttttatttctctcctctttatcttcactattttgctcctgttccagtgctgcatcaccaagcagggatgcaccaccaccacaattacaaggtgtgcaacagctctaaataaagggagatgaggagcaaaggtgcaatacctggttcagtaactcaaaatccaatagcaatttagcagtagaaccataatcctgcattatttcattcaatatgtcaattaaataaggggattaatctgctgccaacaattaccgtactagtaatttatttttcaaattataccatgccaggtttgatttccatatccaacaactcttgaatggaatgcatacagtctgctgcaagtaacatccaacatctaagatccaagtggcgttcatcttcacttgggtgtgaagctcgtggataatcatccaaaccagaggacagtgtctgaaaatgccagagataatgtttgttaggagcaagggtcatcatcagggataaggaaagctttgtcaaaattgaccaacataaacaccgcaactgtgttatgtgatcctaggatgtaatagatcaaagaacaactaactacaagtgagaattctggattcaaactcattcagtgctcatgtttatggctttctagtttctagtagcaacagagaaagccatccaatagactcattttattttcaggaaaaaaatgtgtcctattgtattctttgagtaccatcaaagatatggaacaccaacagcctacaaattatcaaatatgtaggaggcgggcgaatttcttcgtatattttattgtatttggcaagaaatctagagcaactgtgtttgcatctctatgcttaattaggattttggtctctgttgtagtagctatttatcaatgaatgtggttgccttaacattaacttcttataaaaccatgacaataatggtaaagtcaatctgctgaaatacctatatagtatatagttcagattaaaattgtagataagtgctgaaattaaaaagtatactggggatgcatattagaaccttaggatttatttcacgcattgtcctattgtcccgtccgtgccaatagtagctgcccatctgtttccctttattaaaaagtgatgataacaatgataataaaagggtcaaaacaaagcaacctatttctagtgatcaagcagacagcacgtgcaatagtatatacctgactgagttgtattgaaccaatggaaccatgcttccaatcgaacaaaggcacgttccaggaatagagagatctcacttctatccattgcagtaaactcattattcttcaagccattaattatatctacagaaacagatttttaacctaattcaaaatcaccaaattaatgtttcacatacgtctgatataaagtgatatttatagatataataatgtacttcataaaaattgtcactttccataaatttattactcagaatcatctaatgtatcatcaaatccagatcagttatgcataattcctaatttaaatgaagaatgtgcaaaaggagttacatggatatgctaccacagaagaggtaaaaaataaccaagcaggaagttgttaattatcatccctcaatgaaagggaaaacctgtcacatgcagcctggggtcctggactcaaggctcaagctatggcttgcttgaagtaaattattgtaacctatttataacaaggagaaatagaaaaggaacattagcatataccattcaatgctaaaaacagagttggaggatttccattagttggatgctgaggaacaaattcctctgggacccgactgcaagtacagaagaacctatatgtcaataggaaagctaaaaactttaaatttactgcaattatttgaacaaaatgtttagtaatacacctcagtgcttcagcccccaaaatttgttcacgcggtatccatccatcaacattcatcaaatccaaccaatgcccaatgatatccaatgaaatatgaatatcccaacgcctggttaatgtgcacaagtgcaaataaagcatatgtatacatcaagagttatttatttgttaattaatacaggtaagtcttgtgcattcaacgacaacaacaataataacaatactagtggtggtggtcatgaaggatattactaaaacaaaaaaactaaccagattataagttgatgaaaaccttcatcccataaaaatcctcttggaaagaaagatcgacttggtacagctgtgtaaagctcagcagaccaatacgacatataattgacatgttctctaagctgcaaaggaaaccaacccactgcatatctatccaagtctaaattgctgacagctaattaaaagtacaaaagttggcaatatcaagatgtaaaaaggaaaacaaaagtcactgacagcaattaattgaagagtaccaaattacactgttagggagagaaatatatgaggaaatgaggcaaacagaaaattaatacaaacctagctactgacacaggatttgttttcaagcctaaaaagatagacaaatgcttcacaacatcaaatctaattaaacttctatgatgaaccagagtgtgaccacctatcaagaagaaattttacaaaatggtggttctacacaaggcaatggttgtgcttaagaatattgccttcgctagcaaaatgattgtagtggtttcctttagagtcagattctcaattccctagcaaagggtaggattcaaaggaatggggaatgagaagcatacagtcaatgtaactcacaaatccttgaatacttatgttatgaagttacgcttctttcatttctttttttttcttccgatgtggagatcgttcttgctacagaatttcagaggattccagctggggatcacccatttcctatttctttgctttctactttttttataaagcaaaccattttcctatttcttatcccagtcaactactgatgcaggagctttttcagattcaaatttcttattggtttaagtcttctaattctaaatccattgatagttacaaggatttaaactttagactaaatatttccacttcactcaatctctggttgttcaaaaaaatattattttattccatttgaagtctaagatccactctaaggattaatatcacacacatgatcaaaatctctcctattgaatcacatgtccggcagttagatatttgtggtgtaagctttgataatattggtgaattgtgaatttgtacaaagagcttagaacattttctccaattagagggttctaggagaagggatatgaagggcaaggcaacttggcagtataaaatgttcactgttaataggtgattatggttagtgagagatgcgagaaatgcaaggttacatttttttttatattggttttacaataaaatagttttactctttttagcaacttcacagtgttcagataatatttatttcaaagtcaaaatctttattgatctgcagcatgatttgctagttaattagcttgtctaggttttcagtaagcattaattcatttatggatgcaactgaagaaatttttaatttagccagaatcctctttattggttagcaatcctctgttctcgtacttctttttctcatctctaaaatctcctctttaccaacagaaaatacaacacaagaaacaaagctttcacatttatgataatcacatgtcaagttatgcactattaaggggtggtatacacttcaataaggactataaaaaacaaaataaggtaacttacattaaggattcttgaaagagcaatctttgactggccatagaagtacccgatgccacctaataagtttccaacagcagccttaccaacagataaggcttcggaatccacctggaaatccactactatgataaagaatttatatccatcaaggataagcttctaaacaaatttactcaagcaaatgaaatttgagagatccaggacacatcaaaagacaaaacaagaagaataagggttgttttggtaaagaacttaatttaagggcttcttgaataagtatttatcatgtaagcacttgtatagtttttataatcaaagaggaaataggtttaaactattttcatataagttgtaaggttgctttcatgatattttggagaagttactgaaataagctaaaataacttatgaagataacacaagttgttttcgtaagctttccgaaacacttacactgctatatcataagataagtccaagtaagtagtaagttcttccaaacataccctaagtaattgaatttgagagaataaaataaaaaagaagacaaaggacaataaaattagtaccttcttggccaaattgaaaatcttctcaaacttctcatcaaattcttgttctttatatttcagtttattggacagtgaggtacctaacaatgagcaaaataacaaataaacaattacacactagcatgtagcatcctaatgccaattagaataaaataatctgtacaaattcggcagttctctttaaaatatataatatttaatattcaaacaagaaaacatcctaagagaaagagacaaaccaaaagccttttttttttggtcagcaaaaataatatatatatatatatatatatatatatatatatttaaagagaagaaagaaacagtacaagtagaaaaaagacaaaaaggatccaagcaaacaggacctatggcagcctaattcatgagaaaaggcatgaattaaactgccagaagtctggctagatcgaaagaaaaccctcaaaacaggagaagacttatacattaagtcctcccctgattaaaaaaaatgtcacccagattacaagaccaaacatgaaaaagaatattgaatcctttttctaaaattttaatccacatccagcaggtaaatatggcttcttccataagcaagtttataaaccccaacaatgtacatcaatatgagaagcaagtttccaaagcaatgaccaactcgacaactcctacaacaatgtaaaggactagattttttcctcctttttgatgagagcatgcatatatacatgtcagattttgtacaaacattataaagaagcagagaaaaacctgtaagcatactaacacgctcttcttccctagaagtttccaaatcagttccagagattagtacaatatctgttgtgaaaggaaatccaccaataatctgcagcacaaataaaaaaattgagaagcacatatgaagtgaaaccgtaaggaaagatgttttcaagagtagttggaaagtggttgtgtgtgtgagtgagtaagacaaagagactcaaagattaaaaatgttaaacgggtattacaaagtgtacatggtctatttacctgaaaaactaacacatttggagaatcatctaatgagtcagatagctgcagtcgagcatgcttttgtatctactaaaacatgtacataaagcaaagatatcaagggaaaaccccaaaaaaaaaaacaaaaatccataaccacattcttgcattacatgaaaattatatatcatcggataaattgaattgaactgaaataccctaacctacttgtgatgcaagattttcctctacgagatcagacaaattgtgaaagtgaggtgtgcgaaatccagcataatgcagctgcaaatcatcctgaaaattattaagcataagaaaatgaatagcaggttaccaccaggcataatattacagataatcaagagataaaaatttctacattaaggcaagagaggaatgatttaaatgggttatttatcgatgaaaggaaaaaggaggactgggaattttatcaaggtagttaaaatattaaataatggcatatacatgtttgctataaaatggggacacttattggtttatcatattcttaaactatttcaaagactgaaacaggaattgtgggtgcttctttaaggaagtgtaagtcaatcacaagcagtaaaccataaaatctataaaaaaaaaaatgtccaatggtagtacaagtaacagaatcttgaatgttcaatcattaccgttgatttcaaatgtagctgccaatctccaatatctgctcgagagccagatgcaagcaaagaatccacgtgaatgttcaagttttctctacttacatctagagcattaccagcttcatcagccaaatagaaaaagagctgggcacctctcccaaattcctcattcctcttggatctgaggttcgaccacaagaacaaagacactcaatagatgaaagtcactgaatagagctattctaagaaatgtagactcataaagggaaacaataagaaagatccacaggaaaattaagtattacttattatgttatgttataattaattcaggaaataagtcaatccaaaagctaacttaaaatttacaagggtgccatgagaatctctaacttcaacaaactggctagcatctacttagcaataaagaaaaactacaaaaaaaaattattctgtcgcaatacatatatgaaagtgatttgaagttgataacatcactcacttatccatttgcacattaattcgaaccgcccaatctccaccataaccactgccttcctcttttgattttaaaaacccagtagtcaaggtcaggccatggtcaaccagcacttgatgtccaaaatcacgtccattgtgccttgtccaaccataagtacctaggtcatcctcatgtctgcaaaaatgccgcaagtgatatttgccatccttcacaccaatccacattaatccagccatcaaagattttggagtcctgaaatagaaataccacccaaaaaaaaagtgagaatgcttgcatgctgagtcaaatatcgtcgacatccgtatcctaaacacaatctatgccaaaatttgggcacaccagtttctgtgtgatgcacaatttgcatgcataaataattcaaattactcacaactcgaaatatatacaaaccctgcaccatcaacaacagtataaggctataagccttaaccaccaaaatagtctcttacttcataattccatttcagcgcaaacaaaacaaagctgagtctgaatataccttgtggtttcatcaatcaataaacaaaaaaacacacctcaagcatacacacacacacacacacacacacacacgaattgtgcttcagaaacggtaacatacctggcgcgaattccgagatacacgtgaggacgataagttccccaatacaaactctccttgtgctcaccttcaaactgcaacagcaccaaccaagtcattcttctttcttcacgcacgctaaaatcgtcgaattctcaaaactgaaaagaaaaagaatggggaaagttgaaagttgacctgaggaaggtccattatctttggcgcgggaaatggcgtgacggcgcgaggaagcttcggttccgttacggaattggagaggtggtggatcataaaccagatgatgaagaatgcgacgaagcagataccgagcagcactttgagattggcattgttgtatatcggaatggaacttccgtatctgcttctctctctttggcgattgaacggaggcctcttatgtcgaagagaatcggcgtcggcgtcggatctcactctgcttcgaacggtacttcttccacttccggtcatttttggcggatcagagattcacgccaccgcatgcatagggatttggagttcgagtggagggagtgtttgcgtagcagaggtttcggtgttaataggggatttcgcagtgtagcagtggagttcggaaggaagaatcagaaggaaggagacgagtgacttgaccgataatgggcacgagcaaggaaattatcgtgggatgaattggactctgctaaatagactatataaatttctaatgggaaaaattttatacacccagaaaaagactcatgcaccattccaatttttttaaatagctaaagtactctcgcattatacaagtacggattcgtgaattcgtaatttctttttaagtcatacggattggcccaatccgtacgtaagttttttttttaagttaaaaaatattttttcaaataatgacacatgtaagtttcaaacatgtgaccttcaggttattaacacaatgtttcaaccaactgagctaataggtcaattatgctaaaaactaattaatattgatacatatagcattaaattttttaatgtatatttaatacacatataagtttatataataaattttgtaacaattaattttgatataataattaaagtattttttttatataaaaatcatagataaataaaaatcataagtttaataaaaatttgcaggtttaataaactataaatacagatataatttttaatttaacttgtaaatacaaatataatttttattagacctgcaaatttttattaaaattatgatttttatatgtaaaaaatactttaattattatattaaaattaattattacaaaatttattatgtaaacttatatctgtattaaatatacattaaaaaatttaatgttatatgtatcaacattaattaggttttaacataattgatctattaacttagttggttgaagcatcgtgttaataacctgaaggtcacatgttcaaaacctacatgcatcattatttgaaaaaatattttttaactaaagaaaaaacttactttggtgtataaagtttttcccatttctaatacactatatatttcttagaaatttatatattgtatttaacacacaaccacaacttgctgaagtttggactaacctggcccaaattcaaccttattttagtaaggctttttcttcttacactatagaattttcaacatacactatattgtaatagtgtataaccgaaaatacctatgtttaggtttttattttgaaattgttcaaaaccatcagcaggtgcacgcttcctctactttgacttccttcttcgtttgtgctttcttcttctctgtggtggtttgacggtggtggcattgctccggtttgtggtggtcaatgagttgcaggtggttggtgatcgtccttgggctgcgccgtcggttacccgtgagcgtcatttgatttgatagggtgattagggattgtggaatccgtggatatgatacgaattagtcattccataaaaggggtttgggggccttacggattggacaatccgtatgaggcatacggattacacaatctgtaagctttatacgaattgcctaatccgtaagtttcatatggattgcataatccgtaaactttatacggatttgtttgataaattgcttgaattgcctaagtttttcatatattattatgtttgatttgagaaattacaataaactaaattggtaaatgtgatgtgtaatattgatttgagggggttttaatttgaataattatcgtttgacatttgttttaagtttgatgttttgtttgtgttactttagtttttgcacttgcaatttgaatacttattgttcttgcaagatacctgggctatggaatatatcagttttctttctaaatacttattttagtttgatcattattgaaattatgttgaatttccactaatgataaacttagaaatggtagtttgttgaaaacctattggccattaggctatgtatttgttttgtgttattgattgttcttgcaagatacctggttgggctatattcattgttttgtgatattcattgttgttgaaagattaatgttaggcatagtgatacctgtgaggggtatacgtgtgatgtacttttatcagctaaccttgttgaaccaccatcaacaatgcgagtttcaattatgaatgattaatctcagcatagcgatacatgtgtggggtatatttttgttttgtgttattcattgtcgttgcaagaaacctgtgtgttggctataactgtgttattcattgttcttgcagaatttggctattgttttaagtttgatgttttgtttcatttgttcttttattttgatgagtatgtgtgaaaagtttgtgaactgaataagctcttggattattattggtagaggaaatggtgaaaacattaaacttgcataaaaatctggagagacctgctgctgcagaggaaggcgttgaacgccgtaggtctaatgcctatgctcgaagaagacgagcagttattcctgttgttgaggaaccagttcctcaggacgtgcaagttgaggctaacactacatatatggtagatgacataggtagtaaatctgaaggatttccaggtggtcgggaagacccttcgattttgaaagggtatagtaaccacgtcgcccttagagtgtgggccggagaggtaatttgacgccaaggtaatttaatgcacatgtaagttttattttacaacattaaattattctagtatttttgttgttgttaaaatttaattaaaataataataatacacatgaccaccccttaaaatatccaaattattaccaccggttattaattatatatgaaacaaataggtttttttttttctttttctttctaatgaagtataagcgtataacaaatataaccatatttttatatttatatatatatatatattaatcgttaattttttttatattcttaatttgttgcaaaataacaacacattgatttattttttatacaagtgaatttatttcttatgttaatgcatgtgattgtatgtttgtgaccattagataattattgaatatttgaaattgaatattacacaccaaaaacaaaatgaaatttaatattaccgtgaaatttaaaatattaattcttaatggcaccattcattcacaaatcatatctcagcatgtaaaaatttctcaagcttagcatttttggtgtagttcaagataatctgtaggttctcttgttaattcatttttcttactgttttgtatctttgaattcttttattttagaagaaaagcaataacattacttagatgacaggacgccagctaatgttgtttttctttctttctactcgcttagaacttagacgaagtctaatatgaagtttaacttcttccctcatccgtgtactcccaattttatcagtaatgataggtttgtaacaggaatatatatatatatatatagatatataaattaaataaaatcattttaaaattattattttttattttcttttttttaatctccttccctacaagccttcccgaatgctcttttatacgaatttatatgttacaaaataaaatttatagataaatttgcatgtttgataaattaaactataaattattagataaattaaactataaattaattattatatcaaaattaattgttacaaaatttattatataaaattatatgtgtattaaatatacattaaaaaatttagtgttatatatattaacgttaattatttttaaacataatgggcttataaaaaaaaacttacggattggtccaatctgtaagattacggattcgtcaatccataaaaaaaaaaaaactcatacggattgcctaatccgtaaggttcttacgaattcgtcaatccgtatgaattatgcggatccgtatgaaacaaaacatgtaaaatagcgaaggatattttggaaatttcactgttacgaaaatggtgtatcagaaaaacgaatggtgtaggaaacaacattctatttattttgataatgatgatcattagcggataagtaaaattacaaaattaaatatatttcttatgactattatatatcatgttaaaattacaaaacaaaacaattttttatctaaatattagattgcatatcatgaatcattttgtaaaataattgaattaaatttacttgaccgtatatcatgttatatatatatatatatatatatatatatatatatatatatatatatnnnnnntcataatgtaataaaaaaacatgaaaaaataaagaacaatgctttaaattaatttttttaagaaattgaagcgtagtaacaaaatggcaccaagataacaataataaaaaaatgtcacctatataagatagagcaagttacctttcttaattcatgaatcatatccataatgaattctaattaacaacatattaacactaaaaatactaatatagtattttgataatttacaactttaacatcaactagcgtcattagaaacgtaaatgtgatattttgataatttacaactttatcactagctcttgtaaatagaaaagtctttcccatttaaacttttttaacactaaaacagtaatatagtaatttgaagatttaattggcatttagttttgtaaatattgaaagacataaaataatcaaatcacacaaattgatagtgttggtttggttgagaggtttggggaggaggaggtaaaggaggcaatatggcaatgcaagtgacaagttggaatccatatgatggagagatctaaaaaaattgtgtgggagttgagtggtttaagatggtttgatgaaggactagattggaaaatggaaaaaagggataaaataatttttgttgtgatgcataagagggagagcaaaactttgccaatttatatctcatactattcctcattttattgcaaaaatttgacaaaattgacaatatgggaaggtgggaaggagagacgtggagatggaaatttagttggtgtaggaattatatttcttaggaagaggacttgcaaagaaagtttcaacaacttgtatcaagtatgggcattgataggaaacggttggatggttggaggtggaaacgaaatgtggatgagtcttattcagtaaagacaacatataatgtcattattgggaatgacaggaaccaacagacaaacaaaattgttgttctatatggaaggtaaatattcctccaaaagtgatcttttttttttttgtggagattgtttttgaacaggttgaccactttggacaacttaaaaaatgtgagggtagccgcgaaaggctctatattgtcttaccattatcacctgaggagaacttttggcaaaaacttgggtctgcaacttctgaacggaacacaatctagtgtgtgatggtctgacacatttggaatttgtgtaatgctattatttttggatgtgtagtttatgttttgtaaaaattgttggaccaaattcttttcacgagctggtcatggttgaaaaatagttcgaaaacatttcaattttcatttgcagagtggtctctgaatacggttgtctgcttatacagatcttaaacatggtgtggaggcttggaataatggaaattcaaagggtgataggaggagtggtggccaacaacttgggagaggaggaggattcaaacttgataggaggagtggtggccagcaagaagaagcgagacatcagcgaacagaagtgagccaaacaaatttagtaaaacgcaattttggacagcaaatcaaccaaaattaactcctagcagcacagagatgtgtgaaatgagaaattgaagcccaatctagaccgaacgcaaacagaagcatgaacaggaacaatcacgagccaaataatgtcgtgcacggacaagaattgatgttgaacagtaacgaacatataaaggagtccaaactagcttcaatcagcacagacaacaccaaaagaaagatccctagctcaaaagaaaccaatcgaactcgtacgaatgaacaggagcaagcgcaatgaagtttgcaatcgtaaatcagatacgcatgaacaataaagaaaattcaatcaagaacaagactgaaacaaacaggaaatctaaacagaacttgtgagattgaacatgatcagtgcaaaatttttgctgttgataccatgttaggtaaaatgaacgaaagagagagagagagagagagagagatggacagctgaatttcttttatttcgaaagaatgaaaagtagttacaaactgtacacgtgaggtatttataacctcttaccactaacttgatgaaaatacgggcttctctaaaacaaccctgacaagttggcgagcagaatgattgtgtcctatctccacttctttctatttaagttgaattgagcatggttaagtacgtgaagaatatcctcatattttcagacatgattaagaaacatgcattgctattcttgcaacggtaagcaaactaaaactgaacctaaataactagacatttccatggaattgcagaaattttaaaaatcttaaaaatgaaagaatttgagataataactacaagtatacgaaaaaaaaaaagataccttttttatatgatttccaaaatcaaagtaagcaccatgtgcatcatcaaaatgcatctgtatggtcatcaatcacaaattaggcattgacacagttatggtagtaacaaattgactctgggtcaccatgcaaacattaatctgctttcaattttcttttctcaaaaacatttaaaatagaaagaaaaatcagattattttctttatgttactacatcaattatccggactatattcaggaatcacggtgggaaacttcaattgctaaaagagaacatgtgaaaagattccgtgtacatgtagagtgtttatacttgaaggtttcatgcatgtaaatgcagcaggggtccttaaataagtcaacaattcactttaaataagtcaatagtctaacttggacacaacatcaatccacattaatcttttatagtgatcaattagtcattttctttgtaaaatccatgcccaacactttttacgagtccgtactttgtaaaatccatggtattgtaagggcccttgactagaaatctctaaacattatgttacctttgttttacatgaaataatctttttatgttttgaactctttcagctcactagtctaatcataagatatgctcccttactaattgcaacgaaattacttgtttataatgaagaacttcatgcctcttatcactaatttattatcatcatcgagtcgaaagaattttagaatcctgccttctgattaccaatgtagtacaattggaaatttcctggaatgttgcggtagcttctgaaaagtatgaaggtggaggaatgttttaaccccgaaaatgtgtaagaggatctttgatggtgatgcctaaacacacagatgaacttttggaatgataactttttgcctccacttatttttgttgacagaacttttaatttgaaatgacccatacattatacattattattgacaatttgactcccaccaagggagttggagggttattatacattgttgcagtatgatagccttatgagaaattagatgaccatcgtgtaatatgctatgaagatcttgttggtttgattactccacagtgaataaaaggtccagtgcttgggtaacgtggtttttctaaattatgtcatattcttccgccatgattaatactacaagtgatgtccagccggtaaatggatgagacccttttcccttaccgttattctgatcgtactgttcccacaaaaatccagtttgttgataattgcgtactatatttctgcagtaagatggcaattattatttaaaaaccaaccaatatcttgaaacaagattacaaaggtaccaaacaaaatcaaacaatacctaattaaattgcttctcagttctttgtagatagctttagctctgttctgatatggtccattctctacaacattcaccacaaggtatgaatgaagtgaaatatttgcagatatttggcctaggccagttcatattacctttggagtaatggtggagcgctgaaagaattctgtgattcatgtttatccaaatttgacctctccaatatggaccctcaagctcagagttgaatttcatgtacaaggaactgtgaaaaataattattttttggttaaccataagcaacataagctgaataagaccacacaaattcaatccattaaaaatgcatttgagcataggttgtaatataccttgtcgtggcaagcgatcgtagtccatagtcagtccaaaagagactgtgatttgaaatgagttcaagctgcttttccagaatccatgatccctgaatgagacagtcataataaaattatgcatatggagttattaggttgacttaatgatttaaggaagaagggaagaggaaaagattgtgggtttaaatgttttccactaacaaaaactaattaacaactaacatttgtccgtctataaaataaaatatgcatctaattgtgaagtcagtcaagcaaggaaaaatttctcagttcttcttagcataaaaaattcatgatattgagaatacatgcattacttacagatggaatgatcttccccatgaatgggaatagactaacataaccaatgtgaggaaccaatctcaatacgggcttctctaaaacaaccctgacaagttggcgagcaggatgattgtgtcctatctccacttctttccatttaagttgaatctagcatgattaagtacgtgaagaatatctcatattttcagacatgaataagaaaccatgcatagttattcttgcaacagtaagcatactaatactgaacctaaataagtagacatttccacggaattgcagaaattttagaaatcttaaaaatgaaagaattcaagataataactacaagtatactaaaaaaaaaaagataccttttctgtatgatttccaaaatcaaagtaagcaccatgtgcatcatcaaaatgcatctgtatggtcatcgatcaatcacaaattaggcatggacacaattatggtagtaacaaattgaatctgggtcaccatgcaaacattaatctgctttcaattttcttttcttaaaaacatttaaaatataaagaaaaatcagattattttctttatgttaaactacatcaattatccggactatattcaggaatcacggtgggaaacttcaattgctaaaagagaacatgtgaaaagattccatgtacatgtagtgtgtttaaacttgaaggtttcatgcatgtaaatgcagcaggggtccttaagaagttcacgttcctcaatatgttaattaataataatgagcttgaagaaggcccaaatgaagattacactcagatgagactcattttcattatttatatttaaggaaaaagtcaggcaaagccttgcttttcaaattggaacacttgatcttccattttggataaaagctcaataaataactaaataaatagtcttctaaataaagaaataaaaaagttttcttttccagaagcgtaatttgttttccatgttatttctagttctatttattctatagatgcatacactgttctatttcctcttttttcgtcccttttatttctctctcctctttatcttcacttgttttgctcctattccagtactgtatcaccaacagcaaagaagtgcaacaaccctgaagaaagggagagagggagcaaaggtaaaatacctggttcagtaactcgacatctgatagcaatttagcagtagaaccataattctgcatcatttcatacattatgtcaattattttaggttatttaactttctgctgcctacatttaccctacttgatatctaaaatttacaatgcataattacaatactgttgaatttacttttcaaatttatactttgccttgtttagtttccttattcaacaactcttcaatgtattgcagactatcggttgcaagtaacatccaacatctaagatccacgtggcgctcatctgcacttgggtgtgaagcacgtggataatcatcaaatccagaggacagtgtctgaaaatgccagaaataatgtttgttaggagcaagtgtcttcatcaaggataatgaacaccttgtcataatcaaccagcaaaacaccgatggctgtaataagtggtgcttgaatgtaataatagctcaaacatacctgcaagtgagaattcaggtttcatgctcatttttttggaataaaaaagtcctattattgtatcctattagtaccaccaaataaattgaccaccgatgccaaaaagccaaaaagtgacaagaaatctacaacaatcgtgtttgcagctttatgcttatgtaggttttggccttctgtaatagcaatctttcaataaatctcatttgtggttgccttaccattagcttctttttgaagcatgccaatggttgttttggtcaagttaatttgctgggctatctatatagttcagattgaaattgaattcacagaaagattaaaaataaatataccaagaatgcatattagaaccttgggacttaattcatatatagttctattgtttcgtccatgccaatagtagctactcatctgtttccctgataataataaaagggaggtgggggtcagaaagaagcaatctatttccagtgctcaatcagactacacgtgcattatagagtatacctgactgagtaatattgaaccattggaaccatgcttctaatcgaacaaaggcacgctccaggaacagagagatctcagttttatccgttgcagtaaactcattattcttcaatccattaattatacctacaaaaatagaattttaaccactttggtaagaattttttttcgtggtgtggcgagcagagagatcaagaaatatacagaaaaaaagttctgtactgcttcatagctaagtaaaagagggggcaataactttcatatacttgcattggatctatgtcccatataaagcatttttccacatttcagcagcaccaagatatttcaacaagtaatacatcaccaaactaatgttaaccatatttttttacctaaagatatagttatagatataattacttcatacaaattgtcaaactgtctccataaatttattactcggaaatattgaagtatcatcaaatccagatcaattatgcgtgataccaaagatctagaacaagcgaagttacaagggtatgttatcacagtcacagaagagacaaaaaaataaccaggcaggaagctagttgctaaagtatcgtccctcaagctcaaggaaacaaaaaaattaacatacacaaccaagcctaaagtcatgctagctcgaactcattaatggcatatatgtagccttcttttttaaataaagattctcataactagaagaaaaaaaggataatagaaaggaacattaacatataccacttaatgctaaaaacagagttggaggatttccatttgttggatgctgaggaacatattcctctggaacccgactgcaagtgcagaagaatctaagtcagtaggacagctaaaaattttacatttactgcaattatttgaactaaatgtttttactacacctgagtgcttcagccccgagaatttgttcacgtggtatccatccatcagcattcatcaaatctaaccagtgtccaatgatatccaatgaaatatggatatcccaacgcctggttaatgtgaacaatataaaaaaaaacatatttacagatcatatattatttgtttgctaaataataccagtaagtcttgtgcggtcaataaaactgtacttaaactgaatttcaaacaagacaaatgataatgatgatagtagtagtggttgaggtcatgaaggatattattagcacaagaaactaaccagattataagttgatgaaaaccttcatcccataaaaatcctcttggaaaggaaggtcgacatggtacagctgtgtaaagctccgcaggccaatatggtatataatcaacatgctcactaagctgaaaagggaaacaatccactgcatatctgcccaagttctaaattgatgacagctaattgaaaggtacaaaggatagaaatagctatacacagctatgcttatgcctatgacatactcttcaataagaactataaataacaaactacactaccaaagtaacttacattagagattcttgaaacagcaatctttgactgaccatagaagtagccaatgccacctaataagtttccaacagctgccttaccaacagatatggattctgaatccacctggaaatccactactatgataaataatttgttaacttctaaatcaatttactcaactaaatgaattatgaaagattcataacacatcaaaagacgaaacaagaagtataaatcatttaatatgagatagttaaacaaacaaaaaaaacaagtcaaaggacaataaagttggtaccttctcagctaaattgaaaattttctcaaacttttcatcaaatgcttgttctttgtatttcagctgattggacagtgaggttcctaacatcgagcagaagaacaaacaaacagatacacaaggacttagcatttagcaagctaatgtcaatcaaaataaaatattctacaaattcaataaaaagttgtctcgttctccttagaacatataatgtttaatgcaaaagaatcctgagataaaccaaaagttgttaaactatacaaataaacacattgaattcagaataaattatagaaataatttggtttttaagctagatttgaatacaaacacagggttttcccctaacacggagtttcctccttcaaaacaccagaaaaagcaatccgacatcttaattgccttctacaagtctgtcacacaacctatatatcactataactgtcattaatccgaaattaatataaaaataaatgcttaacaacttcctaatacaaaattatagtagcctaattcaaaacttggcctatcaaaagccaaaagaaataaaacaaaacacataagcccctatgtcgtccttcaacatgcgaagtaggttttcagagcaatgaccaactcctacaacagagtaaaaaactaaaattttatctgcttttacgtgaaagcacataaatataaagcgtagtttgaacaaacactataaagaagtagaagaaaacctgtaagactactggcacgcttttctactgttgaactttctgaatcagttccagagataaatataacatctgttgtgaaagaaaatccaccaataatctgtagcatgaataaaagaatgagaagtgcatatgaatatgataggaaaaccatgatattatccctccaggaccagaactttttgtttcagaaggtgaatctatcaaacttgatcagccattaacaagtaatccaaatgtgggtagatttggtcagggggatgcggaaatagtacttcaagtttgaagagatgaaatggaatgggatatactattcaattaagctatattcaataggagaaatagagttaggtccaagtcctgtgggcttgcctcaactaatgagactttgtaacaaggaaaattagtgacaagttagttagtaaattttactgatataaatagaatgtagaaagaaaaaggagtcccttttaattggatatcggaaatcattattccatgaaagaattcaccaataaagatagttccattctttctctatatacttgtattgcctgatacagttccttagagaatcttagaaaagtgtaaacgctgtattacctgaaaaactaatacatttggagaatcatctgatgagtcagatagcagcaatcgagcatgcttccttatctacaaagacatgcacaaaagcagagatatcaaagcaacacccaaattaataaataacttccataaccacatgctcttgaattacatgaaaattatatcatcagataaattgaattgaaataccctaacatacttgtgatgcaagattttcctcaacaagattggacaaattgtgaaagtgaggagtgtgaaatccagaataatgcagttccaaatcatcctaaaagagaaaaaacataggaaagtgaataaccggttactaccaggcataaattacagataatcaacatagggcaagagtggaaatggtttgtatgggataattaaaggtcaaaggaaagaggaggtatgaaaagtttgatataggtagttaaaatactaaataagggtgtgttacatgtttgctttaaaatgcggagattcataagtttagcatattctttgactgtttcaaagaaggaaacatgatcgtggactcttctttaaggaattgtagtatgactgtatgattaattaaccatgaactccaaaaaatgtagtacaagtaacagaatatttaatattcaaccataacatcacttcctagcattaccattgattttaaatgtagctgccaatctccaatgtcttctcgagagccagatgccaccaaagaatccctatgaactttcaagttttttctaattaagtttagagcattaccagcttcatcagccaaatagaaaaagacctgggcaccgctcccaaattcctcattccacttggacctgaggttggaccacgagaacaaattccctcaataaataaagtcactaaataaagcaatactaagagaggcagaggactcattaatttaatcaaatttgtttatcctaagaccccgtaggaggtttttattttattatttttctttctattttgatagtttgaataggttttatgcatttatcaaaaatatgaatggttcactcgtacaggtcaaaaataagaaacttgagccggaaaattaagatcagtgtttttattttatgtgttgtcattcgtcttgccttacttcaacagacctgctaggatctactttactataaggaaaagctacaaacaaaattgtttagcctcaatacatatatgaaaataatttgaagttgataacatcacttacttatcaatttgcacattaattcgaactgcccaatcccctccatagccactgccttccacttttgattttaaaaacccagtggtgatggccatgccatggtcaatcagcacttgatgtccaaaatctcgtccattgtgcttagtccaaccataagtactaaggttatcctcatgtttgcaaacatgtcgcaagtgatatctgccgtccttcacaacaatccacattaatcctgcaatcaaagattttggagtcctgaaatacaaagaccaccaccaccacccaaccaaaaatgaaagtaagaatgcttgcttgcttgatgagtcaaatgttgttgaccactttctctatgatgcacggtttgctgatataaatcagttagatttcatactacacaacacattcattataattagttattgcataaggagaaaggctaacaacatagtcttagagtgtatgtcagaaagtacaatcctcttggattaagtgtgaaaaatatttctaacaatcaattattgttataattaattatgaaaataagttttaaaattagatatattagatgaaagtaatttgaaaatattttgttacatttgaattgtttaaaaactattttttatggtaaaattagaaaaataatataaaattatttcaactaattagttttatagttaaaatgattaattcttgaaaataaaatagaaaaacaaatgcctgtttggtttaagcaaatgatttttatttttattttctgttctatttaacttttgtttatattttatttcttttttatatgatttgtaaaaaaaagtannnnnnnnnnnnnnnnnnnnnnnnnnnnnnnnnnnnnnnnnnnnnnnnnnnnnnnnnnnnnnnnnnnnnnnnaagttctaaaattttgcacctaataatgggaaaaacatcatttttataatttttccaaacaattagattttcttaaacaaaatgttttaaaccttaaaaaagtttctacaaaattaatcatatccaaacatccactttgagtgggaaaaaataagcccaaaacatttttaaaaacaaaattatatgtttgacaaaattatcaaaataaagaaaaagttgtttttaatataaaatatttactacaaacaaaattttaaagtttataactaaaacgtatcaattatttattattaaagttttatttttctattttatctcaagcaattaattaactaaaatgtaaaattaattattacaaaatatttcaatttattttctaatttcattgttaaaaaaggaatttattaaaaaatttaaagaaataatttatttaaaatttattcctttttaataattaattataaacataactcaaataatgttttttagctattaaaaaaatcaggtctgtttcactacagtaatacagtgtaaagtaagaaaaatatttcatggatacccatgctataatacatctacatttcatgagagagaaaaatataaatattataaaatttatgatatgataaaaaaaaataaaaaatattagtagaatgtttaaaataaatgagtatttgtatataattgctgataaagaaaatactcaaaatagaatacctggtacgaattccaagatagagctgaggacgataagttccccagtacaaactctctttgtgctcaccttcaaactgcaacaacgccaaccaagtcattcttctttcttcacttcacgtacgccaaaatcattaaattatcaaaaaatggaaagaaaagaaaaacagcaatggaatacctgaggaaggtccgttatctttggcgcgggaaacggcgtcacaacgcgaggaatacgatcttctgcagctgaattggcgaggtaataatggctcaaaaacaagacgataccgaacacaactttgttattgtcattgttgaacatgtacatcagattgaagcttcggtgtttgcttctttcggaagacgatctctctccgctgtgagtggttcttcttccatttccggtcattttaagtgcagacagtgtttgtgttaactgtttagcagggtaacgtagcggaagttcggggaaggaagaaacgagggagtgaagtgaagtgaagcaactttttttggtacttcaaataaaattctcatttcgataaatacaaatatcttctacttggagtttgatgcatacgtaagaaatgcaattgaaaaagttaagcttttttcttaagagtttaattcgtaagtgtacaaccaattaaaaataattgttggtaaaactttatgataatcattatgaaaaaatgataactatatttttcttgcacaattattacataaattatgagtttttttttttaatttggataaattagaaaactatatactgtaaaagacaaatacaccattattaattaatggtgaaaatcatcaggtagttaattcaagttataacatattcaatttccctgacgtaatgtcgttggttcaaatttgtagaaaactgagataaatcgatccgtttcattttatatgattcttaagattttggcataaacattaaaaaatgtaattaatattttgaatttcataaattatattatgtcactttctaatatactatttgtgtttctaattaattacatttttctcatttattacacaataataacttttttatcttcaataataactattcttgctaagggtattccatgaaaaatatttaatgtttcattattttttaaaacaacaattagtttgtaattttttttttaatttaaacgtcatcagaaatgaaaccgaagaagctatattatagatgtttttaactcaaataaaaatttatgggtgatttagacaaactctactgattacctataaaaatatttgggataacaataacaaaaaaatataacataaagaataaaccaaagttaatgacaaaaaaaaatagggtggaatcttccttttatttttttactttttttttataaatccttttttatcaataaaaataatatcattagcttaaaatagtcatattttgacatttgccctttctgaaaggttagaaaaagaaaatatacaaacattttggcatttgcaattaaaaacgttcacaaattcaaaaagagttggccttcggtgtggtcaaagagatgcaggcaattacaattacacttcatgttacttattttacttgttaaatttgtttatccactcttacgaataaaatagagtcaccattttaagatgaaataatttttaattataatattgctttaagacatgtaattttatgttttttaagagattatatattcttcaatagagagtaagagaccataactttccttacattgggaatgattactatataagattgtttctatttatatacaaaattaagtgttcttaaatttaaatatgattaaactgaaataataccgtggcaatttatttatttatttatgtgctcgataaaaaatattactatttactattttttaccttttatatttatttaaaaaatttaattatcaagtatacaaaattaacactatacgttaaaaaacaagttgacttttatatatatatatatatatatagatagatagatatatattagaaacaataaaatcaaatgattcaatgaataatagaatgagatccacacaaaaattttcaagttttagtcagttagtttgaatcctactttacaaaatattttaagttttaatgactctctcgttaggtaagacttgttacccaactttttagtacttgccattaaatgttgttgttgtgatattgaggccttgttgtctcgtgataggagtgagtcgcacttcaaaagaaacaaatgagtgtgtggattgattgactaaatttggaacaaaagagatgtttcattttaaaatcttcgaaagttaatctcctaaattatgtctatcattgaacttgccttctgatatattgagcgaaacttatattagagtagtcttttgtttgtctttcttctatcaatctagtttttaattgtactttcgttaaaattgagatcttcaaacgaagaagtcggtagtgccaaaactcttgaaaggaatgtaaggtaaggtgacaaatataagaattatcatatacccatctcaacattcttgaaaataaaaattttaacaaggaaacaaatccaaccttcatatagaaaataaagccaccaacaagaaacaataaatgccagacccgaaagaagaagaaaaaattgaggtaatcatattaaccgtagtagttcaatgattctaaataaataataaataaaaaatttccttgaggcattctatcaagcatatgctacagtcgaagagtctacccatgattctaaaactttaaaaagaaaattgttatcataattataatttcccaaatgaacattatttcactttatatgcatgaattcaaagatccaaatccaaacaaaatctaattgagcaatttaccattggatttcaagtacgtctaaaaccagtagggaattaaagattggatcaattaaatacataaggtcaagaaaggttgagttcaatgcacaaggtaagagtgttgctttatacactatataatatttctaatacactatatatctatagtgcaaatccgaaaatgcccttctcattattttgcagaaaatccgtatgcacatcccttggcaattacggatcaactaatccgtcctatcatccttggccaattacggatcatgcgatccgtgctctcatccctgccaattacccatttcataaattaaaactagcaacatagcccctatggatccaatgatccgtatgcacatccttggcctaataaggatcaatcaatccgtgtgtgtatgctggcctattgcagatcaaatgatccggacgcgcatcattggcaattaggcaattactaggcctactgcggatcaaatgatccgtacgactgtcatttggcaattacggattcattaatccgtgcccatcatttgaccaattcggactactaaatctgtgcgcattccatggccatcatttggtcaattacggatcattcaatccgtcagcattcatggcctatttccttgcttagcacggatcaatggatccgtaagcattccttgcttagcactgattattcaatccgtgtgaaattcattacggattattaaatccgtgggatttacacggattcgttaatccgtaacatgacatgaccaaaccggatgcattgatccgtattttatacactataccaccaacgaaacataactttactcacccagctgaaaatggcatctccgacgagtcctgagctcaacccagctaccaccgaccacgacctacctcctccaacaccaacagctccaatgcacaacaaaatcgcagcaagggaccaagcaaaatggaaatcgcagcaacggagaaagtaaaatggagagcacacagtgataagaaaagcacagaataaaaacaaacaaaaagggcagttttggcattttaaaaaattatatagtgtattagaaatattatatagtgtataaagcaatactcacaaggtaaagagtgaggcttaacctgatggtacgaagacccaaagaggatgggagcatgggccttgatagtacgaagacccaaaggcccagatctctgattgtgtgttttctcttaagtacagcacaaaacccaccaaaacaaattaattatgactccacacgagagattttacttgtgtttaaaaccataaagatatttgtttttgcttgaaaaaatctagatacaataactaacagagtaactaagatatcaatgttagttaatggaattgaaagtgatattgagtgcattttttaatacgtgtttgtaaaattaattttaaattaatgtgattttataaaattgattttaagttaagttgtaaatgttaaaatcatacggattgcttgatctgtaacactcttacggattaccaaatccgaatgccctccacggattccataatccatacgctgcacaatccttcctacggattgtccaatccgtttcctacccacggatcattcaatccgtacgagtccattttttaaaaatctgtgaaaattggcataggcagcagcatgtaacagcttttcaacaatgttatggttaatttgagaaactacaatggtgtatgtggtatgaaatatggattataagctttgtttaattgtgacattaacttatgaattagtatgttatttgagaaactacaatgttgtcaaacaatcctaaacctaaatagtacttcagtttatggtaagcacaaattcataattgttttctacatagtcattaggatcgctaatcagtattttgttctgcatcaataccctaaatcattgatatagcttctgcattgctttgggtaatagacatatgagtgttttttgatgcaggtcatgcaacatgttagcaaacaggatgttagacaatgaaatataaatgaaaattaaatagccacttatgaacagcaaaatatgcctaatactgagttcaaaattcaggatttcccaattgccaaaccaacaatcagtgcttatattcaccacatttttgacatgaatgcatggattatcatttggctgatgttttaagtttgatgttttgtttcttagttatgttactgtgacgactacttacccattgtgtgcatgaatatgtgttggatttatttttgtgcaggatatggtgaaaacattgaacttgcgtaaaaatctagggaggcctgttgaagcagaggaaggcgttcaacgccgtaggcctaccgcctttgctagaaggcgacgagcagctggtcctgttcttcaggaaccagttgttgaggaaccagttcttgaggaagtgcaggttgaggcagacacaacacatgtcgcagatgacatagttagtgagttggaaggatttgcaggtggtccggaagaccctaccattctgaaaggctttggtaaccacatcgcccttagagtgtgggccggagaggtaatgtgaccctgaagtgtatcctataatgatgatttaaatttaaaatttgatgtcgtataacaacttttctttcgcaggatcgtcctgagcttaagctggcctctcatggacgtaaggttgcgaagtttggtccccccgcacctgagatcgaaggattggtcgcttgtactgggttaagcccactggtttcagccttaatcgatacgggagaccggggattgatatccgcctttgtggagtggtggcacccagagactagtagttttcacctgtcgatcggggagatgaccctgacattagatgatgttgcttctctcttccacttgcctgtgatgggagccttctagacctacgatgtagttgacgtgggggaggccattacattattggtcgacttgcttgatgtgaccgtaactgatgcgcatgctgagaccgaacaatgccatggggcatatgttcgactctcgtggctccaagacttgtatgctcagaagtgtgaggcccgacagtgggttgtagcggccagagcatatttgctccaccttgttggttgcacactcttcgcgaacaagagtgccacgcacataagtgtgatattcttgaacgcttttcgggatgtggaccaagctggagatttttgctggggtgtagctgcactggtccacatgtatgatcatctaaactacgcctctcagcatcacgggaagcaccttgctggatatatatcactgttacaggtaattgtaaaacattatctaagttaactattattatgacatcatctaagtttactaagttcaattgttatttgataccgcagtactggatctatgaacactttccgaccatcggaagtgtgagtgctgatccttattatgatgagaggttgccctgggcctgccggtggaaagcttctaaggctttaccggttgcaacctacagacggcgattggataggttgaccatggatgacgtgtgctggatgccatacgtggaccatcgttcccacagacagttcgagatggtttcgctatttttaggtcaccttaggtggggaccacatattgtcagatatatgccggaaagggtgatgaggcagtttggttttgtccaagaaatccctgatttccaccactgtgatacgccttcagcagaggaggttgacgacatctggactcacttcgccgaccatcttgtccccactggagaccttgtcatttatcccagccaatgcgtcagtggctacatggagcggttttatcggatatcccatccatttgcccgtccgccagaggttggtgagcctagtcgacagccgactcgagtgacccgtgtgatgcatgatccccctcatgttgatggcgatggatgcgttggccagccaggtccagttcagccaggatcagatgtcactgacatgccccagcatgaagtggtagaatttcctataaacatttcttttacttatattttaataaattgacacttatcaaacacctaccaattttcatatgcaactgtgcgagcccatttcaatacgtcctcacgggaatcaaacacctaccaaaatggataattcatttttaatcaactaaattcattcatttaacaacttaaagtaaactcaacttcatatccatacctgagatgtactgaaagctgcagaacaatccacaaaagaattatcattttctggggcatcattttcttcttcaatgtcctcattcataatatactcgtcatacataacactgtcatacatccactcctcgtagttcatcttcacaaaacaaaaaaagattctaacatgcccaaccgacaattacgcaaactcaataatatttatcaataatgcattcacaaataatcacaaattacgttgaagcataccatacttaattatctaatttatccatactcattcatcatcaaacttttcaactcataaacaatttactttttaataacctattttaaatttttttaaattatttttcctttttttacaaaataacacatacggattatgtaatccgtatgtatataggtaatccgtatgatacatacggattacataatccgtaatagtaatacggattatgtaatccgtatgcatcatacgaattacctaatccggaaatgccatgatattgcctaatccgtaagtatcgtatggattaggtgatccgtaagtagcaaacggattatgtaatccgtacaatacttacggattacctaatccgtgtgctacttacggatcacctaatccatacgatgcgttaacagcagctcttacctttttagaccaccaccagccgccgacgaccaccgctaaccaccaatgaagctccgacgaagctcaaaacaatggatgcactcacaaagttacctataccagcagccacaacaacggaatcgtaaagcactgtgcaaaatcgacaactgagttgaaaaagcatggaatggcttaatattgtgctggaagggtactttggtcattagcagaaatatatagtgcatgttgaaatttatatagtgtatgtagaaattcccaaaaattggggttcatgattggacccacgaaactggttgggcttacttacttgtggggactccgagaaatcctgaacatgctcctagtccagattctaaacattcattatgctgctacagtcacaaatagatatagaccatgagtatgagtatgagtataagtatgagggagtgtaatagacaaacaaatgaacattgtggatttcaggggccatgcacttgtagttagctggattctttacttcccagtggtgttgtagctttcatgcaaagaacgtggcctctattacctctcttgtaggagacaatcacgtgccatccatgatccatcattaactccattctacaaagtaggtcatgctattttatttctattttttattttattgatcttggtcaatgaagataataataacgacagagttttagaagttcttaattaatttatgcttttcatccaaataaggggaatgtttacctgcattttagtaatgattgccataatattcctcaaacgaagtccacacagtttctaaatactcgttaaatgataacttgatattgcttaatccttttagacagtttaagcttaatttacaccatcattacaaaatcatacaatcaaattggttaaagtagaaaggaatgtgaaattattcaaattctgccaaattattcttgatcgttgatacaactatgtttctttcttctttttttttttcttaaataaaagggatgatgtattacgtactaaggtgagttgtggagaaatcataaaagcagtccgatggagaggggcagatgctaagggggacaagcgtgccccggtcccttcccttaatttttttaataatatatatatatatatatatatatatatatatatatatatataaacgtcatacattaatgggaaaaaacacttgattagatttgttctcttagatatattatttgtctatgctcaagtaggattcgtactactagatttatccacaagtaccgaaaattaacatacatcaacagtgttttatattatcatcattatgatgaaaaaacttacttctacaacacccctttaaaatactgctcaacaatattcttacactttcatatatccatttttctttaatgataaaaaaaaaattatagatattctcatacgacatctaaaaaaacgtattcaacactaactcatgaaaatagaatatttgatgaaaagatctctagtggaattttacaagtcaatatttggtatgaactctcctaattaaagactctatcattcaagtcgatcggcatttacaggatttctaaggtaaatgaattagagaatgtgtgtaacttttgccttttatgttagtaacgagcacgagcttttgagttggtactttttgcatcatgatgtgtggattaagatgttgggttgcttttcacgagatcatatattgagtcttatggttttggagtcaaacaattttgttttattttttctcttttgatttcatgaactgaagtgagcctataataatagctcagaatgaacagcatctaacttctatgcataattgttctcatcaatcaacccactatctttgaatttaagactcattttgtattgagaaccatcaacagtttaatcaccactatatctaatataattaaaataaagtttaaatatgttggagatctctaaaatagacttgaattttacaactgatctttgaaaaaaatttcttttttgttaggtccctaaaacttcaaaaattttgtaagagattcatatcgttagtctctgtccaaaacataatgatgtgtccgttagttagatacgtcaataatataagtatgaagccacttcagacgtccaaacgggtgaactacatcgataccatcttccccacctcctcccccctcctcggttggttctccacctgccgttcccccctctctctgcccctccattttttttcttttttctttctccctttattgttgtccctttcacctcaccaactcctatagcttcaacatcgacgtgttcttagatctttaagatatttgtttgggtgaaaataacattttttaactagaggtatgaagagagccattgccttttcacatttgtggttttccatatcattctctgacaagtgctttagttgggggcaacggcttcggagtggatgtggtgacgatgaaatgacattgtgctcacttgatctggttgtttcgacgtcatggttctcctactctacctccctattgtcaatttggttgtttcacaaaagctaaaccctcaagcaaaagccccttttcagaaaactccaatgtccagtaacatctcacacaggaagaatcgatgtcgatgcagatgttgctgtgatgttcaatctttttcgttgatgggaatactagacgtagagcaagagatagaaggagacaattacgtcgatgcattcacgtttattgtcgtgaagaggaaaaaccttgcaggatgttgcacatgacaatgaacgatcccaatgtcaccggcaacagagaagacagagataagaggacaaagggagaaagaaaaaaggtgtaaaaaatggaggggtagagggcagagcagcaacacgtggagaaccagtcaaggagggggaagaggggaaggtgaggaagctagtaatggtggcgaggaggaggaaacaatgtagttcacacattttgacatcgttattgttgacgtgtccaattaatggacacgaccatagagatctccaaaatttttgaaattttagagattcaacaagaaacaaaaaaaaaattctggaatcaactacaaaattcaagtatatttcaatgatctctaaaatatttaaagtttaaaataaaataaaaatatttcttcttcttcatatattgaaaaagcaaattattaatgcattttgttagaaaaaggttgctagttaaatgtataataacatgaaacgtaaatattttattttacatggtacaattttgagtcagctttatttttaaaactaattatttattatttataattaaataaaccgaatctagtttcctacatagaattttctctactaaaataatttaatgaaaacaatttccgtattatataagttctaacgtctaagtcaactaagtgacttctttgaaaggaaatatcagtcggccaacaagtacataaacaaatatctaagtttatgccttccaaaggttggtgatgaatcgctctcacggataagggttggttttcatatatatttagatttttcagccacgagaaaaagatttgcttgtttgatacttgtgataggtgaatcagaggaagagtcgttatttatttggaatctagtgacgttagattgtgatcgttaatctataatataacataacaagtcatgaacttgattatttgggtacaggtgatcattttttaagcaacggaggaaatcttggtcgtaaagctttaggtaatcatatcgttcacatgaacatcttaattcaaatatgctattgtggtgcttaaacatataaaataaatttgttatttaggtataacgtgaatttgtggtttttatttatttatttatttatttatgtccagtggttctgataaaaaaatgttcagaggtttaggagttgatagaatttaatgcagagagaattttagtatttagtaagttttttttttttttttttttttnnnnnnnnnngaacttgattatttgggtacaggtgatcattttttaagcaacggaggaaatcttggtcgtaaactttaggtaatcatatcgttcacatgaacatcttaattcaaatatgctattgtagtgcttaaacatataaaatatatttgttatttaggtataacgtgaatttaaggtttttatttatttatttatgtccagtggttctgataaaaaaaatgttcagcgtttaggagttgataaaatttaatgcgaagagaattttagtatttaataagtttttttttttttttttctggtgatatcaataaggtcacccagtttctcgcttctcataaacatatttgaagcattgatgaaaggtgaaaggttccacggcgtggatgagttgctgactcattcttcaaaagccacgcgatcagattcccgaaaggattgtcttgtgccagaactgattgcactaggagaagaaaatcaattgtttattcccattctcttttaagtcagggattcgtttaaagccttttgctaccattacaacaaaaacaatgacatcagattcataattgttgctataaaacttttctacaagatgattattttttattataagtaaaaattaaagataaataaaagatgatttataacaatttatatattttattcaactaattaaattagatttttttaattttatacacgttaatgtaagtatatgtttacattattaaaaaaaatatttagtgttattattattattttcattttatcattaagctaatatcataaactacatatataaagtaaatgagaaaaacaaatcacaacagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttaattttttcaaaaaaacaactataaaatttagaaatattaatgtaataacttaatactagattataagaatattttgtctatacatacacaaatctgattttttaatgcaaatgcaacaaaatgatcttcgttcaagacgtcaaaataccatttgaaaccaaacatgatagcaccatgtcttttttatttaggattgcaccatgtttgagacgattaaacatgctcttaataattttggtcaacaaaatttctttcgaataatcaaatgtatttttctgacaataatttgttcgtcctacccataaataccttttaaagtctttttactaccccttgttataaaaaaaaacagacaaactttttaccccttcaaatgtgtctactccttttctatcgtttcaagtttttaacattnaaaaacaataactttgaacttcttataatctgtgtaggtagacgttacctaaatttttgagacattgatttggtgacaaaatcttataaaaaactgagagatgaattaagtaactaatttttttaaagaactaatgtgatgacgtttgtaaatttagaggactaaattaaaagttttcttcataatccaataaaaatgtaattcttcaaaagacttcttttaatgattttgtattaaagtaataacgcatttatctttaatatataagtgtgttaaatttatgaaagtttatattaaaataagaactgatatattattaccttctcacattatactatttattttatcttatgaaatagtaaatatttgtgtaagtgttctagagaatttatgaaaataatttataaactacccataagttgttttaatcttattttaggaatcttttcacgataatttatgaaaaaggattaattttatatgaaagcaatttaatcttatttttttcatttattataaaacaatttatacatatatatatatatataaataaaataaaaactgtgtcattacatgtttaataaatatctaaacagaaaaataatactactccactaaaaaagaatcttgtaagccattaataatcaaagcattcttacaaaactagatgttagaagtaatcatggcaaaagtatatttgaatttgaatttaaatttgaacatgaatagtaaaaatgaatccattgaacttcttccaaatttgagaaaataacagggagggacaaaactgtaattgcggaaaagtcatgacaattcgtcaattccgctgggggacaaaaacaacgcgaaaaggtcggtcggcaactgtgggccggaattgaaccgggggagataaaagcggcgcaaattctaactcttctctttcaaaaacaaaacccatttcaaaacgtcttgtaaccaaaactaatctcaaaacaaattaattaacattaacaataataaattaataattgttcatcctcaaacccatccacccaaacaaaaaactcaaacggataacgcaatacgtaagactcttctgagcctttatatatgggagaattatttatctaataaaggaatttatatttaattttgatgtgttaaattcttttgacccattataaaagaaattagtcggagtctgaaacacctttagtgtatgatccacaagactaaaaaaaataaaatcatccactcaaaaaataaaataaaaaacaaaaatagacactttggttttaattcccacttaactaacaacaaagtttcttaaaattccactctccaataaccatatcttcttcttctctctttctccctctaacttacttctcactgctctatccacactcaccctccgattccaacaccaataccctaattccgctattctccaactgttttcttcttcttcttcttctttcgttctctctctctcttttttatatgaagcctccttggctgtgatttttacttattactattatttttcagctcggtatgtcgttttgcttctaaaccctaatcctaatcctgcagattttactttaatttgttttggtgaaagttctggattgatgaaactgctgtatcttttaaaatcagtgttctgcttctgatagattgcgatgtttgtgttgtttccaagtgtgttttgaaaatttagcgacctttacaatctgtcctttttttttttttttcttgtggcctattattcagttcggtagaaaagtgttgcgaaagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtagccgttgtttgtttgtttttattttctctgcctaaatggaataaccatgcctgggatatcatgatattttataattttataaattatgctctgcaagtaaaacaaggttgaatttgttgttttctgcttcctgattctttcaaagtttactgaaatttgattcgtgtgtttggcctttagtgatttactctctgcttacttcataataagtcttgatgtaaggaaagattagagagactgattgtgttttgaatttcgattctgagctgattttttatcgttgttttttttttttttttttnnnnnnnnnnnnnnnnnnnnnnnnnnnnnnnnnnnnnnnnnnnnnnnnnnnnnncagtagaagattatttggtacctaagttaacgaagaccgtgactgtgaatgatggatgttgctgaggttgaggaaaatctgtttgccgcaagtgatgccaaggtatgatcatgtctttgattattttgtatgctgttttgggaattgcttttacagcgtgcacagtcctcatgccaaggtttaattgaagattcaaatctgttttgtattaatttctttatgttcttcatttaattatgtaggaaaagaaaacccgtttctttattattgttttcctagttattgtatgcattcagctaagaaaacagttgaacctgtctaccttttaaggtgcatgaacaatctttttacattgtcatcgtatctgctatttaagccaatgtttttcattgctggcctaatgaaaaagaaaaacagcaaggggatgtttgagttctgtttttcttgctctgtttttttttgcatttgtatccaattcagttacaatttatttttattgtctgtaatgtagtctgactaatatctatctggtttcttatgcagttacatggacagatgtgcaagactctttctataatatattgcaaagtattgtctgtatttccttctttagaagctgctaggcctaggagtaaatctggtattcaggcattatgttcattgcatgtagccttggagaaagtcaagaatgttcttcagcactgctcagagtgtagtaaactttacttggtatgatttatttcttctatagttttatttgctgattatgtttctgagtacagtttttattttaccttatcccatgaagcagttatctcttcttggcgggtaaaattatttaacctgaaatacatttttgtaaaatatcttacaaatggcattaattatgatgcaggctataaccggagattctgtcctcctaaaatttgagaaggctaaatgtgctcttgaagatagtcttagacgggtggaagatattgttccacaatctattgggtgtcaggtaatattactcagcagcatggctggtgctgtaaacttttttttctccttgtgggtggtggtggttagttttaggttcatgatccttttattataatattatgtggagggtcttactcattcttgccaattgctgttgtgatcatatgaattctaggccctattgtagatgttttattttgttattccaaaataattgaaatattgaatgcaccttgattacattactctgggtttggttttctgtaacactggcctttgtatattcaaatgcacaaaattctctccttcttgttatcattgtcaatgttgaacccagtctgaggtttgattgatttcctcttcaggttcaggagattgtgaatgaatttgcgacaatagaatttgcacttgacccatcagagaagcaagttggtgatgacttaattgcattgctccaacagggaagaaagtttaatgactctaatgacagcaatgagcttgaatcttttcaccaggctgctactagacttggaataatatcttcaagaacagctcttgccgaaagaagagctctcaagaaactcatagaaagggctcaatctgaggaagacaagcggaaggaattaattattgcatatcttttacatcttatgaggaaatactccaagttatttagaaacgagttctcagatgacaatgattctcagggttctgcaccttgttctcccgttcagggatctattgaggatagtgttcctggtagtcattgtcaagcctttgacagacaactttccaaattcagttgctttaattttaaaccaaatattagtaggacatctgggcagctgcctcttccacctgaagagttaaggtgtccaatatctctgcaacttatgtatgatcctgttatcattgcttctgggcaaacttatgaaagggtttgtatagagaaatggttcagtgatgggcacaacaactgcccaaagacccagcagaaactttcacatctttgtttgactcctaattattgtgtcaagggccttgttgctagttggtgtgaacaaaatggagttcctattcctgaaggccctcctgaatctcttgatcttaactactggggattggtattatcagagtctgaatctacaaattcaaaatctgtcaatagtgtcagctcttgcaagttgaagggtgtccatgtggttcctttggaagagagtggtatctcagaggaatctgtggaaaatggaactgaaagtgtttctgcacaagaggaagacactgagcagtattttagctttctggaagtcttgactgaggggaacaattggaggaagcaatgtgaagtagtagaacaattaaggctgctgctgagggatgatgaagaagccaggatttttatgggggctaatgggtttgttgaagcacttttgcagtttttgcaatcagctgtgcgtgaaggtagtttgatggctctggaaagtggagcaatggctctcttcaacctggctgtgaataataacaggtctgctttgtatttctagttttaatcattaagtaaaagtaaaactgcttttcatatgattacaaaatcaaaataattcttgatatttgagattgatatttgagaatcacaaccttgtgttttagccaaagccattgatgatcaaaactgatcactgagatttgcatagtgctagtggatgtaaaaaattgatcactgcccacattgaattttgttcgttcagttaatatgttctaataataaatctggcttaaatttaccaatatggtagagttgatgtttcattagctccttctaaattcacataacttttgtttttttttaacctctgcaaactattaacttgaggttgatctttacttttcaacagaaataaggaaattatgttatcggctggagtattatcattgttggaggaaatgatttctaaaactagttcttatggttgtacaactgcactttatttgaatctctcttgcctcgaagaagccaagcctatgattggcaggagtcaggctatccagttcctaatccagcttcttcaatctgacgctgatgttcaatgcaagcaagattctctccatgctctctataatctttctactgtgccctccaatattccatacctcctttcatctggcatcatgagtggcttacaatcccttcttgtaggcgagggggattgcatttggacagaaaaatgcgtagctgttttgataaatttagctacttctcaagttggaagggaggaaatcgtatcctctcctggactcattggtgcattggcttcgatattggacaccggtgagctcatagaacaggagcaagctgtctcttgtctcctaattttgtgcaatagaagtgaggaatgttgtgagatggtcttgcaggaaggggttataccagcattggtttcaatatcagtgaatggaactccaagaggtcaagaaaaagctcagaaactcttgatgttgttccgagagcagcgacgagacccttcaccagttaagacacatcagtgcccacctgaagctagcgatttgtctatgccgcctgctgaaatgaaaccgctatgcaagtccatttcaagaagaaagtctgggagagcttttagctttttctggaaaaacaagagctattctgtataccagtgttaagttccattggttgttgtaaatctgtgttagcatctttacttttgtggccctgcttttatcctcctcccgtggggtgctgcttatttttggttcaaagcgaagaagatatgtacaggcctttgtaatttatggattttgttttcttctttcgctttcctctttgtaatatcatttttccaagtattgttgtttttcttttctttgttttttatgttcgagggtgtttatatttcaatggggcttcaattcttaggcttaccattttgaagttaactgtgaataataatatcttaaggtgtttcttggtgaacaaactataaaggtcacacaatagtagttagtaaagagtgcaagttttcttagaagctagcggatgtcgctttagccattagtttcagctttaaacagtcatgcttcttctttggtccgtgtttcttgattgctttaccgcaattcttctcaagtaggatttcttataattccttaaaaaaagatgtcttatataattcattttgaaacaccataaacgtcaagtaattaactatttctcatgaaattaaattaaatttctcttataattatactcagtcacttgatttatcacagtaaaaaaaacaaactataaaggtcacacaatagtagttagtaaagagtgcaagttttcttagaagctagcggatgtcgctttagccattagtttcagctttaaacagtcatgcttcttctttggtccgtgtttcttgattgctttaccgcaattcttctcaagtaggatttcttataattccttaaaaaaagatgtcttatataattcattttgaaacaccataaacgtcaagtaattaactatttctcatgaaattaaattaaatttctcttataattatactcagtcacttgatttatcacagtaaaaaaaacacattatagaagtcactaaaaaaaagtttaagagcctccaaaattgttattaacttaaacaaaataacatccattttgcaagtatcatcttttttttttgtcattcatttttattatattttataaattcaaattcatcactttttttttataacagaaacatatttttaaagaaaaatagtaattacaaaatgtaatttaattttttcttaataatatttcttattaatattatgtatatatcttatctaaatctaatctaagatatatacaaatgtgaatatacatataaagataatattttgaaaaacacataaattaaataaatattcttataactatttatatttatacaatataaaactgtaataaataactataatgtaaggtaggaattattaactataatgtaaggctagccttttacaacatttctaaaaaaataattagaccgcggggtggtactcctttaatttgattgaggaacatcacgctcagtcacttgcattacatctttttgctttctcgagaggaatacgatggtttctcttcccatagttcaatatgaagagaaaatcatcgaaactgttgagcgcaaccccgttgtcgtcgtcatcggagagaccggttccggcaagagcactcaactctctcagatgctccaccgccgcggctacggcaaaatcgccgtcactcagccccgtcgagtcgccgccgtctccgtcgccaggtaactattcttcattttcactgaattgtgcgtaggactcctcgcgtcgtgtttccgtttctcactaagacgtggccgtttaaatcccgcagacgagtcgcgcacgagctcggcgttcatctcggggaggaagtagggtacgcaattcggttcgaggataggacttcgcacagcacacacataaagtaattgcgttttcgttttttattattccattgacttcacttggttttattttcaaattgtctctgattgtggttgatttgattgaattaaggtatcttactgatggtgtccttctccgagaaagtttagctaatcctgagttgaatgagtattctgtgatcatattggacgaggctcatgaacggagtttaaacacgtaagattattgaatactgtgtgctcttgttgttgtcaagtgtttggtgtacaattgttctgcatgaaactttttatgattggtgtgtttattgtcagggatgtattgatggggctaatgagacgcttggtaaaaatccgttcctccgatctcaaggttttgatcacgtccgctactcttgatggcgaaaaagtatctaagttctttgccgattgtcctgtattgaacgtcccgggaaagttgtatccggttgaggttctttatagccgtgagcgtccctcaagctatcttgagtcttcgctgaaaacagctcttggtatggcatggaatttgaaccttatcagcgtgttaagttaaatgtctgcttgggtcaacatcaacatcaataacacctttaatctaagttaattgggatcaatgatagatgaacacaatgatagatagatgatgttgaaaaaaaggaaggtaaaagcaaagaaggggaaaaggagaggggagatgaagagaaaaaagactaaaaagagactatctaaaacttagagataacaatgggtctaaccctccaccaaatttataactttttttcattcgatcctaagacataccgtccatcaatctatatctcactccattaagtcttgtttaattacatttcctcacgtaagtttcggtctacctctacctctcttttgtcgaactcttggtaacaaacttttgtttttatgggagtatccaagggttgtctcattaaagtgtccaaaccatctcaatttatgtttcctcatcttttcactcaccagtactactgttctctttcatcgaatatcttcattttttattttatccatcttcgtataaccacacatccactttaatatcgtcatttctgctatgcttattttatgctgatgttgcctatgtgttggtcaacattcaactccatataacattgcaggtcttacagttgttctataaaattttccttttagcttaagggaattttgcagtcacacaacaacccagatgcgctctgtcatttcatccatcctgctttgattctatgatttacattctcatcaatcccttcatcttttagcaaaattgatcacaggtatctaaaaccatctttctcggataactcttgatcaagtagatgcacggggtcttgatgatcatttcttactagtgaaaactcacatttcatatacccagtcttgctctggcttaacgtgagtcttttagactccaaagtgcttctccacaattcaaatttcctattaactccgtctttggtctcatcagtaagcacaatatcatatgctaaaagcatacaccacgacacttttttttgaatatcttttgttagttcattcatcactaaagcaaagagataaggactaagagctgaaacttagtgtatatctaccgtaataggagaataacttgacatttcattacaagctttcacatatgtggtagtcctatcatacatatccttgattgcatttatatactttaatggtacttttttcttctcaaaagtccactataaaacttttcttgggactttatcgtatgctttctcaagatctatgaacatcatatgtaagtctttcttcttttcttgatatcttttcattaattgtcgcattaaggaaataacttccacggtacatcttcttgacataaatccaaattgattttacagaaaccttggtctctgtcctcaagcgatgttcaataactctctcccacaatttcatagtatcgctcataagcttaatgcttctatagttagaacaattttggatatctttcttatttttgtaaatagacacaaatatacttttcctgcaagcatcatgttgtatactttgcttgcttttgtatgtaaataaatttgccttggcatcatgtagttattccaatgctatgtcaaagtgttaaatgtttgccttgccctttgcttattgataaaaacttatacgagacatacctattttttttttccgttaaggtaacatttccttaaaactggtattggctcttaaaagataatggccatggttaaaattgtttcatgtgagaacataagctgctaagaggggggatgcattttaaatctgaattgggaaatctttcgttcatgacttcatgttgatgtaaataatcacattcacttccttcagctcctttactgattgaatggcttgtaactctgcaagtagaaagtcaggaaatgttgtcatattcctgttgttttgaacacattccgtttcagatgtattatttcctttagttgtatttttatttttatttctagtgattgactaagtattggttttgcagatatacatatttgtgaaccggaaggggatattttaatattcatgactggacaggtgaacatttttgttatgtgctatttatcgtatacttttctactccacaatttaaatcttagtatgtattttgattataacttatttaggggaaatagccccttttctgttttgaagtttcccgagatagatttcctgtttctgtgtgtataagtatttgttttccagaactaacctgtatcctaaatccctcgatttctgatatgatgcaatgcaatgattgaacatctttcaatgatcttcatgtaggatgacatagagaagttggtatctaagttagaagataaggttcgtgctctcgaggaaggttcctgcatggatgctataatcctccccctacatggttctttgccccctgaattgcaggcaagtagttactcactctaggttccaaatacaatcacaattctataaactgatgtgatgatgcatgctgatacttcagataaaagaaacagcaattgtgagaatatttggaaaggcattttaatttcattcttatacataattcttagttttctttttagttctgtctataaaaaacttgactaatttgcatttgaagattgttgctggcttaggtgtgaaactgccttgagtgtatttctcttagttcattcctcttttaacttgttgcttaccttgtttgctttgtattacatctcaaatgatatttcttagcttgcaattaacactcataattgttccttttcatatgggggaaaaccttaaatatacaatggttggtgtttgagatattttatcccagaaaataaaatttgaggcattataatttttttggtgcatttgatactcgtgtgtaaccgacttcacctagtggggtaaggctgttgttattattttgtcgttgaaactcatgcatttattatttaatctttcaggtgcgtgtatttagtcctccacctccaaattgtagacgaatcattgttgcaacaaatattgctgaaacttccttgactgttgatggtgtagtgtaaggacattgattcttgattaaatattgttattttatgatcatcatgaagataaattattgtgtattattattgttgttgtaattgctattattacttattattataattcaaatgttttttttttctctctctatagcctattaattttcatcttaaccagagaagagattaaaagttcgttgaaaaccaaaatttcctgtaatacatttattgaataagtactgaagttcatgattaagctattcctgtaaaagcaatgtcaatattgcttaatgttgcacccagacgagtatgaaaacattgttggcaaaataatagtgagtgcttaatatataccacaggcctcagctggtgatgcattctatttctttctgacaaaatttaaaaatcacatgcaacaggatgtatcattgctttaacttattttttagattgcatatgttttgaggtatgtaactatgcagtttttgtaacgacaattaatttaaagactaaataggggtaggggggagataatgacatgtagcatattatgagatgcaactattgagacaagtcagacaacaaaccctgctatttgaattcacctattgtgatttggagtgtttttcagtcatttactcctttagatcaagcacataaacttgtcttctcatagtttctgaaactgtttttaattttatgaattttaggtatgttattgactctgggtatgtgaagcaaaggcagtataatccatctagtggcatgtattctcttgatgttgttcaaattagcaagtaagcaattaatagtttggtacctcgttgtggccttcataaatttttaaatacccaattcagtagcggtaagatgatttcaaataattcatgtgcagagtgcaagctaaccagcgtgctggccgagctggacgaacacgtcctgggaaatgctaccgcctatatccttcccgtgtttacaatgatgagtttttggacgttacagttcctgaaattcagagatcttcccttgctggcagtgttctttacttgaagtcattggacctcccagatattgacattctaaaatttgactttctggatcctccatcatgtaacatactatcttgggaatctttttttgtcatctcaaacattttaattcctttttatatttttgggggagggggtcggtccttatattagtttcttgtagtttcaaatattctttatccttgactagcagctagcaagttaatgagttttgctcaagtttactctggtgatttaataactgggttttctgcagctgagtccttacaagatgccttgaagcagttatttctgattgatgctattgatgaaaatggtgcaattacaagtattggacagaaaatggctggtacttgatttctttctttacattttagtgttgaatttttaatatctgtatgtagaactaacacattatgtaacattgttatcttcatcaagattttgataatggctttcactagtttaccatatttctgtctattattttcatagaagtttctttctgctaggcttgacatgaaagttgtgcttggtgttgaccataaaatttattcttttcttacccattcattttcctaatcatgtgtacttctcttggttccctgagttgtttcttgattctatgcagagcttccattagaaccatcgttggcaaaaaccttaatggaggcaaacaattatggttgcttatatgaggctttgactgttgctgccatgttatcagctgaaactacattgctaccagggcagaggtggactagtctgaactctgaagtttatatagatagatagagatagagagggagagaaagagaaagagtaggaggatcttatcatcctccacgttttcaattatactgaaaaggctactgtctttcaaataaatccattcttataaaatgtttaacaatttacatacttgtgaataattctactatcagtgaacaaaacaaatgaaaaaaaaacaggaacataggatgatgtgtatcttgtgttttaccatgacgaggcttatacgtttatacatcgacaaggactgagtaactgagcagtaacaaaactcctttaatgtgcagaaagactgagaagaagaggaaacatacaatatctaaccttcctgatggctccggattgggtgatcacattcaattgctgcagatatacgagtgctgggatcaaactgattttgacattggctggtgcaaagataatggcttgcaggtacctatatgtgatctagtaatgtcaactgtcaaggctgacataaatttgggactgagcttttgcaatgtagtctgttaaaaatgtttagctagaaaggctagtaatatccttgtggaatatttgtcttcactcttcacacatttgattcagatatagtatcctttaaagaaaaattcttatgggtcattgtgaaagacgtactgttatttcttgattataatgcatgcttgcatttttattttacctgtcagttatctaaaatttcttgtcttcataggagagccattctaaaatatgaagtgatatttatgtacatatggatcttttgtatttgttcaatgcataatatatgtgatcattctggaatcaactgattgaaggtgcgagggatgttgtttgtcagagacgtccgtaagcagttatcccagataatgcagaaaatatcaaagggttcgtattccacaatattgaggaatttacctgtataaagtgaataataatatacttttagatgctgtgataatgtcactacactagtaaaaacgaaccagcattttgattttgacacattcgtatcctctttaatctttttattcgttaattttaattgctcttttccttttgccttgccttcatccttattgtgttgatatgagcttgtttgtaatttgtataggattaatggggtcaaaactctttaagttttggcaaaactattggtttccactatatctatcatgttatgtatgttgtttcctccccactttacatattttttcaatctcgcaataggaccactggatgtaagggaaagtgggaaaagagaagagttcaggcaggattatcgaaatttgaggaaggctttatgtatgggctatgcgaatcagctggctgaaagaaagatgcatcacaatggttatcgaactttgggtttccaagctcatgtagtccaggtaatataagtttctagtcactattgcatgtcaccattacttttagcagctcttttgattcatgttgtgttaatataatatctcctttaagttttttccttaaattcttacacttttactgtgaagtccatatctaagggtgatggaacttacagaaatgtcccaatgaaaaaaaaagtctatgtactgtgaatttgtggaagttcagaactagtaactagtctttgtgaatttcaaccgaatccttggtttgtagatacgttaattttctgaatcttctatactaggtgcatccgtcatctgtgttgagtcttgatgacctggggaagttcccagactatgttgtgtaccatgaactaattgcaacaccacggccgtacatgagaaatgtatgtgctgttgagatgagatgggttatacctattattaagaagctcaaaaccctggatgtgtacaaattaaggtaggtaaatatggcagatgtgtgcagttttttttctttttcattttttgggtgggagggggggctatgatcattgatggctctaattcctttatctgaagcagtggtggtgttcatcatgttgaggaggaacctgagaaaaagcttccagatttacccaagaaggatgttgaggtggctagtactgctgatgaccgtgaaagtagaatccaagctgctagagaacgatttcttgctcgtaaaggccaaaaatgagcctgaaaggatgaagaggtcaaatacactagagatgatcttggcttgtcaggcattttattaggtggtatagttacctgaaaggatggaagagtctggatgagctgatgcttttgagttttccacgttgtcacaacaccattttcgtgctatgatgttatctcagcttgatcctcatcagttgtctctcgcaaacattacaagatttatcacagaaacctgagatttggtctcatactgttctgataagttggttgagtggctgaatgcatatatactttgtgttcatgcttttggtttgaaatatacccaggaagaagaaagaaaaaggaagaggaaggaaagaggagacagaaagtagcaaatccccttgacaagtaaatgttaattaaacagttaaggggttttgaaatgcaatcgtggatactgacatctgattgagataattacctttgggtggcacactttgcctgatagttaaattacatttttgtttatattgaacccgtttagatggagataatgcctagctgagattgcgttgggagttaaacttacaaaacattatggtagttatgtatatgaaacaggatcaatctttgtctaataggttgttggttctcaacctgatgatcactaattcaaggtgtctggacatcacctataatcaatgattaaaaaaaatgaaaaaggttttcaatttgggtcttagtctaaaaaaaagattggattataatcaaagtaatccagaaaatagaaatcaaatatatttgatttctactatttgagaatttgtccatttttttttttaatttcatctatttaatttgtattgattctaatgaatctaaaataataaaaaaaaaacaactcttattcttttagattttggattcttcttactgttctggtatcataataagaaaagaaatggggaaagactgagttgattgtcctctaacgatggcatattctttgctttggtgtattaagatttcaatctttgcgtatctcttgtcatgtttaatcacgtcagcatacataccatagcatatgcaaaaatatttatgtttataaaaaatctttcctggccagtgagggtgactcaaatgataggatcaagagttatttagttcaactaatgttgattaagttaattagcggtaccgctgtgggtcaattgtaagtacttttatacattagaccatattaaaacggccatgattaaaaagtcatttaaatttgattcatacaatatatggatgattggaaaatgatttatatgcagtagtatatatataattttttacaataattaatactagttttcactttatatatatatatatatatattagtaatactaatacaaatattattgtttactattttccaatcgatcagtgaaggtcaattcaaatggtactactgtattaacaggtcaattagaaatttagatgtattttcatagactggattgtcattgagatttatggtgaacttttgactttagtgatatagtacttctttttacataaacttttatttcaaataaaaaaaaggaaaaaatacgtcattactactatatacggttgtacaccatgcattgaaagtagcaaaacagactcacgggacaatcgacagaaccgcctaacacgtaggagcccagaatgacgatgagagatattttgtcgatgcaatgtacgttccaaagttgataactagcgtacagaattaagtatgcaacagcaatttcaagtaagagaatttttatgataccttcatgaaaatgatatttaatgtgaattaattacaaagcgtttatcaattactaactttataataataattttaattttcaatatagttaataaaaaagcttcacaagtcagcttaataattatgcgcatcattcttaacatagtaagtagtaaggtgtttttttttataatcttttttatagaaccatgactttctttgatttaaataagattattatagacgataattatttgagtacttaatactttatattgcttcatgttctaagctcaaagtcaagattcaaaaatcaatcttgtatcaatttattttttgcacattatttaataaacaataagtttgatttttggacaaaaggagacactactcattccgatgctttcatttacgatagagggtccacacacttgcatgcagcttctatgccaaggtggcggcttgtatagctcctatattgcaaggtggcacttcgtctatatagtttctgctatatggcttattttttctggactcattgttgacaaggggaaaaactttctgctttaagtaagaaccatgaatctcatactcttctgactctctttgtttcatgaaagttaatgatgatatagtataatcactatactatcactcaaatattcaggatctagttatcattcttcttccccctataaaaatttcctttgagttttcagcttctgttccttaggagtttgaagttttcaatactgaaaaatgaaactgactccaagagaggtggagaaactaggccttcacaatgctggctaccttgctcagaagcgtcttgctcgtggtttaagactcaattatactgaagctgtggcactcattgccacgcaggtacttgcatttgtatatattttctctttttttttttggtgattaatgattatctaacttgcatgctttttttatttatttattaatgattatcttccttgcatgcatttgtttttatatatatagattatggaatttgctcgtgatggtgaaaagactgtggcacaactaatgtgcattgggaaacatctattggggaggtattgtatttttgtatatatatatattatgtcatttttcatcatctcattctcaaaccccatgacatatatatatatgctttagataagagtttcatcgaagtatatgaatggactccaagttcttttagtcattttgaactagaaaaagctgaatgagccattttaaacaggagacaagttcttccagaggttcaacatctcttgaatgcggttcaggtatttgtctcactatggaaatgtagctattatctaccaataaaagcactctcactaatggctttgtagacattacatgaagtctcgttagttcagttactaatgacaatctttctttttgcccgctataattcaaactacatatttttttcttatataaggtgttaatatatttcctcattatttaatctctgtattatggatcttaaacttcaaatggataagtgtatctccaattttgtcgttatttatcttaggactctactcttatccctctgattataaaattttgtagtcattattaattattattacctgtatttatgttttaatataggttgaagctacctttcctgatgggactaagctggtcacagttcatgatccaatttcgtgtgagcatggagatctagaacaagcactatttggttcttttcttccaggtttgcttctattatgatattgaaaattgataatttgttagttggtatatctctctctctgatgagtgtttccagatgtgatcatgccatgcatgtactttgaagcttcgcttaaccatcgcttacaaaactgcatcttttatttatattttattcttctgtaatatttttctgttttggtttataatcaacattttcattgtttattgggaaaggaggaatctcttgttttttctattttaatattgaattatgagaggttaaaatatctatgaagtgtaatttgaggctaaattttttgataaaagattattgactagtcaatgatggtcagccatctggtttttctttttaaattaaaatagcttgaaacatataaccagtcactacattattccaaaaagctaaatattcctccaatatgcatatggtttgaaaacattcactcctttagtgtatagtttgtatggtttcatgttgaaattgttgggtaccgagcaatcacacaacaatcgagatatgagaaagagagaaaggggaagaagaaaacaacacacagagtttaccttgattcacgcactcgtacaattgcactcagattacaaggaaatatataaacttagaaattctaagcatagtagctattcatgggtccaagtcaaactacaaataataaaacacgagaccaacaacagtactaggcctcgaaaaaaaagttctgggggcgctgccccctagccccctctaggaagactcccccgggccctcacctgctcacccccgtgcatatctgctgatggcatagtatgagccatatctaacaaaaatcacataacacacttaaaaaacatgaaaaagtgaaatctatatgaagttccttcgtgttaacatgaaaatttgacacgattttcctaaaactgatgcaaaaccaagcatattatggttatggatatgcgcaagtacaggtttatttctgtaggtacattagcatttctcttgattgggaggaaaatgtgtttgcagtaccttcacttgacaaatttgctgagatcaaagaagataatagaattcccggtgaaataatatatggagatggaagtctagttcttaaccctggaaggaatgcagtgattctcaaagttgtcaacaatggagaccggccaattcaggtgtttgccttatattgtctacaagattttttccattgtcttgttcctaccaccttaacattttaaacaatttttttagttttctttatgcattaaaatgtcaaactgatttatgcaatttaaaaatgcccaagatttgctattgttacatgcatggctgcagcttctgaatgcagtgtgataagctgtttttattaacttattgtagcgtatgaaataatgaagtgatgttaacgactgcttttcggtttgtactggtttcgttatgttgtttactggttcattatttgaggatttcatagggtcctctggagactaaaatctgagtatgtgcatgctgttgacctttttaatttcaagtgttgcaaatgtagacaatttttttcatctggtgtactactgtttcacaaatcagaagcttttgagtttttttcttgtcagaccaaatattgttacagttttgaaacttgtcagaataataaattttaggagttcaaatatccaaacaaatttatttcttgttagcttttccaagtgaattgaagcaaacattgcctaatagttatgaaaatttcaggttggcagccactatcattttattgaagtaaatccctacttgacttttgatcgaaggaaagcatatggcatgcgcctcaacatagctgcaggaactgctgttcgctttgaggtgcaattctacattgctgcaagttatttatttatttatttatgacatgttcaacagttgaacacttgaacttattaatttaataggttctaaatgattaaccacatacatatttgctcttaaaaagccaggggattgtaaaagtgttaagcttgtaagaattggaggtaacaaagtcattagaggaggtaatggcattgctgatagtcaagttaatgaaaccaatcttagagaagcaatggaggcagtgtgcaaacggggatttggacataaggaagaggaagatgcaaggtttatcatttgttactgaagtacttgttatatacctttgcttacatctttaactattccacatttgagaataaatgaagatttcttacctcaaatgtaaatttcccagtgaaggtattactggtgaccctgactgtccattcaccacaatcattcctcgtgaggaatatgctaacaagtacggtccaactactggtgacaaaatccgtcttggcgacactgatttgtttgctgaaattgagaaagattttgctctctatggtgatgaatgtgtttttggaggtggaaaagttttaagagatggaatgggtcagtcatgtgggcatccacctgcaatctccttggatactgttataacaaatgctgtgataattgattatattggaatcatcaaagcggatataggcattaaagatggtctcattgtctcaattggaaaagcaggaaatccagacatcatggatgatgtattttttaatatgatcattggggtaagttcccttccaaaaatctgaagcaattaactgaattcatacaccattatcttgacacaacttatttgcatgtcatccatatcaaggctaatactgaagttattgctggagaagggttgattgtaacagcaggggctatagattgtcacgtgcattatatatgccctcaattagtagatgaggccatatcaagtggtgagttttacaactagaatcaatttataaagaaagatttcattacagtgggtatcttttaaatattaacgaatggtcaaggaagtacaggttctcttactttctctcatgaataataatacactcccaatctttggttaaaggggagaggaattccttcttacatttctcacctcatctccttttccccatggtagatatcagcctatgcagatgaatttgatggactttaacgagtccttttgtactttgtatgtaggcatcacaacattagtgggaggtggaaccggaccgactgctggaacacgtgccacaacttgtacaccagcaccatctcagatgaaactaatgctgcaatcaactgatgacctgcctctaaactttggtttcactggaaaagtgtgttgcctttttgatatatcttctgtttatatgtcttgtttttcttggcatattgcaaagttatttttcttgttccttgctcaatgttatgtgatggatttaagacctctctttcttcaaataattcaattaactttctattggttgctttagggaagtagttccaagcctgatgaactacatgaaataatcaaggctggagcaatgggactgaagctgcatgaggactggggaagtactcccgctgcaatagacagttgcttgactgttgctgatcaatatgatatccaggcacaacattcttcattacattttattttgtaatttttatcaatatctgctgctaacttttatgattacagattaacatacatactgacaccttaaatgaagctggatttgtcgaacatagcattgctgcatttaaaggaagaactattcatacttaccacaggtataatactaacttcaaaattgtttcccccttataaatctcatacatgacatgtaagattcaatctataggagtattagtgtagggaaagcagctaacatatattttataatccatcatttttctattgttattgaatatgatttcatctgtgatgtaaataggtgatagattaaaacttatgtctttcctagaataaattttctcacttctacaaatgccctatgcttatggatattgctctttcctttgggaattatgacttggacatggtttatactttatgttacatattcacttcttgcaatcacaaatggaaatggaaaacacaatgcagcttttattttctggtctaagttgtcttggctgattcttgatgtttccatattatttacttgagcagtgaaggtgcaggtggtggtcatgctccagatatcatcaaagtatgtggtatgaagaatgttcttccctcatctacaaacccgacgcgccctttaacagtcaatactatagatgagcatcttgacatgttggtaagatataaatctggtagaggtactaatgatgtgcattgtgatgacatgtggttctcaatttagactttctatgacatgcagatggtctgccatcatctgaatagggatattccagaagacttagcttttgcatgttcaaggataagagaaggaacgattgctgctgaagatattttgcatgatattggggcaattagcatcatatcttctgattctcaggctatgggtcgagttggagaggtttttattcaagctcagccatctaaatatgattttcttcctaactcacctttattataaatgaaaaatgaaaaaataaatagggtgcttcatacatttgtctaagtgttgaaatgaaatgggataatgtgcatgtggcattttcacaatatgtgtttcttttaagatctgttactgtgtcatctttatgctgttgtgtccaatacccccatttgtttttttgtagttcactagtactagtaactattggtgaaaatttagtttttttccccctttttgaaccctcagggtttgataagttgcattatttcttccttaggtgataagcagaacttggcaaactgccaataagatgaaggtacaacgaggaccactccagcctggtgaatcagacaatgacaacttccggatcaaacgatacattgcaaaatacacaataaatccagctatagcaaatggtttctcacaatatgttggttcggtggaggtatatgtgatttttaaatgtttaatgcatgctcaatatatgcattaatttctaggaaaagaaaaaagaaaccctgagatttccttttgattaaataacttattgtatacaatgtgttttaccatttaactgattaaagtacaaggtcactgtttcatatttttttgtcaaaaaagaatgttacactttggcactttgccatagcctatgacaatctcattcaaaatgagaggagtgaaacagaaatgcagaaattactagtgatatttcccgtgaaaaagcaaggttgcaaatgtcatcaatacttgctgacctatgttgatgttggccattggcctcttgtttacctcaggaaagaagcacgcacatgttagttggtacttggtaagaatttagtggattagataagttcgtagtataatttatgagtagtgctataatagtgaatacttgtacttgcttagctattcacgtggctgcatataagttgtttaagcagttcttattgaacatttgaacttgaactttcagtttttttattttttattttttgaaaagttcagattgagaaaaatgaatagttaagcatataagctactatacaagtcggttttctcttctctcataatttaacttcaaacttaacatatcagaggacagctataaatctgactctaaaccttctaattttagcattatcatccagatcactgcatttatgtgcctaactttgcaggtgggaaagttagctgatcttgtgatgtggaagccatctttttttggggcaaaaccagaaatggtgatcaaaggtggggtggttgcatgggctgatatgggtgacccaaatgcaagcatccccactcctgaaccggtaaagtttttgtatctaactagtttggctagagtttttaagtagagtgcctcttgcttagtctttttggtatttagattccttaatgttgttctatatttcctgatttggccataaaagaatttaattgcttatactaatggagtctattttagttttcttaagggcacacacacctcacctcacatcggctaatgcattcaggaaaatgaaattggtgccaaacttccaatctaagattcgaacaccaagcgtctcgagtaaacgcgtgactgaaaattaaaattatataagatttgcttaatggtgacaatggtcaaacgtattacactaatgatgataaacttttcattacttgtttcattagcattcataatcaatttcatgcaccattgcacaagttctaatgtaaaatttgtggttgagactaatttggacacacacctcaatgagattagaaaatctatattactaaaatataaaacagacagacagacaattagtttgtgtttggattggcgtttcaaatgtcccaaacgtccgttcacactttctaatgcacaaatccaaaagctacaatactgaagctttgagaaaaatgtcttgcaaacatgctcttagttgttgggcaattagcattttgatgaacctgctgccactaaacttattaaacacaatattgtaggtgaagatgaggcctatgtttggaacactaggcaaggctggtggtgctttatccatagcttttgtgagcaaggcatggaaccctctatccctcatacttacgtaaacaatttagtactaaaattacaaactcacgttgttgttgttgtttcacaaacaggcagctgtagaactgagagtacatgctctatacggactgaacaagagggtggaagcagtaggcaatgtgaggaagctcaccaaactagacatgaaacttaatgactctcttccacaaatcactgtcgacccagaaaagtacactgttacagcagatggcgaggttctcaccagctttgcaaccacctttgttcccctttctcgaaattacttcctcttttaagtactagcttccataaataaagcttataaattatctctcttctaaggttttaatgtgtagcactacccttataaattttttagttcccctactcttgttcttatgaattcagatgcaataaaactaagtgtgttggtttggtatctgttatgttttttgttctttttaaggcatcaattatgctgtggtgaagatgcacaagatagaattaaatcactagatgaatccctgtttaaagaataagaagaaacttggtgaaaaagtagaacaaagctttaaggagaggcaacagcttttattgctgaattttttggtaacacatgcatggtgcaagagatgctcttcataaagtttttttttttttttnnnnnnnnnnnacttttggaattcagatatttttgtatttttttttctttagaaagaaattttatatatcatttttttccaaaaccgaaaaaacatatatctcttttatacatcttttttattggatgtctttttcaaaagcacatttaaaggttagaaagttcagttatataattaaaaattgaatagggccctaattggatgagacgcacataattgaatagatccctcatttttctcgtgtttgtttggaagtatatatcataacagtaaaaagttaaaatattattattattattattattttgctttataaaaatgtaaagaatattttacacaaaaattattcgaacccgagcaatcataaagtaataaaaaaatgacctcttaaaagtagcattctcgcgtttccattagggttgtaacctctattgattatcacatttctttagtagaataaaaataaaaaatattaaaattaaaataagtttatggatttagttaattaataaataaataataaaatattggtatatttttacataaataattaattaataaaaaaattttgtacaaattttaaaataattattataagaatcaatcatctnnnnnnnnnnatcatttttttccaaaaccgaaaaaacatatatctcttttatacatcttttttattggatgtctttttcaaaagcacatttaaaggttagaaagttcagttatataattaaaaattgaatagggccctaattggatgagacgcacataattgaatagatccctcatttttctcgtgtttgtttggaagtatatatcataacagtaaaaagttaaaatattattattattattattattttgctttataaaaatgtaaagaatattttacacaaaaattattcgaacccgagcaatcataaagtaataaaaaaatgacctcttaaaagtagcattctcgcgtttccattagggttgtaacnnnnnnnnnngtctaaagaatacgaatatataaatatatactctcaagttgaagggttatgtgatatacattaaaaaatataatggaactcaaacattgcgttagatacttaaatggaaattaagatttgttattcatggcggtcataattaacttgagcataattgcttccaataaaaaatttgtgatctataaaaaaaatcaactaactcaatatttacttagtacacgagataggaaatttgtaggtttaataagtgctttgagttttaacttgttcttatcatatatcattcatcaattgatttaagatttaagacatagggtttaatattttttaaatagacaattgcaaatagagatggaagagaaaaaattacaaatataataaaaaattatatataatgacaatgaagattgaatttaacatttcatgcatattatttgactcctatattacacttatcttagtggatatatgtgtatatataacagaaaatataagagaaatagactatacattatcatatctaattataaattatcatggatgaaaaaattattgacttgtataattgaattaccataaattaaaagtcatatttagagatgcaattaaatgaaaaaaagaaaaaaaaagtgacaattagatatttatgtacctatcactaccgtttactaaacctaagcttattaattagaaatgtatcgagagatattaaaagataagcagttattagtaaaagaaaattttattgaaaaagacaaaacttctttcagtaatttctatattttaaaaattatatcataatttttagttatgagaatacttcactttcagaagaaaaaagaaatataacatatgggtgataatatacaatatgatgttgccatgtcgggaggaaaagaaatgaataaaaatgagaaacgcgggaggaatggaggtactaggtggtgaggaaatcattattggtaagtttatttattttttttttatagaaaaatgttttataaacaacaatgttatctcatatctagaaagagttgaaaaaataatattataaatatgattaagtttataatgtaatagaaaaataaaataaaaataaaaaaacattaataaatgtttaaaataaatgaatgcacatgtattattatttttttaatagtggatgatagacagcacatgcagattgatacatccactgttttcaattatagtagttgtaatcacgccactgccagacgtacagactagtgctccatcatatccaatgttggcgcacaagcctctccactactcaattctacccttccgctcatctccggcgacgcttgccgtcaaccgccgccggaggattcacttcccggccttcacgcggcggaaggtggaggtccaagcggcggtaagcggcggagacaagagccagacgactacgtctccgttggacagcaaagagaggaaggggaagagttcagtggcatcatctggctctggcattgatgaagggatacaagtgaaggcagtggtgacaataaggaagaagatgaaggaaaatatcagtgacaagcttggggatcagtgggagaatttcgtcaacggcgttggtcaagggatccagattcaactcattagccaggaaattgacactggtacgtgtgtttctcaacttaattcaactctcttttttttttcctttttctctttctttctgttattaattgatcatgattttaaggttgtcgagatgatcattcagagatcacgacttcaacaccgtcctagactttctttttttctagctttattaattatttcacttgctgcacactgcacagtgagaactggtatgcacaagtacaacacaactgcaactgcaagctttttcatttgatttgatttcatgtccccttgttcaaccaaaagcaaggaccaggaggcctacaaattacaaaaggaaaaagttgtttggtctagctctactgaactacgtgccttggaagcacctcttttattttaatatttcctacagtaataaaatatcttatttaacattgctttcaattattatcacattattaatataattgttttatatatttaattaagtataagtcatcttagaatagatatagtttaacataaaggattcatctgatagagtaagacaaggtttaaatgtttaacaacgacagttgtaatcaacccttaattgtctctttagagcagaggaaacataaagaatagtaatatacaaatattttattattttaaatatctttttaacacttttcatttttcttcatctttttttctatcatatcataaattatattatatttatatttttctatattttgttttcctcttgatgttaaataatataatgaatattaatgtatcatttttcaaatataaaatgacttagtccgaagactttttatctgtcttgaacatggaagtcattcttttcttctaaaaaataaatatattataaaaatttaattcttaattatataataattagatgctagagtaagtactaaaaaagtgttattaatttcataaactataaataacaaattaatattttgatcaaattctctctttaaattaagatatatatatactatttatgtttttttttaaatcatgtttttcactaaatgaaatagaagatttaagatttaacgttgtaactaatattgatgtgatcgtgttaaattaacttcttgtgtctgtagtctgtactatataatatctttttctgattaatttgcggtattttttatgttttgttgctttaaataagttactaattctgggaaaagggtgcaatcctacgtgagagggtggctaccgaagccgtccaacgttgcttacattgtggaatacgctgctgatttcagcgtgccaagtgactttggatgccccggtgctgttctagtcaccaatcttcatggaaaagagttccacctagttgagatcatcgttcatggcttcagcggaggacccattttcttcccagcaaacacgtggattcattcgcggaatgacaaccccgaaagcagaatcattttcaagaaccaagtgagtcacagctcaaccctcttgtaaagtctaaaccaatgaaaatttattgcctgatggtcactttcattaagtgttcatgtaaaaattgtttcagaccatgaacactaaaacttgaccatgtgtcatgtaaagattaccggagaccatacgtacaaaaaaagtatagactacacttgaagattagttgaaatcatgaacaagtggtgatcattattctaatgacaaactattacgtggacaggcatacttaccatcgcaaactccagctggtatcaaagatcttcgacgtgaggacttgctaggcataaggggtaaccagcatgggcaaagaaagaagcacgatagaatctatgattatgctacgtacaatgagttgggcaaccctgataagggcgaggaacttgctaggccagttcttgggggtaacgagaggccttatcctcgtcgttgtagaactggaagacctcccactctctctggtacacttcattaatttgctttctcgttagttactttttgtgttgggttttggtatgagcaaatggcatgtctaatggggtgtgcaaaatgtggtgtgtaatggatgcaatgccaatgattagatccactgtcagagagtagaattgaaaagcctcatcctgtttacgtgccccgggatgaaacttttgaggagatcaagcaggacactttctctgctggaaggttgaaagctctgttccacaatctgttaccttcacttgctgctactctgtcgagttctgacattcctttcaagtgcttctccgacattgacaagctttatatcgatggtgttgttttaagagatgaagagcaaaaaggggtagtggaaaatctcctagttggcaagttgatgaaacaggtccttagtgctggggagagtttgttgaaatatgaaattcctgtggttataaaaggtgcgatagtgaaacaaatacaacacaaccttgtattcgcggaaaacaacattcatttcacttgtttcttttgtatggttccaggggataaattttgttggttgcgggacaatgaatttgcaaggcagatcttagctggggtcaatccagtgaatattgagctgttgaaggtagtttttttatacctgtataggaagaaattgtgtggtactgtccatagctctggtcaatgtccacataacatgcaaccgaacttatcaattttcgacaaagagctaataaaactttattatatgtcacgtggagattgtctgagaccatgctagtcctaaatcatgtaataatttctccaatctaggaggttgtaggagtattaatatgttttctttgtcatttctttagccattctctttgtctttcacaggaatttcccatctgcagcaagctagatcctgctgtttatggccctgctgaatccgcaataacaaaggaaattctagagcaagaacttagtggaatgagcttggaacaggtttgctctgtatttctcttgctaattgagcttgacctgtttatctggaagaaatttgttagctctattaccaattatttttatattggtaggctattgaggaaaagagactttttatccttgattaccatgacatgcttttgccgttcatcaagaagatgaactctttacctgggcggaaagcttatgcctctcggacaattctcttcaatacaaagactggtattctgcgtcctgtagcaattgagctttcacttcctcaaacgcactcttccccacaaaacaaaagagtttacacacaagggcatgatgccacaacacactggatttggaagttggcaaaagctcatgtttgctcaaatgatgccggcattcatcaactagtaaatcattggtaaggcaattgaatggaaattccaaagtattgaataaatggctagattcagttagtttaattttgcaaaatcagatttcataaatgacttattcagaagaaatggtggattttctcaaatttagccaagagtaaaatacagtggaaaattgttgtgtgcaggttgaggactcatgcatgcatggagccatatattattgctactcatagacagctaagctcaatgcatccaatttacaagcttctacatcctcatatgcgctacacgttagaaattaatgcacttgctcggcaaaatctgataaacggaggtggtataattgaggcatctttcagtccaggaaagtacgccatggagcttagttcagcagcttacaagaacttgtggcgatttgatatggagtcattgccagcagatcttattcggaggtaacactaattttaaggcttttaaaaccccacatttaaatcttgctttgctgtcctttttgcacttattggtaacataacttagctaccattttaacttttgtgcataggacatagcatactatcaatctgttaatagtgctctcttcttttcaggggcatggcagtagaagacccttcaatgccctgtggtgtaaaacttgtgattgatgactacccttatgctgaagatggactcttgatctggtctgcaataaaagaatgggtagaatcttatgttgcacacttctactctgatccaaattcagtcacatctgatgttgagctccaagcatggtggagtgaaatcaagttaaagggtcactctgacaaaaagaatgaaccttggtggcctaaactcgataccaaggaggacctatctggtatacttaccacaattatatggactgcttcaggccaacatgctgccataaactttggacaataccccttcggaggatatgtgcctaaccgccctaccctcatgagaaaactcatccctcaggagaatgatcctgattatgagaagtttatccaaaatcctcaacttgttttcctatcatcactgcctactcaacttcaagctaccaaagttatggctgttcaggacacgctgtccactcattcccctgatgaagagtatttgggtcaacttaaacctcggcataatcattggatcaatgatcatgaaatccatgtattgtttaataagttttctgctagactggaggaaatagaggaaataataaatgcaagaaacaaggaccccagtttgagaaacagaagtggtgcaggtgtccctccctatgaactgttgcttccctcgtcaggaccaggggttaccggtcgtggaattcccaacagcatatctatatgatcaatttgataattgtttagtatgtcatcttatcctatccactagtatttgcttagcggaaaccacgtacgtacaagcatacatatttttatgggaaataaatgttccaatatttagtttcgtactgcattttattcgtgcgtcaaagtgaaaaatcacgtcgaaaccaagaaaatatacagaagatacaaatattaaacaaggattcccacttagtaaaatgagatattcatattatattagggaagctcattatttttttggagaattacataaactagaggcttagaatcctctaggaaaagaaacttgagctacatcaactactaaagcattaacgatacaacctagagcaaaatcaaaaacatgatagggttgttgagacttcaacacatacttatagccaaaccatctacaacttgatgggcttccctcaaaatatgattccacgtgatttgacccataccaccatgcaccatgtgaatttctcaaataatatcatagcagggatgcaaattactcccttctccaagaatgaggctgatagcattaagggaatcagagtctacccttattttccaaaaacctctggaccacgccaatttaaagccgaaaaggatagccataagctctgccttcaaaactgaagcagatcctatgtaagctccaaaaccacacaagcccccatatgatcacgtataacaccactacaagcagcattactatcagcattagttattaagcattcatggtattacttccagagcaaaattctcactctttccggcccattccaacggaaaaaaattttacatgagggctgatctgggatctcatccgtgttattgacttttgcataaactgatttcatagaaaatctcctatcacctgatccattccaagctatagtatcattgctgaattccagggtcgggggtatcaaagataagattttagacccaatatgagcagggagagaattcctgaaatcatccaccttccaactcctattcatatcaacatactcgtccaaagtcctattcgactccgtttcagaaatagagttttccattacactcgtcaaggcaccacaactgggcagtcagttgtcgctccagaatcatataatagaaccattcccaattctccagattacatttctgcataatatatcccaagccgagcaaaaacccttgtaccagtgttttaaaatccgaactgcccgatcgatcggactgggttgacacagcaatctgaggatcaaattgaactgacaatcggatcaatcataaattaaacatggtcattaaataattttattagtgtgttggaaacattctagtatggattgtgtctgctatgcaatacttttaatcctaaaaaagattattgtgaatttgctctttctagttttttttaaaacatttaatatttttttcatcactagtttattgttaattttttaatatatattgataacgcaatatctaaatgataatataatattgataatgtgatattggtatgatagtatgatatataaggtgataatctaatatgtgttgacgcatcatatatgggccaaattttgttcctactattagtcagcaccttattaatgtcacattcataaattattaaattgacaaattatttatcgcatcaccatgttagcgtgtcagatcattaaattacattaaaaaattgatactaagtgaatcagaatttctaaaatttaacaatatgagaatcaaacatgttatagtttttttcttggaaactaaaattgtattatctaaaaatttaaatatatttttgttcttataaaattaatatatattttatttctgtaaattattaatatattttttattttcataaaattaaactatattattttttaggttaaagtaaagtttagatgttcaaatctataaaaatataaccattttatattaattatatataatcaatatgaaaaatattatatttacatgttatttgcataatatacataaaaatcataatagtaaatttggataaactgagttttgtccatgaacaaaaattatacattttaattttatgttaacaaaaagtatatttttaattttacatgaaaaaaaatattttagccattcaaaaattataaaaataaaaagtgaatcattaattagttgaagaaatctaaagtcgtcgttatgcggcattgtcttgtctgtgtaagatcctctgaactttcaactttgtcacttgctgcacctaggaagaatggaagatattatatttttcaagaaaatactaataaatatttttaaggtattaattaaaaaatcctctgatcgaaaggtattaattaaaatataaaaaaaagttatagaaaaattattaataattataaatacttttaatttgttaagattttcttattttcagaaagaaatgagacaggtaagcagatgcatcatacatgagttaccattaataaaaagcagggtaagaaaataaaaatataaaataatggaatcatttctattttctcacgtcaccgctttgataacggcttaagaaatcagcaatggaaaatgctcgcccactccgccaacccaccccgttcttttccttttcatacatccaacggctcagcatttcccccaatgccacgcgtcacgaggcaacgcagattgcatttgatctcacgattccgcgccacaccgtgagcacctgggttcgcgatgcgattcgttctctgaggaacaaaagatgaatgcagtggatttaagagagtcctattagtctcgtaagtaaaagaagaaagatgaccaatctgcaaatacaaacagaggaaccccctcagagtcaaacaccgcttctaatttcaattcagcagcaactagagaacgagaatgagggaaatcatcatcataataataattataatgagagtaagaaggaccaagacgttgaagttgacgatgacggtgacggagagattgtggaggcgagcctggtgcgcttggagcggtttcttacggtgttagggttcaaccaggactcggcgttgagcttggtggtttcgtggactgtgttcgcggcggtgggagtggtggcgccgctggtggcgctgtccatgtgcgagtgtccggagtgcgacaggtacgagattcagagcttcgagatggcgatcgtggcgtttcaggcgagcctagccgccgtctccttgctctgcctctcccacaacctccgcaagtacggtctccgccgattcctcttcgttgaccgcgactccgggaagatgcattgctttcaccgcgactacgtcgctcagatttcggtctgtttccttttctctttcgctagctccaatgtgcaagcctctgtttctgatctgaatgcatgatagcttgattactttgcttgacacgagttatttgtgaaaaacgtttttattttttttactgtatttggtgtagtcagggttgttgctcgaaaccagaatttgtcgctgtttcttctattcgtattattattagacattcgccttatttgaaaactttttcaatatgtgaggagtcaaatcatggacgattattgtgtaacctttcagttcttccttattcttttatgaacatgttattattctcttagctttgaaatgaaaagttaactattccccattaaggagatcttaaatacttttttttaataaataacatacaaaatctagatatagttccttggatgcttttgctgatgcttttcaatcaaaattagagtttcactctgcgcattaaaggtttccattaaatttcaacatagctgaagtgaaactccaattttgattgtagaacagtagcaaaagtgcctcagtgtatttatattttttcataaacaatacatgcatgatagtgtaatccgatcataaactgccttgtaaggttagtttgttaccttttataaaaactacctttccaagtcataccaatatgatttctgattaattcagagtacattcttttattgcctattaaactctttttctttttcactgtcaccagggatctatgcgcatgctttttctgtgggtgttgccgtgtttcattctgaagacagtgcgagaaatcattcgcattttttatgtacaacctgggtcctggtggctctcacttgctattttatcagctttgattatatcttggacttatatgagtacaatctctctgtcagcctgcattttgtttcacttggtctgtagtttgcaagtgatccattttgatgattatgggaagctcttgcaaagggaaagtgatgttttagtctttatggaggagcacattcggttgcgctatcatctctccaagataagtcataggttcagaatctatcttcttctagagttcttggtcgtcacagcaagccaggttgtgacgcttttgcaggtcactggatatggtcaaatgcttaccttcattaatggtggagattttgctgtaagtccaactctttatgttcaaagtatttatgcatttagattgaaggaactaattcctttcatttcaccatttctttttggactgttgtttcttttaggtatccacacttgttcaggtggtgggcatcattatttgtctgcatgctgcaacaagaatttctcatagagctcaaaacattgtttcccttgcgagcaggtggcatgcaatgctaacatgcacatcttctgatgcaccctctcaattgagaagctctgctagtgcagggagcttggaagctgccaaccatttgaacgcaatacaagtagactattctgaaagtgatctagagtcaatggattatgctggaatgtttacaaatacccaatggacttcctatgtgtcttcacatcacaagagacaagcttttggtatgtaaatcaaccaccgtctgtaaactgatgaattttacaagtttttctaattcgtgataaaagtaaaatgtttatagaaacatcatatatgcttcattagtgttatcttgtaacttcatcttgcatgagaacctacaataatctgataatgttacatgaaatggtgtaagtggtacaggtgtgttgcaagaccaaattgagatgaaataatacttaaaacatcaacatcaacagcacctttaacccaaattaattggggtcggtatgaaataatacttaaaagacattagtaaaattacaacttggaaagatccaaggaaacatgtatgttagagagtagttttctggattcattaatttttacttatattttggtgaattctggattcattaatttgtgattactatattgtaaaatttgttgaacattcaaggcacattgaaaacatttagtcctgctaaaaaggtagttgacttgtctaagagaaggaaagggtatattctgctatttccaccaaggtcatatctgattgatattcatttgcattattcatctctcatgttcatggaccaaaactagcttcatatggctacttcattttaatacagctgactatgcaagcttttatatatgatactatcttattagattagcaaattagattctcagaaccatcttctatatgtaatgtaatgtgcaataaacatgtcatctctctagaaaatactgaatgcttaaagtttcattttacatgattactaggtcattctattgttctcataataattactatgtaaatcactatttttatcaaatattttgcaaatgtgaattttctcattttgtgtattttgtgatattagtgtacttattttccttgttcatatgtatagctttatttactatcaatatgttggcaatcatgctaaattacacaagactttctgcataactgcttttggaatgtatttttaagttgagaaatcgtgttctttctggtttcatcacttgaatgcaggctgttagcttgttttatgtctagcaggaggatctcatgcttgttggttcttttaaatatgcagtgatgtatttgcagacgaatccaggaggaatcactatatttggatggacagtcgaccggtctctagtcaacaccatatttttccttgaattaagtctggttacctttgttctcggtcagaccctaatctaaggataaaatttgcaaaatgacatgaaaaaaaccctttggttttaggtcttcctggttaccaccatcaatttgattgaaagtcctccacatgccgagccagaatgtcgcatgcacacggtagtcatgcaaagtagagaaacagtgtgtattgtccacccggggtctggaccaggcacactactgctaaatgccgaggcctcttccccaatccccagcaaaacagatgtctccaaaattctattcgtcattctcattcctcagtcagcatacttatgttcgtggatcttgtggcttctaattggcacaatatgcaatcaaacaacatagcttaaacttataccaccttaagatacttggcagttttctgcctacgtgggctcctcgaagcagtctttctccaattgtttcgattcataacctaaggtttgcaccatctcatttgaaatcgaaggatcatagctatagtcatgtcaccccctgcgttgaagattccagcctctggacatctctgacctttaagagcgttctcatgttgaactcgtatgtgttttgctttgtagttggaagcaagaaaaggtgttgggcaccaggaaggacagaggtttaaattttcaactaggaatatggaggttggcccaatcgtgttgggtgtgcaagtgtcggtggacagtcatattaccgagtaatgttgcttgcaaattctgatctagttagattacagtgattgtttttattattattatttgagatatggttaaggatgaaacaagggcctataacttccaacaagtaacctattcccatacttcatctcagaaacaagggcattaaaattaagcgacgataaaaggatgttttccgtacttcgaaagacaagtttataattattggttggtcgtgcaccaaccctctttcattttcttcacgaaatttataaatttctttttaaacaaagaaaaattcaataaattttacttattcagtaatcttcaatcaattgcaaattgatattttctgttctttacttgtacgttgatgcatttgctctgaaatcaattggagtaaggttattttagtttaattagtagttttgtattttagtccttgataataatgtgtcatgtacttggaattgaaatgagaacttcgtcttgatatgtatgagttaagtacttgtaatgagaactttatgagtcagtgttcttgggtggttcgagtaagattacttcacatggaatatatttatctcagaaaaaacattcatgcttttaccacaggtatttgtcgtacttgttactatattcaagtccatattttgaaattatttgataaataaagaagcttaataaaaatcttagcctaatggttatagtacaataaaacattcaacaacttactgttggttttatcattacttaattaacgatccactagcatacttttctattcataataaaatattattataaaataaataaaactcattaaataagtaggagttgttgaaatcaaattgttgcttcaatctttaaattcaagattttcccatcctccctcatgcgccaaaatttaggtatggtgagtcttctcggatcttggactcatctttaaattctaaggtttcaccatcctcccatcataagcaagtaaaccttgtctttctctatgttttgaccactttcagtcatcaaaatcctagaataatagttaattagtccattttagcctcccacaatacttcaaaatagttaactagtctccatttaccaaaagatgcaatctcatacaacacaacaagtaaacatgatatggacattctcacgtaaaacactggcagcctgtgaaatagaagtagaaccccaccaacccgcacttggcaaacctaatatatttttcgtcaaaacctgcctattgaaagagagagagagagggaggggggggaagtacagcttatgcttactgcatcatcgcccatccagtgagtgatgcttaatgagaagtggatgctttacatctcttagcaaccccatctcccagctgtaccaattaatagagttatcaattacattatgagcattataaaaatgcatcagttattgcagaaatcatgaaagcaaaacaagtggatcccatcttaaattaaataaaaaaccctcacccacgatgtcaatgttcaaaaagtaaaggatgttctatcatggtgtgtaaacagggggaagggactcctttaatgggtagaaggataattgaaatattcagaaaggaatcacaggtaaccgtgaaaacaaccaacatttaattcccaattaagatttaagatctagttctggcctccagattcaacagcaaaacacctcatagtcatattttaaaactagcaaaggaataatcgccacaatattagacaacaggacaattttccggtgacaaaattcatcatttcaaattgccaacaatgtagccagtgagtcagcaaactcaaatagtcatttggtgcagggtgcaaattgtgtagaggcaacatagtatttagtggtaacttgtataaagtgaacatagattttagcacaggaaaagcctcaaatatactgaaactaacatatagattttagcacaggaaaatcctcaaatttactgaaacttaacataaatagcgagttaggttagagccaaaaagaatcgttacagtacatcatacggaccctggtcaattttcttccaactagttaagggataatttcataatcattacccatagggaggcggggggcagggataagtttctaaacacagattagtaatgctgtgtttggttgagggggagagtagagaaatagagaagaaagtgtgtggggcccatgtggatcctacacctcctacaatcaacttcaattcaaaaatttatcttctatttctatcatctctcgttccatcctctaatcaaacacaagcataattgctccaaaagatgttttaatcaaaacaatttaccataaatttaactgaacatccaagcaatcaatgataattcaatgtcataatccatcacatcctattttaaggaaaaaaatgggtgagggtgactatatcaccatgatatataataaataagaaattattaaaacatagcaaaagtcaatatttcagatcttaaaaacctataaggataaaacaaagggaaaaacacattataacaaaccaagttttgcattgtacctctagagagactgaaggaacaactaattgaagttctatactttacgatatactggtaacctcttcaacctgcttgctttgatacttgatactgcagtgacatttgcagacaaatatcataaaatattcttgtacttgtcaaaactttaatcttcagacgatgaatacatatgataaaatgataacttttgctaacttttgacttcttgcattaaagaattttatactcttagtgaatgaacaccagggggatgaaaaactcaaaattagtgtatgtttccttgtcatgggaaagagggataaaaaataaacatcgttaaaaaaggttaaaaacaggcttaaagtacaataataagaacccaggaaaaaaaaacaaagttggatatttaaggaatatcagtttggcctcgcctcagaacaattggcaaaataaaatagtcattaatacaagacagcacttcaaaccaagaagaacacaaaaatgttttcaaacacagctgttatacatcattattagggtataattttctaaccagtatatatgatggaaaaaagaaagacccatttttcacatttattgaggcttagtgttcacaatctaaatgtaaataaaaatacaataactcgtaaacaaagctagtgcaatatatatcatggcctaccgttaaccatggaaactcatgaaattcttggcaaatcacttcacttagatacaacaatctgaagcattcaccaataacaggaattaaattattgtataataaatccattatagaatgccatttcatttaagagtcggtcattgtgctcacagaggaagaggttgcaccacttggaatcaaaagaagtgatgattcacatccgcaataaaacaatgcatggtaccatcatgtcattcacaaaattaaatttgagagaatgtttcaaaatgcaattgctgacttatataatagaccaataatatgagcaagtagcaattaaaccctccatcatctccaacctccccccccccccccaaaaaaaaaanacttcagattctagacattatttctctcacagataatacatatcctcattccttaatatcaaaggaatgcattacctttcaatgcatataatgtcactcaatttctttggtaagatgcacagaaggtcctcttccacttcacaccaaccgtctcttgcaaacacaaggtgaatattaaaaaagaaagaagatatagctgctagaaaatccatagtgctttaatactcaaaaccagatcaaatttgtttatacagtatgccaatggatatgttacaaagcttcagctgacactgacaattcctaagccaataatgccacactttgagcagcaagccatgtcccagatgcatttctatataatgatcaagcatcaagaatgttaaccttaaataatctggttcccgggaggtaaaagaatacatctccgccaaaccaacaagttcctgctaaaaaacagcacgagtaatcgtctaacaaacaatgcttccaacttccattcagtgcataccctcacctcatacactaaaccattcagcagagtgtgttagaatgattattgagagttgagacatagctttagtaaacaccattcttagccaaaaattccaccagtccctgtttcaccctgctgcaactccttccggcgctgctcctctaaaggatctggactcttgtatattctccgcatgcgcctatttatatgatgattgatgaaattatgaaaacttgtcaaaaataaatgttgataaatgttatagagtcaacaaatatttacacaacttccctcttttatccagactagagaattacataaagttattatttaataaaattgatccagcatttcctattaggtcaaaatacctgtcctgagcatgttgagcaggaaatgtaggcatgaattctttacttttggggagaggaacttcacggaaccactcatgatttagagcagcttcggcagtgatccgctgcataaaatagtaggtcttatattaatattcagaaaaatatttatttaccaaattaattcatgtagctcatgtaacctttaccttctcagggtcataagttagaagcttgttcaacaaatcaaatccagaatcagaaagaacaggagatccagtgaatgatgtggcaggaaactttttacgcaggaggttgtacctgaaaggaacattccgtggttaatacaaaatagaaaatttgttcaacagtacaagtcaccaagggaggccagatagtcagaccagaaccacccaaagttggaaaagcctgggaaaacagtggcaaaacataagcacaatataatcaaacagtaactttttaaataaaggaaatcgtaagcacttactgatgtttgacaaaattgaccttgactccaggtaatttggagaacccaggccaaattgtttcatttggtgtgccaagaatccggaaaatctacaagtagaataacaggtcaatagagtaaaacaaccaccaagtggttaagcacaagacacgcaagggttaaaaggaaagagaaatatgaagcaagagtgtaccaaacattacacataccttgtcaagttgatcaaactctgttttcccattaaacagtggttccttagacaatagctcagccattatacaacctaaagaccacatgtcaatggctgttgaatactgttttgcccccagaagaagttcaggtgccctgaaacatatagacagccattacgtaaatgatcgcatcactgcaagagaatttagtcaaagacattaagataaacaggtaaaatgaaggcaagtgcaacaaatgaaacaccatagtgtgatgacagactaacaggtattctcatatgcaaaagcatcgatgctgcataaaaaggatggataattatgtacatgtgaacctaaagtaacaactaattagcaataaggctactttattattattgcagaatagcttcaaacaaattttagttttattacaaacattgaacatggctatataactacatggtttcaaaattcattagaaaacctttaactatacttaaaaatgtaatacacatacagagaaatatcatgagaaacaaatagcatatagaagcaaattagcattcacctgtaccaaagagtaaccaccaggtgtgtatatggctttaaaggactcccatactgacgagccaagccaaaatcacaaattttgagatcacccctattatttagaagcaggtttgaagtctttaaatccctatgaagcacccagttgtcatgaagatacttcacaccttctaaaagctggatcatcaagcacttcgcttcactctggctaaaaggctgcttcattgcctccattagtcctttaaggtcatgttccatatattccatgaccatgaaaatactatcaaggctacttcctaccactacttctttaacgtcaactatggatgggtggtgaaaagaaagaagaatgtttatttccctaagagaagtcagtgggaagccttctttttccttctccatcttgaccttctttaatgctacaatttctccagtctttttatccctagccctatatacaacaccgtatgttccttcatctatcttgttaagtctctcaaactcatcaacacttctacaaccctgaagcatgttgactgctctttgaggttgagcaggaggttctggagtctcctggccatcatcttcatcttcagaatccgtgtctgagtgactgacactggtttcacttttcccaccttgagcatcaatctctgactcaataccaggataatcgtcaccactggaagttctcccacggacacctctttcttcagattcagatgatctggccctagctctttcaataccttctacattagattcctcagggctcaatagcttgttccttagtctaccatccaataactcaggagacaccttcctcctccgtttgggcatttcctcatcattgaggatctcaccctcatcaacaggagagttatctccagctgcccatcttgaggacgatatattgcgagttggaatataatcttcaccttctggatgttcagcttcctgatcattatcccacctccctttcgggggcgatgaatgcaaacctgaaggagagggcaaggtaaccttagatactgcattcaactgaagttcctcagtttccctgttcttgacaggaagtatttcaactccaccatttggaacattcggcgactgcgactgacggaacacctttggcaacggaggtggaggaggagaaggaagcgcccccttcaccacagaagcggaaaccctaactctggatgactcgttgacttccttgtcatcctgatcccatactatgggtgaaaagttccttttcctctccggcgctggtggagaccgagtcctggtttcttccaacatggcaacctcggagtctttcacacccggttctgattcaatagcatcatcagaaccactctcactggaaagttcaccaggctctctatcaactgccttgacagagaaaccacattggcgaggaccaaggccactgctgccagagtcactcctactcgaagaggatcgataaccaccaccattaacaccttccatctctttaatatccttctgcctcaccctaaccctatcccttgacccacccctcaaaccatcaccgccaccattcctaacacgatcgtaatcctctttcgaattcgcgaatccgccgcgtctggaaacttccaacttcgactcgcgctctctgaactcgttttcgcggtaaccgccatgtctgccagccgccatatatttctctatatacctaagtttgtgaattacaaaggaaaaccctaatcccccctttgaaacaatttttttgtatttttgtttaatagagccctaaacccaaaacaaaacgaatccccgagaattcaaaattgaagaacgcaaaagagatctaacggagattggagatgaaaggacaagataaaatcgagaaaatacgaagggggaataaaataggaatttaaagaggggattagaaacccgaaaaaattaggatcaggcgaagaagaagagatagattgatagggcttaccgacgaatgatgaagaaattggatattaaaagggagagaacgagggaggcaacgaaatggaataggcttagcgatgtgatgcggctgcggagaagagagagagagaccccttcgtagagaaagaaaattgggcccaaaagaaacaagggtgacaaaaaacggggatattatcgggacactccgttttttttttttctccaaataagataacctccttttttatttttaaaacatttaacttcgtatgttttaaaacaaaacatcatgatacagtatgggatagtcccatattttattcaatcaattttgatctcctcatattaaaatttgattctaaactttcaaaaataagtgattttaatttaattttaaattttatatacattttatttattttattttgatttaattgaactctaataataacatattcatttaaaatattattagtaaataatataattaaaaatatataaaaatttgaaaaatgaatcaaaattacatattttaaaaaatcatgagactaagtatttttattttaaaatttgatgatgaaaattatatattagatcaaacaggaggacaaaagttgtattatagcctataatcctttaacataattttgaatacattttttattatcaaaataatttcttgaaaattatataaattttgtatttttatcattattatgtgtgtgagaatgtcatttattagttaataactttcactaattattagtatgattatggattttaaatatgtaggcaactagtatgggtacataagtaacataataataaccatctatttctcgtactaaagtttgcttgctggtattggcaggaaaaagccaatgaaatgaatgaatggcattaattagagggagttggtgtatatggggaaaaaaaaaccttttcctcatcctaaaacaaatctgcgcgttcttttttcctcggtggcgtcacgatctgcgcctctccctctcttctttgtggtgtcgcgccgccatcacctccctggccaccatcgttgggcgccgccgccaccaacacattgtgattccacctcgagtgcctccgtagacagctctcagaaaccgtcgcgctccatcaccgacagcctccacaacgcagtattgtttcctaggagatcgtatgcaaccatcatgctaagagcgttgcttgagagaatagtgagagagtcgagaaaccacaccgtttcggcgacgagggaggtgtggttgatatatttgaggccgttccagaagccgtattaatagccgagggaggcgctcatccaggtgcaggtgaacttagcggcggcgcgatggggggtgcggtggcggagagggaggtgctgtaatgggagtagtggaggacctggaggcagttcgtgccggcgatggagcggatgtggttgtttgcggaggcgtccacaatggactgcaccttggatcgcgcgaggaggaggttggaggttgagggtgagggaggagtggcattggagggggaagcacgtggctttacaggcttggtggatctccacggcggagtggggatgggagtggaggaagaagaagaaaatggagatgcgaaagaggaggaaggtgggtttcacaggattgagaccgggaatgggaggaatatgaggattttagttttttatttttttaaataaaataaaaaaagtgacaatttttaacttactatattaaattaattatttcaaatttttaaaagttaacataatgcaatatttcaaaaagtgacaattgtgttttgctcatctatagatatttttatacaaaaattgtaagttaaaatttatcatttaacaaattaaccgaccatattttagatttagttttctgataaattctgaattatttttaagacattactcaaattacaaatctcatcgacaaaaagttgattagtattttaaaaaatataagagttttccttttaccactatagatcttcttactgcacaccaagagagcaagaaaagcatcatgtaacttgcaacattattgaagtagcacaattatgttgggctagactgaaaaggttttatatttcacacaagatattacatatatttggttgcaaaattgctactagcagcaaatggaaggaaacttaaagctgaaagagaaagaagaaggcacatgtcctgtccttcttatatactcaaccctttcagtagtcctcaaagctttgtcattcagcttcacttgtgcattagctcgtttctcttcagctatcctcttagtcgaagccagtttatttgcaaacctttcttgtgccaaagctttcatcctctcagctttcacctagtaattcaaataaacccatttattaaagaatagaaatggtgtcaagcaattttgaataattctgtttttgtttttaacctggaaatctcaaactgaaaacgagtttctaagatctatttaagagattatctcaacaaatgtttctataaaatccttaatcatatgtttagaaggcatgattatttgttaatcatatcacacattacaccaatgtttgttttttgcgtcagacagtaatgatgattctacatacacatcggcagacccaggattgaagaatagggggccaataatcacacaaattttctaaaaatttattttcatttgtcaaatacataaatcaaaataattaaattatacatacaaatatttaaattaattatattttcatttgtataacacatgaaaatataaattatatttacgcatacaatataaattaacacatgaaaataaataaataaagttcattttatgagataaaaacaaataaaactatcaaaacatgcttgttaatattacaatatgaaaaaagggatatgcactaataaactatagaataattttacagttaattacaaattatcatgtataataaatttgttaattttataatgactatcttaaaaattatatatgtttattaagatatgttatacacttctactaataaaagaattccaaaatttcaaaaaagtttaaattgaatgaattttcaaaaaacttatactatatttttataagatatctatttacattcatggaccggagccacaaagagaagcccacaggccacattcgatatttaacaaagcctttaaaataaagtaaaatcttatctaataattaaaaattaacaaaataaatcacttaataattaaaacatttatactaattacaaaaaattaaaaaatgagggggagggggacagtccccccttggttaacacccctgaaaatgcatgtttagtttttaggtaaaaaaaattcttttattttcatttgtataacatttataatttcaatcaaaacggacacaattgcagatgtaaaaactttaaattgtacgattgtatgcagtgaaaagcaactttttcctcaaaccagagccttactcgtgaaagcaatgcatgtctgctacctagaggaggttccatcagtataacataggaactatgaatcagaagagtactggtttgaacctatcaattacagagagtacttactttacttaaaaacccttgtgcaatttcagtggattcatgacaactcgagcgagtttcaaatataaatattttttctattctatattccctgcatcgggaaagaatccaggaagaaatataaaaatgaaagatcaaagatccctgccatgccatggtttcttttcaagaattattctctttgtcagtctatttcacagacctttcaactcttctctactcatgagctttttcccgttgctaacagggcatgaaaagatgagccatcatcttcagccttggaaaaggttaaaatcattgacaacagatcgagggaaaatggttgttgtactactatgccaaactacttttgggagtgccagtttcagaacatcttaataatagtaatatgctacactgtaagaacaagaacaaagcaagtaaagatggtacctccattttcttcatttccatttcagcttttcttatctgatgattttcccaggcttgaatcttcacctcttcacgcttgaacctaaataaagttttaacaagcaaactttgttaacactcaacaatttatcattaattcattgactcctaaggtccatgaaccgtcccataaaactaacctggaacatttttctgaacatgagtacaatttacggcaagtgtttaataattaaaataaactttagtattaacatactagaaaaataaaataaaaaatagtaatgaaataatttatatgtaaaatatgtcactaaaattgatgagtgtcacattttataattctgcactctattttaatttaaatctttcattttatttcactttcacatttatttcattcttttaaactaaacataccattagtgattaccataatcagagaaaaaaacaaattttttgttactaaatttgatcactaattgtttggtttttagtatttgatcataaaacaaggtcaatagcaaattaattacctggccataaatttggcacgttctgcctcatcccaagccattgcacggctttctagaggactaaattttctagcttgatgatcttcatgagtcttcttgcaagggcttgttgatccttgatctccacacttcctattagtgccattgccaccttcagcaacttgttgcaacccattttgacccctcattggagttgaagtccctgaatgaattgggcttctagtagcaggagttgtggctctaattggtgtcccagttcttgaaggctcttggctagcaatcggtgtcatctcagtccccatgtctctgaaacatatcggttgcacttggattgtgtttcctgaagacctattgtcattattattattattgtttctccaatttgactcatcacattctacccttttggcttcagcttcatattgagcagcaatagcattagcactaataatattagtcatgaaatcatggcaagcattattttcctcctcttccttctcactacttgagtaatcatgctccttctgtggcacaggagctatgagtctcaaatcatctgcgtttgagtttcttggcttgcttttggagtggcttttctctccaccttttgacaaccccacaagccatttttgtgcatcatcccacttagaaggggttggttttcccatggttgctcgatgatggtggttggagacacgagtagcatcttttcctttgtgaaaccctgagtacatggcactgctatttggggtctcttgtgttggtccattgttgttatagcaccctttgtcctccacgtatctcattctcaaagatttctctcacaaactcttaactttggcccaaacactacgcagggaaaatttcaggatctacaatttctgttccagatcctatatatggaaaagtcagtatgatctatgttatgtcttgaaatacctgttaacaccgttccatatatctgacgaaaaaaaatacatagtgcactggcatgtatatttaatttgtctttacaaacatgaaaaacagatccaactgccaaaatagctatgtaatgttaactcttgttgattcagcaaggagaccctaatgaactttgacaaatacttcagtctcaagcattaaaaattctgctgaagacctttttactaagctgaaaaagaagaactaaacaaagcctaatgtgcaatgtttgaaagcaaaatacactcactcattgagttaaaactttggaatctaaggttgttaagtgctttggaaatgtagtgagaggaattaaaacagagtaactgaagctgaaaatgtagttcacagagtaaagcttggtatttaagagaatgataccttatttcagagcatgaaattctgagagttgcagaggcagagatgaatttcagatccattgaacattataatactacccaaataatatgcatggtttcagaaaaaaggtttatcgttacgacaacaataaataaaaaatggtcagagggaagaaacatagatgcatagaatagccatttatcttgggcattggtggacttttattactgaacaatgcaggtgccatgtggggtggaatccacatttcatcttcaatgtaaggtggcagaggaatcatggaagtagtattttggcagagaatgactaagcaatatactatcatagattttttcctaactattctgcatttgagataaagttatatttaaaattaaaaaattattaagaaaataatatttgatcttaagtctttaatttactgtatctctaaatatttattattttatcatgatagtattaaaaaaaatattatttttaattctatataggcaaaacgaatattattaatacttgtaagaaagacttaacacaaggcgtataaaattcagctacggaaatttatctttaattattatttttttataatattctcatttattgatatattaatattacttacatacttaaatgaaatttgtaattgcattttaacttttttaatatgaatattttataaaaaattatattaattataatttataggtttaatattcattatatttataattatgttattttagtatattaaaatttaaaaattttattttgatcatttatttttttaaaatatatttttttaatctttttgctaattttacaataaaaatgtcacattttaaataattaatctaatataatcatttttaatcatcattatcttaaattaactatttaaatttttaaacaataatgaagagtaatgtttctaactgaaaaaaaagacaataatacattttgaaaacataaaaaaataaaagaaagaataatatttttaattagggtaaaaaatgatgataaataatgcgacagcaggattatttttggattgaagtgtccatgagatgtccactatgaagaaaaataatatagtactgtttcctagagacagcatgttaaaactttggttgtcctattaacggctactagattgagaaaaaataatataaaagggagacacgtggacggtgggatgtttgcaagaacatagacgaactgtgatactcctgattcctgaccttttcagttttcacgtgcccatgagagagagagccgtgcttccgaagatacggacagtttcataaatttgattgtttccacatgggtccatcttcaccaaaaactatcttatgccattccactcacaattactatcaatagataaataactcaccaggtgcaaagttaagtgtttgatgaatcactatgatttattcttataaaagatatgtctgtgggttgagaatagagatgatatttataagtaatctttagttttgactcttgactaatgtgagatttaatgactataacaacatattcgaataagatttaattgtgagaagagatcaataatattagttacattttaaaatcattaattatttttcttttgaaaaaactgattaagatattttaaagttactctcaaaatatcaaaacttggtaagtgagtgtaagttttaaatcacatggtgcaatgtgaagaattggaatagtatgggaccatatctgccatctgggaagtaccaactgacagaactggcatacaaacaaggaaatttcctctgctagaagaggaaacaagatggctctgtttatttacccatgcttgctccattcccccaacccaacaaacttagtggatttattttaagagtattaattaactgttctattctttctttctagtatctacgggactctgaaaggggttgcgagtggatcgtcattgtgttgtctagttggcgtgtgaagatagtaatgaattaacaaaataacaactaattagctactgttaagagaccgtatctaaagagaaggaacgttagtatacatacaagtgtatgagaggcagaatggaacgtaggtgataaaggtgttttaatgatccaattcaatttcaattacaacatccaatctaaaaaatataaccaaaacactgcaaaataaatgtttgaaaaaatgttgggttgatcttaacccatgttttttttttcaatccacaagtatatttcctttttggcttgaaaaagtgtgaaagaatgttccatgtctaaacatgtactaaatgtgtttggaaatatgtcatgaatgcaagtctagttaaatttttacgtcaacaacaacgcagaagtcagctactcattgtagcttctgccttaatgtagattgtggatatgatgttaggatgtgtttccaaacatatagtaagaaaaatttaaaatctgcataaaatccaatatttttttggataatataaatggaataaaattattatacacttattaacattaaaattactttgtcgcccttgttgatatgatgcgctccatatttgcaatgtaaatatgtttttatccaaacaaaattatttttatattgtttcgtattttcaatctcaatttgtaatattaagggagtctatataaattagttgactaagaagtatgagttattataaattcttaatatttatatttgaaacatatagataaaaaatctgaatttataatgtatataactatgattttattcataatttttaatcgtaaattagtgaaaaacaaacaaagttacgactgacaaaagttaagaattgatgtgaaatttttaatttttttatttgatttactagttatatcattgttttataatttactttattatttaaaatgctcatttgttatatcttatttgattgacaagtttaatatttataagtttttaaaaaattgaaaattaatccaaaccaaatcgacttaaattggattggataagatttggagaataaaaattcaaaacgaatggatgattaaacttaaaaatgattggatcatatgattcttttacctaaaaaatgttccaatccaaataagaaaacctttcgtttgattattttaacatttgtcttagttttttctccataatcatttgttgggtggtaaattgtctttgacctgaaaaaatgatccgagttctgatcaattgcatcgccctttcctctgaaaaagttgtcttagattgtgatgcagaacaaaatagacaccaactgaagggtcctcaataagaaaatatgatggcatgattggtgactatagaagtgccaaaatgttggccgaaacagcaaagtaaatgagtaagaaaaacaacaaaaagaaaattattagggaaacggataagatctaaaatgattggatccttatagatgagatatttatattcctttgagcataacaaaattggaagtatgagatgctatcaacaattatctccttcacatacattgatggagagatccgatcgagatccaagttgtgaagtacggtggttgagaaatttatggaatggaattatagcaagagaaaataattgaatggtaagtgtaccctggtgctgtagtctgtttgagatgaattagcaaaatttgactttgagggagaggatgagttccttatctggtggaaggtgcagtagttacaaccggtgactatgacaactttattactcatttaaaggttcagttaatattaggtgaacgcaatatgaaatttggacttgatatgatttgttagggattttttttctttattcgtagtttttgaaagcaatatattttaaaaaataaattttctaaaatgactcagattaaaataaaaaccttaaatatgttcttatttatgatatatacttgaattttgcttttaattcttgatataaaaatttattcttaagtattgttttagattcttacattagttaattgatgacgtaaaatatttgataatgagatttgtgacgactaaaaactaatacgattattttaaaatcaaatttaaattttaaaaaaaactgtcataatgaattaaagtaaaaaataaattttaattgaagaaaaaaattagagttgaaataaggatgttaagatagatgtatggataagataaaaaattgagatattcagaaaaagatataaatgatatctatatgtgaaaagatgaaagaacagacattgatcgaaacttacatgaaaaataatagttaaacaagacctaatggaatgaaatatagattgataaagagtatatcttagaacagagtagaaaaaagttataaacttagtagaggaataaacccattaacagattcccattatttctttattttaattattttcttcttcttttttcccttttgtcttatttcaacttttttttttcacttctctttctctttcaatctcttttatgatttatcattgaattcatatatcactaatttcatttaacttgaattaaagatgttattgatgttaaaaaaaaaaaaccagatttgaaaccaagcgaaccagaactaccaaaatattgtcgcaatcaatcatattagactcaagtttctcctcacaaaccaaaatcttaatcaaatcaaatacaacaacaaatcataaaaaatattgtcgcaaaacctagaacagagaaaccattaattctacaacattttcaccatgcagaatgtggaccaaggacaaaaatggggacgaagggcaccgtttggcgaaaatggtgatgaacaaatcaagatgagttcgacctcctcactgacattgcaaacgatggtagtggagacgtagaagaatcaacgaacgtctacctggactgggcggtaggggcgacggtgaggacgtcgtgcacggaggagttgcgagatcgagagagcgtctggaaccacaaacgcaccataccacaaaagctccaaatttttatatctaagttagatctagattgtgacgaaaggaggtggagtcagatctatggggtttcgagtgagaatgaaataaatgttaaggttgccagttgtcggtgataacaagagttgcgatggttgtcgcggaggtgcggtggttcgcaaggtagagaagaacacgatcaatttgcttccaccagagtcttcatgtcatagatctcacatcaccagaactttcgattgttggtggtgctatattgggttcagtggtgtcgctggggttgcaatgtgtggggtggcaggtttggatgtgggtatgtgttttgttggagtggagacaatggaataggaggtgggtcagcttaggacttttttttaatatatttatttgtttattttaattaattttggcagtttttaattataaaaatattgaatttgattttaaaataaatattgaaagattatgttatcaaataaatatttaatagatgcgtcattatttaaatgacagatattttaaaacaatttttttttttgtatcaaagaacagttgaaaggagtttttttttatcaaaaatcaaacataaaatttggatatatatcataaagattggatgacccctgatccaaatttgtcagatggtaaactcaatcaattctagacggctaaagggtatctttaccaacaaaattcttaagctcttcctttgctgcttccatcaccaccttaaagtctatatgcgtataccttcccctgtaatccataataaaatgttcaggtttagcactttgttctaaagaattatttaaaacctgcacaccataaaaaacaaaaataggagggggaaaatatgaaaggaacggttgctgctcactagattttcctcctctttttgtttcccaaacaaaagctaaaagttttgggacagcaaatcatgactaatgttggtctattgagatattgacgcatgtgtgtacacaattctaactaactaaacgcacaacagttcaaactcacccaatttatttcctattttcgagcagtattaaggtcatgaagtagaaaaaattgaatttcaatgtaccagaaatgagttttactccatgctgttgaaggataagctggacttgcaattccatgcattaccctcgcaacagctcttggtgtaaatcgagcctgtgaattgctctgcagaaagacctggtgatacccaaaggaactgttaagatttcaaaactttttcttccaatttttttttaagattattagaatgctcaaatgacagcttacctttagatctgcccgcaggaaagggctgcatatgtaaataccaccaattttagtacaagaaaatgtagcatataagtcataggttaaatttttgttctatagtacagagcttagctcaaagaaattagaaataacctgctttgaccgattttcttgcagaaatcagcattatcaactccagaaaagtaatccaatattttcctttgcaagcatggtgtatgattggcaccactgcaaccttgcatattatcacatatatttaatgcaaaatatgcagcattaaacattgcatccatttttcgtacctactcaaaaaatagaaccatgagaaaatgaatcaatcattgataacttggacatcaaatttgactacccaaacccaatggatgcaacgtttcatctaaaacgaatgatccgacaagtactaactcaaggttcagggtttctgattatgagaggaatacgggacaatgtcataacaacattacatttcaatttttgaacccccaaaaggaaaacaattgagcaaaggatacaacattctagatgaacatatttaaaaaaaatcccaaataaataaacatctcccaagtttatcagaatttacttaccttacaattttcaacttctgataaccatcgcgtaatatctgctgatagagataacaggtctgttgggacttcaatgatcctataacagtaggccaagtccttcatttcataagttatttctcccatcaactgagaacatttcaaaaataatgaggtcagattgtatttatattattgcttcagtaccacacacaagggtagagagccatgtgcctatgccaaatggttaggtgtcccaaatcagaatcagattagaagcatattttgaataaaaaattatgggcaagattaatctcaataaaaaaaaagaatgcactactcggctaaacctttccagatcataacaaaatatacagcttcagtgtattgattaatgaacgtatcatgtattgtgccgaaaattttcaagacaaggaaaactagcagagttttaagatgattacgataatcaatacataaatcacgttgtaagtatttatggctataatattataaatctaaaaaatataataactttgtttttctttcaatcacattcatcagtatgtaccatgagtactgttggctaattggaggtttaatgcagtggcaagtatcggaagcatttgtcctttggactactattcagaatctaaacttggtaactacattattgtattcattcccagtttcatttgaaaattttaagaatgacatagtgatatgaagatgtttcccatatcaaccttcaatcatagcatctgacatcttcccttgaagtgtagttactcagaagaaagaagacttgtgcacttttgaaacatatttgttaagcacacatgcgaactcaagaaaaaaatatatcccctaatccaaaccttcaggttgtacaactgatttgttaattccactgctgtaacccccatgtcatttgccacagttggaatatcaaaaatatattgcccatgcttgttttcagatctgaaaaatcacacaacaaagattcaattaaacagaagtatgagtgtaagtagaattaaacggcttttctatataacttcactttatagaaactaaaaatttggagccagactccatgttgaggtttacaacattaacataactcagttggaaaacagtaccatccagtggaaacagggggaaaggtgaaaggccaagaaatgtaatatgcttactattattacctttttagaattacagctatagcagaaaccttctgagcaagtaatggcggaggagactgcaatagtgccaaaagttaaaaatacaagcaactaaataattacggaaaccatatttagtttctagatttcagttaaaaattaacaaatagtagtataagattgagatgtcctatctgaaaattcaagtttaaatatatagatttagagagatggcactcaaatttatctatcttgcgtggcaaattctacatgcaaaggtgagtctggcacccaccttgtgaaaattcaaagtgcaagttatatttatctgtggatgtaactgcaggtactgtacatcacccaactccaagcgtgtcaaaagtgtaagcatcacctggtaaaggaaaatataggagaaatattttaaactgtagacctagactaaaataggcaacgtatgattatcttgagtttccttacaggaacatgtttcatttctagcatgttaaatctcatacaaatggatagagattagtgacccctatatctagatgattgtccaaaaagaaaagaatcttaatcactggaaagaatcccaccttagctttatctggttcaaagttaatcttgatctctttggtttcaagtacttagcaaagaaagataaaacaaaaccagattttttgtacaaacacagatatcatctacaatcaatatggcaaaaaatggcattttggcatagcatgcatatcctacagatatcatcctaatgacaaaaacttgggagctatccccccagcccctctttatttatcatcaaaatatcaagagaatgttatgaaatctgtctgaaattttaattgaaagttatttgtctgagaaattagacttaataaattaaaatgaatagtagtacagagtagaggacctcttctttcatatcaaacctgcgtgcagcagattctttgattaatgaacagattttcccacagtagtttttgtcagcaggaaacacttcacgcagaaatttgttcactgcatattcatccactccttcactgaggataaaaaaaatgcattaagaacattttgacagtgagaaaaagttaaaaataaaaaaagaatcgtattacctgtgtgttagactacgaagtttgaaatatatctcatcatcataaaatagatgacagtaggacaacctcccatcccttccagcacgacctatttcctaaaataccaattccctttattaagcaaagcatatgatagaatatcttgctatgctactactaaagtttagaagaaatcatatacctgtacatactcttccagactttcaggcaaactgtaatgaattacctaaacacagatatgataatggagttccagtatgaattactgtaatatgcaagataacttatattgcaatacaaatatgtagtgtgtaaaatacaagagaaaagtatacaagtaatgctcaaaaacttcattttttgaatattgaactattaactaaagtaactaccagtgcatttgcatgaacagagaccagggaaagagattagatgtccaagaccatgcgtccccattttgggattttaagcataaataaaaatcttttgaagaagaatcagttgttcctgatagagtcaggcttcaaaggtttgaatcataagacacatggaaaagcaggttaccatgcaacaagagcacaatgagaatcagtaaaccactatatgagcataccatcctagggaacttctattgtcataaaccagttcatgcaaattaatgcagaaaaccataacatgttgataagccttacagctccaacatctcttttatctagtcccatgccaaatgccactgttgcaacaaccttcataaaaaaatacaaggtatcagttggctaaaaaataaaacaagcaaacacaaagaatactagtatattatccctgcattgcatggtaaaataattaaaagttgctaaattttatatatagttgactgtataaaaaaatgcgtgtcataaattcacaatattaatgattgaaccatagaatttgtctcaccactctgatcttgttggaattaaacaactcctgtacatagctacgttcctttgcagtgataccactatgataactctacatggtaaatcacatcaatcatcagatttaaccctcagtgtcaaatatacagaaagacatacaatgtcaaaaaaaaaaattcggagctaacctttgccaagatattgttatcattcaaatatctgctaatttgatcagtttcatactggaacaagaagaagcatcattaattcccaccaatatagaaacgttacaatagattcaattatccactatataaaaccacattttaaatctgagccataaggatctcactaaattttttcagccaacaatattatacatatcaaatgctctgagctagaagcaagaatatattgcaatacaataacagttgagtttaagaaaccatagaacatcctgtactttaaagttgacaaaaaccagtccatatacacacctgaaatttgcagtatatgatgatgctttgaacttcaacaaaaggaggagactttatcaaattcagtaggtctttcattctatcatgatcaaaatgttcaacgtatataagttcattgatgtataagtttaacaaagttgaaatgacaaaagtatacaagctgaagcagtaaatagaagcatgtgacttgcctatttctgaccatggatactgataaatgaaaattgtcccttaactgcgccttctgaataagatttgtggaaggaatatctagagcagacatgatggcatctaaagttgtggttgtagcagttgccgtcatagcaagcacagaacgaacattaagtgtcttatgaagcagagatgctctaagtctcataaaagatggtcggaaattgtgagacctgtaaaaatgttcaaaatttcaagatcaaccaaaaagcagattaatatcagcaaaaaacattggaattccctcaccattcagatatacaatgtgcttcatcaataacaacaagtgagatggctggcaaagaagaaatagtagacagaaagtcctcattcagaaaccgctctggtgaaacaaaaagcacctatataaattaaaatttccaacattagcattagctttatgcaagagtactaccatcacccacagataaacctagaaacacaacatgtcatacaacaatgtcatgtaaacaatcaactccattgtatgcaaacaatctgcaagagtgctacacaatttgagccaaagttgcattcggaaattcagttgttgaaagtcctacctttatccccccttgacgaagctgcttgagtgattcagaggcttcttcaggtgtctaacataagtagacataaaaagatgaattaaacatgaagaggtgaaatgatgatatcctgtataacaataagcacttataggactataccactcgctaagatgctaactagtctctcatccaaaatccatttaagttttaaaaattattttcaaaacaagtgtttagatgttttctattttattctattttcatcttattcaacatctcccttaatttcagtgtctgttttgtacctttccaccagttgtccttgttatagttgtattttgaaaattaaagacagtttttgaaaatagaaatcaaatacaccctaaagttctcccataaattaaaaattaacttatgcataagctaaaatcagtttttgaataagttaaatgaaagagtctcaataaaagttaaagtcaataagttgattttaccttatgtgaaaaccttaattcgttttacccttttattattatttttttctcttacaagtgtttattgagaattttatcctatcaaaatcaattaaccaaagtatataataacactgcacaagggagaatgtataagagtttacaacacctgagtgctggatagaagaccacccttaatcacatgaggcaattgccttagctgatcaatcatcaaagccaccaatggactaacaaccaacgtaaccccaggtaagatcacagcaggcaactgataacacagcgacttcccagcgccggttggcaaaacaaccacactagacttcccagcaagaaccatcttaatcgcctgaacctgcccatctcgaaaacaatcatagccataaaccaatctcaacagcttcaccaaattctcctccgaaggctcgtcacgtgcggcggccgcagcctcctccaccgcatcgccatcgatctccctactcttactaccccctctctgcttgaattctccaattgcctcctcttgctcctcctcctcctcctttttgggctgcgatttgaacctccctctcttgtaccttttcccgccaattttccctctcttgttcaggaacttctttctcttgccattcaagttgagcttcacgaagttcccatcgcctgctccgcttgttcgcggcttcacgctcggtatcggagcactggagccgatcaggttgggaagctggctctttctgcgtttcctcgggtcggcactctcggcgcgtgaatcagacacgccggaagtaaaaaccggttgttcgatttcagaaggttctagattgaggagaggtcttcgaatcttcgagaaggaagcggagagggaggaggagaagtagccggcagggagggtttcaatggagtttgaaatcgacggagcgtcggaaggtcgccggatttggaaggggagatcggtggggagggagagaagggtgccttgctggaatgggtcgggtttggacagggttttggaggatccggtagggttcggttttgattttgattttgaaggtttgattctgattctggatttgtttgaaactactacaggtggtgatggaattggttttcttggaggagtagtggagatgtgagatccgtcggagtctgaatcggactccatttggattctcttggatcggaacacgaaaatgaagaatggggaaggaaaacaaaagaagatcactgaataaaagctagctcccgccaacgcgaatgttcccgccagttttgtattttgtttttttaattgttcgagctcgggttttgggcctattggccctaatcgggtcttaaggtcaccattacaggcacaggctacggtggtcacttaaattccttgtgttttgtggtcaagtttaaggatggccgttagatttatgtttttttatattcgaagactagatttagtccatggacgtgtgtaccagttatttgttttttttaatgattgtgtgataatttacatgtttggccttgttaattattatatatttttaatacaaaatctgaatgtaattgttaagtcaaatttacccattgttgattgaatggtgattttttttatttattaattattgaaaattaaatgtttaagttgtgttcgttaagaatactgatgtagttgagagtgttgatattggtggcggtgcaatgaatgtgatgtaatgaccattttagatcaacacgtatatgggctttacaagaaaaacaaatctttaaaaaaaagaaaagattttcccacttggaagaaaatttgagattttaaaatgttaagattttactaagaattttttctaacttctcattttattactaacaatattatataatggtatttattaaaggcctaagatcttatctagtaacatttgtttggagaggatccatcttaaaaggaaataaacacaagaaaaaagagacattgatcgatatactaaataatgtaacaataaaagaataaaaattgagatggggataagatggaagagaagttggatatataacaataacaataatccagagttattaaatcgcctattatccatcatgtcacaaaagacgatttccttttagccaataaataaatgaaaaatgtttgtttgcggaaattcatgtagtatgaaaagtgttatacagataaatgactcctgattaatagaatagcagaaacaacgcatgtactgataaaaaaaaaacacgtgaaaaatgttctcaactccgaactatgacactacaaatcgaaatgcatgtttgaatggtatcataataaaaaacagcaacaacaaaacaagaacaagcacaaaactaaaggggctgacctcccaagtcgatactcagaatcaccaccttcgatttcctacaacttgaaagacgcctctatttcaacccaatcaacatgacggagtactagaaacgccaacaatcaaccttcttcaacgaaattaatcttcaaaacagaaccctacaaagacaacatagggcttatctttctgcctggaagggcaaaacagtatctcaagttcgtaaaggacattctcgtctttctatgttaacttaaatataaaaaattaaatttttaaatacggacccacttactatacccagtttgtatttccttgaccacaaaggaacttaggtgactacattgataaagaatatttatcaattttattaataattaatttttattgaagaatttgattaatcatttttaataagattttttttttacaatcatattttttttatttacaagacttaaatccgacagtttacttaagataactaaatcgattacctctccacaatgacttgttggtttgattgcagctttagattgtgttatttgataacaataaaaaaaaaaaacttgtttttgcatggttccatttggtctgcaaccgaaaaagcttttggtgggtttagggttgctgcaatggacttatcccttgttttagctgaaaaaatagttgcaaaataagctgattgatgaaagaagagagggaaatgtagcttttaaaaatgtattgtatactttaacagtttaagtgtttaacctctttctctcatcttaaactaatctaaagagttttaatttaaaaaattgtcatacattttctacttcatttttatatttcttattttaaaccttaactttaaaacaaattttaagctaaaaaaaatactaggccaaacatatcgcatgccatatcatttaatttttcctatattataaatcggaattctcttatttgaataagaatgtttttagaaattattctcactctcattatcataaaattatatctcaaaaacttaaccagaagcatttcaaaaatataccatcaacaatagttaacgttagctagtacccaactcctattttccccggtggaaaaacaaagtcaacccaatttaattcacactgatatgttatttcattcatatttttcttttctttctattgcttttttataacaggggaggaatgatgcacatgaataaacttctagcaaagaaatcagaatgcgtttcacaatattaacgaatatgaatgagttatacttcacacttccattgatggatcatcatctcaatggaaatcaaataacaagaatggagcaacttgaggagcacaatcctccaattgcctcaaattaatggcctacccacaaaaaaagaaggggaaaaaaaaaataactttacaattatgttaaacacaaagttgcatatcttacgatatatattggagccgacaaataacaattggctattatcccaaacagccataaacctaaagccatgcgcaagcatttggctaagctctgctctggtgtatatataggccaacgagaagagaagaaatgctggcacaaattataagggcaatttaaactttgaactctcacattatgatgcaattacactttgattcaagcttatctggaagaggcttcatgttgtctactttgttaggaagcccaacattgagtgtcgaagactcggcaatattttcatcattctcagccttggaaggggattttacattagtttccaccatcttgggccttgccgccttctggggtttcatagcatgcttgccagcagttcggctgcaagagtcctttgtatcggaattgggtttcgccaatatagtcaccgtcggctcagaaccttccaatggttctgagtgctccttttccattgctatcgttgcagcctgatatgcaagatcatggatgacagagctgcaaaaaagtatagtatttgttgcctcttcaagtgtcaggcttctagtatttcctctatcttgacactccaacgtaactgtggatctctctggcataaaccattagaaatctgtcagaaatttgccaagtactaatattttctccaaataaagctttagcggataaaatatattacaagcactaaagaaaccatgtacaacatagagaagcagaatctcttttcaatagaaaactgaagcgaacttatcctcccccactaataataaagtatctgatcagatttcagaaagctcataaaaagatagcaaaatacagccacaatgttagtagtataaaacacacaggttcctgtttacaagtgccctaagggcactggttatggaatcaataaataaaatgtttttttattgaatattacctaaggttgcattgggaatcatgggggaatgcattgttacactttctaataaagaaattgactactgattccttaaccagctcccttggttagcgtttgccaaacaaaaaagttaatccaaacacaatttttaactgataagctagaaactacactactaaattgatgctgactatcttattcaacataacgatatcctaacacatcaggcacttcactcaagagtattatccctgttataaaaaatatgtcaagaaaaaacctttcaaggcatcctaacctactctcttagaaatcaaaactacaaaatttgagtagatcaaactattaatatcagatagagcaggagaacctagaatagacagtcattctataaatttatgtatccctttaaattgccaaaaattaacatatgacaaactgtgtgtgctatggacgagtgcattgagtgatacaagagaataatagaagattcttatagaaaattttcatctcaatcatcattggcaatatcttctgtttgaaatttcatccaacaagcatcatacctatgccaagggagtactcggaggcatggagctcagaaatagaagctgcaagacaatcactggaagaattaggaacagaatgttcctgaaagtcatcaatggggctctttgacaccagcgatggatcaacatccaccacacaagtatccttctgacaacagttttccacttctatttctgattcttcaattgtagaagtgttgatagttaccaaagcatccagtccatcaacattagaattctccatatcatgtttcttgtcaaaggatgactctggatccttaactgatgtttccatatttaagacactgcttacattatttgggtggtcttcagtactatcatttgaaatagaactcccatgatttggaaatgatgacactgaattgtcgccatgctgaacaccagtagcttggcttactaactctgagctccaagcatcagttgttctaactaccccaatcatgatattcaagattatcttccctgacaacaattgaacccatattggaagaatcaatcacatctgtcactgcattttctgaagcttgcatttctagtagatcttgaggtattttcttcaggatgctgcattctgtattgccagaactttcttgtgtagcaaaacctaatccatggtaagaatggtttgacattcgagaaaaagataaaccagggcttggaggcctgatcctaacatcatatccatagtctacatacaatttcctgccacttgactgcctttggacatgaaaatcagattgtcttgctgagctaaaatcggcagatgatgaggtagaataactgctacgcccagttgagcttctaatactgttaatgcttcttcttgcaaaagacagatcatcgtaagatagcgtcgtggcagtaaaagtccggctctgaattacatgtcctttgctactgcttgaccttttcaatagttcagaaatgccagtgccttccaagaggtccactttcaaatttgagcgatcgttggaaagatacaactgctgatcaccagaatcattatcaggcttcttgtaatcaacccctgactggtccacctcaagctgattggcaggcatctgcccacttctctccaccagtgaactggagagagaattttgttgtgagtggtcctgaataaattcactgggaaaaatttgactttccacagcatctggttcagcaaggggaaaccttgtgttacccacatcagtctcttgacgcagtttagacacaagagttagttggtctgtttcggctgatggtttttcttctgcagggatgttagtggaattcactgaattgtcactggaaacttccaaatttgcctccgggatgacatgtctcaacaatgtggttttcctgctacattctggacacagtctaagattcttctcagtttgatctgtggcctcaagagggaaaccacaatgggaacaaattgtattctcgaaaccaccagtttcagaaatgtcacctatgacattgaaagttgctaaactttcattgaattctttgtcaataccatgattagaagaagcttcagattcagtaggacctaaagcaatcacagggcctctagttttggtgtgcaggatgtcagctgattcatcattgatctcatgcccaatgtttgtatttaatccatcaattttatcaaaggaacatacttcttcacaaatatcagtgtataatatcttctcagtcgcacgtgccacatcttcttgattgtggtcactcccttcagtatctggcgcaaaacttgtaccatgatcagagctcacattgctgcttgttgtgacagaggagttcctagataccagggaacgttgtgcagaatttgcttttccaacatagaaggttgtacttggcacactagataaaagaggcctgaacatgttctgaggactttttctatcctgcatagcattgtgagtaagaactaagaagtttgattccaaccaactatttgaagacataagagaaaaagatcagggcaaaaggtgaggggaatagggatgactgaacaagtttttacaagaaaaactcatgactaagaacagaaaatgtgttaaccttgttatgataaattgataatcatgtaagtgtgtgcatgtgattttatatgtagcacaataagcaaactcattcatgactttattgaagccatttatttgaataattgtcttctcatgtgtagtttaaaaataaacttactgaggaaagaaaacatgcacacaagaggaaccaaataaagcattgtacttaaaaaagattataaagagagaaataaaccaaatatcatatcagagttttgatcattggtagcctagaataatctaggatggttggttcacaccactttccattgtagactgctttgatttcaacagaaaaacaatgttctaatttattagcatatatcaaaaggaaagtgcataaaggaagaaaattgtgtgcacggcatgcatgtgcagggccagctccacatatttttaggcttaaaacaaattttgatatagccaacttaggaacatcttatgggctaaatttggtgagaattgatatattaagaaactatctatttaattgaaattaatgaataattaatttttaagtgagacagtaacaaaaaattaaggacctaaaaaaaagtaatttttcttccaacagggttcgaacccattcaccaaggacaaaagtgcaccttaattaccactaaactagaccaactagcaataaaaattataaatactaatactaaacaactttttttctgaagggcctaaaaaaggacttggcccgccttatgcttgggccgtatctgctcatgtgtgtgtggaaaatgagtgaaaaagagtccttggaagaggaagggcaactaccaaataggaatattcaagatttatatggtatgatcacttgccagcacattagcagcaaactatggaatgattatgaaaggaagttaagagattatgcaacaaaataccatttgctggatagcagaatcaaaagatcttttaggagcagaacttggggacaccatcctggtcgacttcttggaaattgaaggagatttgctgtttgaaaatgaaccatcccttcttgaaccaaatcggtctagactacccactgggatggactgaagagagtccagatcatcatcactagaagatacaactgaacctttgctgtgtgaactaaattggtctcgatcatgactacgaatataactggtgctcctggaaggagttggagacattgattgcctaccaaatttagaagtagaatccctactatttttggatgctggagatgaacctctcacatatgatgctggttgatcagccaaagaggtacggagattgagaggagcttcagaagagaaaccaggaatattagtttgccatgctcttatatttggtgaagcagagtttccacggcttgtcttaacaggggaagttaccctaatccccaatgagaatgcaggactactggagccagtgctgattcgctgaggagtaggagtggaaggcctaggagcaggtgtcataggcttagttggaggtggagatggtcttcttgttggagtagcatatcgtaaaacttgagttggactaaaatttggtgttgatgaagaccttcccctagattgcgatatattattcccagaacgaggggatgaacttaaacgacttggacttgcactacccctactgcttttgtaacttctctctgtctgaaagaggacatccaacaaaagatagataatgagtcaaacaaaaactaaatttttcataaagaggagaaaaagacaaggaatttttatttaagaggcatttgtgcataaaatggatttgaaagcacaccgtagatgatcttgatatggaaataggtttactccttggccttcctctgcttacaacatttatttctggtggttcatcatctaaagaaggaaacagtggtgtgtccggtggtgtcaataacctttcaatgattaaaacagaaatgctgcatcagcaaagtaatatgcacatctaattctcaacctttgcgaaaaagaaaaatgaattattgaccagacaaaatggtgcactattaatgtgaaagaaacataattgcaaacagttggacttgaaatcattaaatttgatcatacaacacaaacgcaatttaacaaggaaaaattcaaaagacagaaaaggctacacaccaatcatagtcattcttgtcaccatctgtattaagcaattcactggtttctcctcgaccgggaatggatatcccaagcttgatatcaggaaaatctctcaacttcgatgctgtaaattaatatccaaaacaaaggggagaaatgcatgagtatcacccaaataaagcaaaaaaaaaaaattacattctcttctcaagatgagagtaaaaaaattacaaattgagtcttctaagtcatccgatggctgaagcaaaaaactctcttcttctctggactgcatttcactgaacaaagcaagatcatcatctttctctctcaagggcaatccgctttcaagactgcgcccgcgcttgtgactgtctgatcttggctctctgccgggagagcttctaaatgatagggaaggtggcatctccactacccaatgcagtgtccaataacaagtgtcacctcaagttctccatacaatccaaaggcaaaaaccttcaacaccctaaccaacaaccaatgattattaacacataccacaagctcacgacaaaattcaatctccaaacaacaatatcagcaaaacccactttccttcgccataaactctctcctccggtttcattactccttgtctaaacacttataccatacccaatgtgactgagtcaaccaacccacataccccaaaataaacaaaacaaaatttggcatattaaaacagtaacaaaaacaactgtaccattcaaaacgcaatggctaacactcctgagcactcatgcaataagcatccaaaaccaatattgaagatacccctcaacctgaaacccaagaacatttgccagtagcaaatcccaattacgccgttgccattaccggccaaaagggtagcccattcaaacggcaaaatttaggcttgagcacccacttagccaagttcaaggcacacagctaaacttggttcaccaaattctcacccaagttcgaagattaaaaaacaaaaaataaaaataaaaacaaaaacaaaaaaatagagcttaaatgccaattacaatgcgacgaatgttgtctcagacacccggttatacagcagcattcatggcttccagagcaaccaaaagtacagatcagaaccagtgtgatccaacggttccaacaaactctaaaaaaattccattattctctctcctcacaaaatcttttttttttttcagttctgaaaaaataagaatattgcactgcaatttgagaataacaatattaatactcaagtactcaacgaaaacctttgttgttgtccttcgataatttcatttgttgttttttcctaaacagcaagcattctttccctttattttttttttctctcttaaccttttcttttcagcttccttttcatttttttcctgcggttaccggtgccctcgtaaattccctatgatttccattttttttaaatcttgttttctagttttcataattttgtgtttgcgtataagaattaaaatgctaattagtcgattttgatgttttggattttacttctacttgttattatagcttatgaactgttttctacctttttgattgccaacataaatgggattgaaatttcaatgagatattaatcaatattcataattgtgctggtcgaaggttatgttatgtgctgtgtgaatactccgttaatgcttacggtgttactactaatattactagtacattgaagccaagtttggacttttggacccttcatctcgtgaacgccacaagtaatattaatggcgttggaatttattggggtcaatttttgggactaagctattaaatttcttatcacactcagtaaatgtacgtcacatagatccgtagagcaaccaatatgttttgacttgttgaataccctaaaaggagtactatactagtagtaaaattcttctaaatttcaacttctaaccaatggacaaaataatggggttttataaagattcgtctatttagcattagcataatttataacaatcttaagacgctgcaaaagacacccaatatgtgtataataaagtccatctcacgaggactgaaccatcacgatcaggggtatcattttggtgaggttggcattttaaacaagttgatatgtcctaattagtttttttgtggcctaaggtttctatcttattttataaaatagtgcgtgaattggtgacaaacgaaaaggccaagaaagaaaaaacttgagaggaaaggaatgaagacagaaaagagttgtgtggggcaacgtaggatgaagtcaacttaactgagttatcattaaccatagctagctgagtacactaatgcgaagattgtcgaatcatgtcactttaattggtaggtgatgaagattaccaaacactaatgatttgttttatgcctctatctcgtgtttggtcctaaacacactttcccaagcctcgtttaactctgccaacggtcgtggacatttgtttttccatcaaatacaatacaatagggcagagaaaacaagaggcgaatgcacaatattcaccttttcaaaggggagcttatctatgctataaactactgtactagtgagaaattgagataaatgcataaaaaattatattcgattctcattttcgttatggtataaattattttttttttcccttttgttgaggtgtgagtaaatttttccaagtctgagaaagagaaagcctatgtcatattattgaatgtcattcgatttgtaatcataacaaaaggtctataatgataacaaattttagtaagagttatggaataaaagatcgtttttgattgatgggtcgatcaatggtattttgtggctaaatcgagagcaattacttatatgttaatttagtgatgatttgagtgcaatgatccatatattgatattagaatcaagtgcagatattgtttggagaagtttgaaggacattcgaatgcatgttgaaatgaagacttgattgtcaatttgaaagaagtttgttagaggttaaatattcgtttcgaatggatgattgaaacattgaaattgaataggagatttggaggatgaaatacttagaaaatttcgaagtattgatgtttgaaggtaaattcatttgtgaggaatattctttaaagatgtagaagattcaaagaccaatgaactcatactaaagacatgtgactctcaaacatacatataaaaacaactattagcaatttgtggataaaagtaacgtagaagacaaaaacaacatcttaaataatctattcaaataaattattcacatgtttatctaatataactgttatatcaataaacttataaataaacataataatagtcattttttcttaattaattacaaagattatacaagttttgcatacaccatcatgcaaggaaattactatcaattataggaataatgtgtaagtttgaacaacatttcttctctaaacttacttttttatttcattttcactttacttttcgttcactttacatttcgtttacttttcattgcatttaaactttatatttccttttgttttcgtatttgcattcttgttttacacttgattatatcttttttaagaacatttgtcacataattttctgattgcattattattcaaagatattatgttttgaattcgtagttgacaatatctttatttttggagatattttgattttacatgacgttatgattatattaattgattattcgagcaaattctgtttcaaattgatatttaaaactgcatttatatacttttttagtcgaatgcaatttttttttctaaataaccatttcgaatcacttaatgaaacaaaattttattcaaattaaagtaagatatttctaaattaaatatcatatttatttgaattggaagttgttgcattaaaaaaagttcataatttaacttctaagcggtgttttaaaaatcgatgactgatccgattaagatggatcattgggttggtcgttgaataggtgaatcattggttgatttagtcaaatcagttgatctgcataacaataccttaaaatatttataaaaaatcacaaattaaaaaataaaagagtgactctctcctataattatgaaatataagtaattcattacctaatatgtaaatatcatctcatcttttaaaaaagatacatcggtaaacttctataaattaattaataaaaaaacttatttttacatacaacaaaactcatattattctttttctcttattttctttctcgctttttcttactctttctctttagttagttaaatgcaatactaattcgtttttgcgttttactacttcctttactagatttgactatctgcctcacaacttgccataattattgcctctcactcacactcccattggactgctccccaacggcccccacaacatcagcggccggacaccaatgtgaggatgtaaattggactataatcacagtctagcaaacaagaaatggagttccgttgcctcttgcgaggtgtcgaacccgggtcttacccctggtatcactccctgtttgccagctgagctacgcccaccggcatctcacccatcatttaatgtccacatgtcttcgccccacgtttcatttcatacaaatatataaaggctgtaacggagattaggagattggttaagaaattgttaaataataaaactatttattaggtaaattaattaatgattaacatttgctataaataaatattaactattgtctttggatatttattaaaaaattaagataattttttattaggatacataaaattatgatgtttataaattattattaatactcatatatcgtctcaataatacttattttagttttttaatcgatatcattaattagcaaagactcataaataaattaccataatcaaatttttgtgtctctagtatattttaccttaaagattttaaaaagattatgacagtagtgtgttcgtgttgtactagcagtataaacattaaaagtaaggcagcttttttcctctcctacacatgagtaataattgctacctacagctatagacttactccatacacggtttcctactttcttctttcaccattcattttcctcttctttttggtacagctactactgcttcaacttcttttcatctcaatctcaatatcttctctcactctctttcagttctacaaggttgtattaacatgggaatcgaagaaaaagcgggagaaagagatgcccagatgctcaaaatgaaagcttccgaaagaatctgatgccaaacatagtggcaagcaatgatcacttttcttcgttaacgaaaaaatggaagcgccgatagaggtcgcgacgaagcctcaagctgttgtgtttggtgagatggaggtcgcgtagaagctcaagctgcactgctgtgtttgttgagctcaagtggagaaaaatgaagcttatgcacaacccggcccgggttgacgggttggcgggtcgacattaacccagccgggtcgtccgggtgggagcggcccactgtcattggccgatctaattacgcaccgacccgatccaatcttcgatttccggttggaccggcggggtcggtctgagtctgcaaactatgcttctaagtcttgctaaataaaataagtttgtgattgattaaaataaaaattagaaacttgaaaaaattagagtcgaatatccaaacaaatttctaccataagcaccctttaagatcaccttaaggaataaggatgaaaatcttcacattttttttaaaaaaaggtaaaattaggacatttctggataaaaaagctaaagattgagctcttgaaatattaagaattatttaaaggattaattttcttatagacacgtgcttcccatcaaaaccctaaccatatatttagagggtataattatttgtcaaagtcatcaaatttacaatagatgatggatttatgatcggataatagtgcaaaatctttactattaattcttacttcttagccttttttttattcattcattttcaaaataatattttgttttttatttatttgtttacttaaattttttaagtaataattataatctttgtagttatatattaattactaattaaattttaagtatcttatttatttatcataaataagaaaaacaaaagtagtaagatttaaaaccacattgaactaacacaccgttagcctgcatgaaactaaattcaatctctttaattaattaaggttttaagtagtaatcttgtgaatgaagaaaaatatatggtcaatcaaattctctagtggattagtcataagtaaaattagtgaatacttcacaccaatctcatgacgacaataaaaaaatgaagcattgaaaatatttaagaagaataaggagatcttaattaattattttattttaaaaatgagaggaacaaggagtaggtcttcaaaatgctattttgtggttttttattagtagaaattgaattcaaatacaaaaaattcataacaactcgcaatactatttaattaactgaattatacctcttgaatactattgtatgaatttatttgagtttagtggatatttattgttagtattaaaaaatttccactctcaattaattataaatgtaatatcttgaattttaagcatgtaactaagcttagattaagccggattaagcataacattaagaattataaacatgctttagaatcctttgaaagatgctttaatatgcaagttataggctgttctggcctgcggcgcgacccacgtgaagtgcggcgcgacccgcgccatatgtgtaaaatcagggcagagggttctgccatgccacgtgtaacaccccggacgtgctaacattaatgataccaaaccacgctaaaagcgttatgcatgcgatgtgcggaagcgacaagatcgtttttcttgattacattatgtatgaaatataaaacacaactaaagcataaaacagacagaactgatccagataaaacatacacaacataggcagatacatactatacaaatatactcaggagggaacataacatacacaatctcacaactgtacatatacatgctcaaaaacatgaccacaggcggtcatttataaaatatgtacagactcgggtgtacacacaccctgctctaagccaaagctaagaccagctccccctctggaagctccgcaccggtcttcaactgcagcctctccagcctgtcacctccactagggcctcctgccctgaggtcgcttctctgcccctgcagaagcacctgaaaaccacaaaccccacacagggtgagacatacgtctcagcaagctcagggtcctgggaaaacctccctcaccctggtttaccatcaagacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataacttggtcctatccaggactcgctatacatcacagtctgtgtaggatttatcagatttaaactaatctgatcttctcagggcctttactctgtggcacacaaccacatcataccaactggaatacctgggaactacctcttccctgatcgaagcccatcctacacctgtgactgaaatagcttcagacacatcggattaccttcgtccactgaccaggttctgtgtctggaccaaaatcctatccactgactctgagcctttctctaccacacttgatccccttcggatctgctcacgagtccatcgaaccattttaggttcgcgaagctgtttctaacactttcttctgccaaaacactggagtcctgcaccattggcttccacagagcctctacaggcgctatattcctcgatcatgcaaaatatcgccaccaaggacctccatcaaggcagacatctaaccccgcgtgtaccctactctaaggtacgttcacatatctaagttcctcaggatctagatgcctcactgcatctgatcatctatctgaggataataggctaaccgaagcctctgcggggttcccaattctctgaagtacgcctcacctctcaaggtcacttcagatccttgtcactaactaagtgacctgttagacactagccatatacatagctatgtctcctctcatccttgaccacctgaaatcctctcaggatataacatatcacagtggccctcggatgactatcgaccagtcctcataaaccacataaggacggcatccaccagctagctaaaggcaccataactaggtttagcttatcataagccaggtgcttccccaaacacgcctagctggttaacaactctcgcagctcaatccggggatcgattccacagatcttccgctgcgcactctgatcctcatcaccactgatcactcccactggagatcagaggatcctctgtcctagacagatgcacatctctgacctgttcatactacccaccgtcagagattatcatcaggcatggaacatctccatgctatcatgcttgaggtatcaacacctgtcccagcctctgctagacatctcaagcatactggccacttggcctggacctcccggtcccatcacatgatgagcagtcttcttgctcccaacaacggcgtatccacatcacgccatggcgtatcatcattaacgcccagatgcatcatcatcagcatctaacatcagtgtgagactggcgactcacacctgtgccatcccaccggacgctacccttaacggggatgcacatatatggtacctccgagaatagcaggaaaccatctggactattcccttggcctaggggagcatcatcacctcgggatcatcatcacccatgagccagccatactaggaggaaaccatctcctagggaggtccatatctcataaccatcgcttcctcgaagcgtaaactctccattcacagatggagatcacacacacaagcagataaacataaaacaggtatataaccataccttaacactggtcagcaacctctgaccgctcatctggtacctctggagactctctctnnnnnnnnnnctcactgctcttatcatctgggtcagaacctctgggtctatccacttgctgacccgtcaggaaaataggctgcttgcctcgacatctgctgagtacagcctcaacttggcgacactgtctcaccaagctgtccatgtctcgagatccactgccggccactagcatctcaatatcacctctaagtcccctcaggaacttagcagctaggacctcatcatctggcatggatctcctgaaatgagcatatttggccagctcattaaacctagccaaatactcatccacagtcatgtctccctggactagactgtcgaactctgcctgcttctgctccctagcatccctgggaaaatacttatccaggaaacaggcttcaaacatctgccaggaaagaacctctccccggcctctcagcaacgctgctgtggtcctccaccactcatgtgcgtcgccctacaacatgtaggctgcatacagcaacctctggtgatcggaacactccatcacctcaaagatcttctccatagcctgcagccaccttgctgcggcaattggatcatatccaccatagaaggctggagggtcatgcttacgaaacatgataagcattttccctcgggctgcagcatccatctccgtctccatagggaacatccggtcccctctcaggtgactcgcaccagactgatgacgacttccctcgccctcatacacaggaggtgtaggggatactctgtcacccctctttaggactctgacctcctctatcaggtcctgatgagccttcatcaaggcctcatatctctcaacatcagcagctctctgccgctgtatctcctcctgtgcctgtctagctgcagctacctcttgctgcatcatctcctgagtctgcctatttgcagctatctcttgctgcaaggctgccatcgcagcagctactggatcagtttgacctggggttgccccactgctgcctctggatctcggcatgacactgcacatgtacacaaaacagtgagttgatcaggcccacatatagtgtacccatatgcaatgctcatgtcagatcaaaccacagcatcaagcaaccaacaatttcatacataatgtcttaatcaagaaaccgctctgataccattaaatgtaacaccccggacgtgctaacattaatgataccaaaccacgctaaaagcgttatgcatgcggtgtgcggaagcgacaagatcgtttttcttgattacattatgtatgaaatataaaacacaactaaagcataaaacagacagaactgatccagataaaacatacacaacataggcagatacatactatacaaatatactcaggagggaacataacatacacaatctcacaactgtacatatacatgctcaaaaacatgaccacaggcggtcatttataaaatatgtacagactcgggtgtacacacaccctgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctctctgaaggtttctcagaacttggggttttagggaatagggaggaaggattctcgctctcaagggtttctctcaagatcaaaggccataggaaggtgtttaggccgtgatatagggtcctagaaagcttggggaggcctctaatggcagctggggtcgtggggaaggaggaagaggttttctcctctgcaaaacgcgtttcccgttcttataaaagctccaccgaccttcccacgcgactcgcgcccgaaaccacgcacgtcgcgccataacaaaccacgcgactcgcaccgtttaccacgcgactcgcgccatacctacggcccttccacgcgatgtacgtggacatccacgcgactcgcgtgacctctcagagactccgcgcgactcgcgccatatccccacgcgacccacgtgggataccagagaagaatctggttttctaagcctcatcctacgcgatccacgtcgcctgtggcgcgacccgcgccacaccctctgcagggttttccaacgaaggtccccgcgctacccgcgcgggacctggcgccaccagcgccacagagagggtccttacaccacgcgagtaacgtgggaacggcgcgagtcgcgtgggctggccgagagtatggcacgagtaacgtgaagatccacgcgtgtaacgtgggaagtgtcctagaaaatcaagttttcctctggagctccacgcgagtgatgtgaatgttcacgcgagtcgcgtggattggcagtgatgtggcgcgacatgcgtggtaactggcgcgagccgcgcgggatcgacggatttgcttttatatgaaaccttttgggctgagagagagagagagaaagaaaaaggagaggagagaatagagagaaacctccattgatgagcgtttgagctttgtatcttcttcatcgttcatctaaacacctccgacccaactgagaaaatgatcagcacctcgagataagtgagataccccgattgatttctgagattagctgagagaatgtgagattggatttccctgagagaacccttgagagctcggagtttgaaggcgaaagaggccgtgattgagcgagctaccttagggaaagttattccctggtgcttctgagcatcacagaggtaagaaactcgagctctaaccgttggttctgtggattggattttgtgtttttggggttatcttaaggggtgttttttgaggtgttagagccgttattaggctcggactctgtagagtcttatgctcagaggactgttctgaggaagtcagagccttgaatcatcattactgatgaagtttgattttggctctgagtcagtctgaacagagataaaaggttgactagttcactagtctggaccctagagcagttgacaaagttgctcatgagactatataggtgagtttgatcggttgaaactgaccattatgagaggttggatttaggccattgtaagcagagatatgcttggccatagttgatcagagcttgtgttgagactctgtagccttgtgtaggctgagatggatcctgttgagggtctgaggatcacttgtacagtgacttagtttatgtttatagaaaggatgagagtttcctttcgtttgatcggtctagaaccatatctgatactatatatgcttgttcttgtgtaggacgtgagcgtgagagctctggtggtattgaccacgagaccgggagagccagtgatctgtctagagcaggtaagctcttggttcttggttgtgaatcctctgctgtgttccaccatatatccactgggattatggttaggatatgtgtatatgctagtagaggaacatgtaatatgctatgaataactgatagatgtggtctgaaccctatgaaagagtaattgatgtttgacatttgatctgaacccagagatgggtaattatcatataggaccatgagttattgattaatgattgttgtgtttgatccctgaggaagggaattgaagtgcttgattcctgataagggaaactgatgtgtacttgaccctgagaaaagggaaaccaatgaacatagttatgattcattgatagcatgccttattgttatgagacttgaatatgtctgtatgtagatgcggtgtgctgatgttctgatccctatgagagggaaattgacatgtattgatatgctatgcttgaaatgtgaattgaaccctgtgataggggattgatatgcatggctatgatgtgattgaattgtgacatgtctggttgaatgtgaaacctgcctatgcatgctgtacttgaatagtatcctattgtagtaggatagatgacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctatgtacacagaggtagcctcaccaaaaggagatgtaccagatatatagttgatgcctcgggatcagagatgtacctatatatctagaggaagcctccgctagggattcatgcaagagatgtgccgagtatatagatgcagcctccctgtgaggagatgatcctatatacttagatgtagcctctgcatgatggttattgatgtgataaatgactttatgtcatgattatgccttggttttggctgatgacgtgtataacctgattgtggtcaggtgtattgtgcattgacgtgcttgatgattgatttaatgtttcactgatgatgaatgtgtattagctgagtccttaatatgggacgatgctttgagatgatagtacattgattgcatgtacattgattgagtgattcgttgatatggatactcatgctatgattgtgtggtgatgtattatgagtgtgtagtgcatgaatacaagccatgagcttgttctggttttcattgatagatgtatatatatatatatatatattgattgcataggtattgattatttgtgactgatattaatgatgtgaataattatgtaatatgtacgtgttgtcagtgaaccaggggaaggaaatacctttaggggccttgagtttactgagattttatatctcaccccttgtgtggggctatgttgcaggtgaatcttccagagtagcagagaaatcccaaggcaagaggcctatgcaggattagatgctgcgggacaccttaggatagaggatatgagcatgtggctcagatgttttgtattttgctttgttttgttttgatgtaccttgaggggatattcgtacagttttgtattgtacagaggaaccttatatgtatattcaccatattatagtgtacagtgttatacagatgacatttgatgatgtcactattagtagttgcttccaaactgcttaaactctgattgattatctgtttgattgtggtgtatgtttggtaatgaccctgattaaaaaattggggcgttacaataaattatgtcttttaattgttattaaagttaacaaattttttatattagataatttataattagataataggatataattctttattttcggtgcatatttttttatattaatatatatcctattttcttatttaatatacctttattgtagtcatgacttcattgatgatttagacttggtaccatttatcatagcagtctctttaaataaccccacagggttagctcaactgttatagcaagacgatgcatcaagaccatgggatttgcataaaaatttaaaggaagatattatgacatgttcttaaaatatttataaaactataaaattaaaatatagtggttactgagacatggttttaccatccagtattcttttcctatcatttcttttcaacgattatgtaaactatttattatattacttttcaaattatatataagtcaatattttttattaaagatattcatttaatatatatatttattaattcaagttatattattatattttaattattcaaaatatataatgtgtttatttatataaatctataattttatctaacttaatttcttatataatatcattaatttaactataattgaaacagtaaacgaatttatatgttcgttaatctaatgatcgatttgattttaaaaataacattgaattttagatatggaaaaatcaacaatatttccgaacacggaagaaaactcgtttcaacaagttttttcctctagcaaattatctaaaccagaccgtgttaagaaaaagagcaacttcaattccaaatatgaaatagagtgaggagctggattagtaccaatggacatttacattaacaaatgcatgttaccgaatttgatgtggttgagaaaagagaattctattaaaaatattaaaggtggtcaactaaattttttcattataaattagttataaacaaaagttggtgaatatttggtaccaatatcatacgaataagatggtatcaaaaattcaattcaattgcctctagatgtgttctaaatcgtaacctcaccaacatgcatgtatcattaattaaagtggcaaacacaaaaaagtctcataattatctcagaagtcatatttgtgtttgcaagctgcaatatctcagaagccagaagttaagtaaagtgaaaaatatatgtgatgggttctctggctcgaccaagctgactctttttccgagccagaggacccggacctacccaaaaagtagccagtgacgttttggcttttgaacgttccacttcgaatggttcatttccctcagtgcagcttaaacttgaagcaagcgagaagaacatggaagcacctgttgttgtagtcactggagcctccagaggcattggccgtgcaattgcactttccttaggtaaagcctcatgcaaggtcagttctgctccttactacgtccatgcatgcatcatgctcacatggtcatgtaatgtaataatattactctcatagtcatactctcatgccatcatgtcattctattacaggtcttggtcaactatgccaggtcatccaggcaagctgaggaggtttccaacttggtacctagctacaatctctaaactaacttcttctctctctttatgtttgtggttctttttattctcatgcttaatttgcgaccaagtgtggccacacacaaaattgcaagatatatacaaaatgattgtggacgagaagatattattgtaacatcaaggaaaatatgatagaaaattgattaaaggtgaaccttaacataacgaggatacatacaacctctttgcatatgcaaagtaaggatacatacaatatctttctcccatagaccaagtgtggccacacacaaaattgcaagatatatacaaaatgattgtggacgagaagatattattgtaacatcaaggaaaatatgatagaaaattgattaaaggtgaaccttaacataacgaggatacatacaacctctttgcatatgcaaagtaaggatacatacaatatctttctcccatatattcacataaagaggagcctccggacaatgaggtatgctagttttttatgttaaaaaatctgttaagataatttagacaggtgtagagaagactactgaaaacacggtggtgtgtgcaattccaatggtgaaagagagtagattgcatgaatttagtctttaaccgagttttagtggtgtgtgttccatataactgaccttgtctagagaggtcattgttatacttttgtgtcatattgatagatccacgtgcttgatcggatttgtagattattatatacttattgatcatatgagctctcaatatttttctggtgttattaggagcaagagttcaagctagctcagttatgctcattgactaaactgcaattatttatttgattattactttcagattgaggcgtttggtggacaagctcttaccttcgcgagagatgtttcaaatgaggctgatgtggagtctatgattaaaactctgagcaaatatttttgatttattaagtggataaaattattttaccttggtcttagatttattcgtacgtgcaactctacatgtgcaggcagttgatgcttggtattggtaaacaatgcaggtagcttggataaattaagaaattaagcacttgtgcaattacttatttatttattttaattttagatttcatactcaaaaaaaaaaaaatatcatgagttcaggaattattcgagatggtttgttaatgagaatgaagaaatcacagtggcaggacgttattgatctgaatctcactggtgtttttctttgcatgcaggtgaatgtgttcagaattttgagttcataatgttaaattaagtatagatgtttttttttttctttcaaatttaagatataggagctgatggtttgcttttcacaggcagcagcaaagattatgacgatgaaaaagaaggtgacacaccacactttaaataaaacctcatggaactctttggccattaattggacttctttctgtcatttcatcattttgtcttctttttttcttatgctaacaacaatgtctatgtaatttactagatgttagtatgtcactgacttactgatattttttattgattagctactgagttatatttctgaaaaagttttgcattcagctagcccattatggatttgcaaaatgacatccagttgttgctgaattaagctctttaatttcgtatcagagtttacttggtacttttgcagggaaggataatcaatattacatcagttattggtcaggatggcaatgttggataatcaaaattatccaacacattccacctgcaaggttacatccttgattccagcattatgtaacagatgcaaaacctgagacttggcggatgtcttgtctgtatctgttgacacgtgaagatgcattgtacctactacatctgtgtttgtgaagttccaggaatgaaacttttgaatgccataaacaccccttatcttcgaaacattagttaaggcatccttcagctcatgctcatgcacccttggcactctttggagcaaaacttctgctgaattttttagtaaaggtatcacggaagatacaattaaaatagaaataaaaattgagcaggcaggatcagcaataagccatcccttgtacttgatcaacagggtagatataacaacaccgacactccccatggtgtcagcaagaacatgcaaaaatatcccttccatattgtgatcgatatggcgatggacgtgctctttatgaacaagtggagcatcttcatgacaagagtgttcagtttgatcatgatgttcccatggtcatggcagtgggcggcagcgtcatgatgcttaaagctctgaatgcagtgtttgtcttcatgatcatgacactcaccatgatgcttcctctcatgactacagtggttatgattatgatgatggccatgatcaccagagcatgaatctacttggcaatcacttgaaactgaaatatattcttgattgcttccatgttttgttgtttcgtgaccatggcaatgcagatgatcatgatcatgatcatgatggtggtgggcgtggtgactaagcgactccgagtgtgagcacgaatgggagcatgatgatccagacaatccatggccatgggcatgatgatgctcctcgtgaaagaatatcaagccaatgacattcaccacaagaactcctatggagacaaccaacaagctattacttgatatctattgaggatccaatatcctctcaaaggactccaccactatgagtgctccaacaagaaccagaaacacagcattagcataccctgataaaaccttaaaccttcctctcccatagttatagtgattattagccggcaaacgagatatatacagcgcatacaacccaatggccaacgcagcacaatcaaagtcaccgtacgcctacgatcctatctgactattgaggactttgatcttcttttgttcaattgtgcgtgctttgcttaacacatgcaattccattaagctcgcaccatagtactcaacagttacacctacttgttcgacactatatttcgattctgcccttttaacaacatgtgacaagcatccgatatcaggccaagactattgctcataaacccagcagcaaactccacaaccatatacccagcattgatgagaagaaaaagcacgatcttccgcgacttcctctcactcaaaacatgtctgataggcttcataatcatgtcactagagaactcctcttgattggaagagtgaaaaggatccaaatctctaacaccaacatatagcaacaaaccacaaagcaacaaaccccagagggaaagctgagggaaataaaaaagctccaacaccagagtgcaaacaaaagtaaccaaaaactccctctgagagtccctcgaactcgccaaactatcaacgtcatcattatcatcaccactataactctcacacaaaaacacaccgaaaacaacagcgttcgccagcggccacgccaaattcccaaaggcgacaccatcctcttcggtctcaaacaaggagaaactaacaacagcgggaacaaacagaaaaacagtggtgaaaaagagagtaattaaccgaacccgtttgcgaccgagctgtttgagagtagtcccggagtccacgagccggtagcgggcgagaaagccggaggcaaagggaaggaccaagggccaaatccggccggtaacgcaggcgggggagaacgggaagcattcgattcggtcccaaccgaaggagagcaggaggaggcagagggagagggagaggaagccgcggaggttgggccggagggggcttctgggccgggccgagatggaatccataaattcggcgaggctcatggaggcggtgccgcagtagcggagggcctggaagcggaggaggattgatttggtgactaagattctctgctgggagggtgtgagtgatgatgagagaagagggtgtttgggtttgtggtggaggaagggatctttggaagaggaggaagagggtgagaagagggagaagaagagggtgagggagaaggagaggagggagacgaggaaggagaaggggaagagggagaaggaaggggaggagggagtaaagggagcggagggagaagaggaggaggaggaggaggaagagggacgatccagattgcgatttcgattacgggagcgagaatgagcgccggcttttggagggggttgggcttggggttgaggatgaggagtatcggaaggcgggcagagctcccggagtgccaccgaatgcggtggtgcgtggcggcaccgagaggcggtgaggacggtgctggtggtggtgagggtgggacttatcgtgatcggccatgctagggtggaccgtgggtctacggttcccgagtcatggaacttctttagtgatgttcctcctgtgaccatatatatacacaatgcacgtgccaacctgaacaagtagctgttgaggaaccacaatgtagagacagagtctactcaaccaaaacatgttcatgttgcctatcatgcgtgagtaatttgagtagttggatagtttgttttttttttttttaattttattttacttttttttctctttcttttttttgctgccatttacaaaaaagtcttcatctttctcagcacctcaaatgttgtgtcgtcgccgcacagcaccgcccactccaccgtcgcaccgcacctcccaccccaccgttgaaggagataaccattgggttggagaagagtgagcaaaggttcttgtgggtggtgaggtccgagttggatgatgctgactcgatggaggaactgagtctggacgagttgctgccacaagcttttcaacagaggaccaaagagaaggggctggtaatgagggagtgggtgccacaggttcagatactgagtcatgactcggtgggtgggttcgtgactcactgcgggtggaactcggtgttggaagcggtgtgtgaaggggtgccgatggtggcgtggcccctctacacgtggcagaagatgaataggatgattatggtgaaggaaatgaaggtggctttgacggtgaacgagaacaaaaatgggttcgtgagttgggaaagagaaggaatgacagagagaatggactaatggagaaagagaaaaaaaaaaagaagaaacaaattggaatcatagatttaaaattaaaaaaatctaacgagtcaaaattactcacgtatgaaacgcaacatgttttggtgttgcgtatgctagactcctcggtcatgtagagacccaacttctcaccaaaggcatgctgccccaactcatgatacctatcgaatctcacacctgacacaccaagtatcatttcgtgcatctcaaccatttgtcatagggtaaacaacctgatcacccatgataacagtggtataactgtccccgaataataggcaatttaataagtttggattattattattatatatatatatatccaacttctctttcatcttgtccccatctcaattttttaacctcattattttttactcttttattgttatattatttagtatatcgatcaatgtctcttttttcttgtgtttattttcttttaaaacctggagatggatcttctccaaataaatgttactagatgagatcttagtgaaatcttaacatttcaaaatctcaatttttcttccatgtgagaaaatcttttcccctttctctttactccactcctgcatccaaaacataagatttgtgttgagcttctttttttcccatttcttctctccttccattcctctctcttgctagccagagcttgcggtgccttttaccaattctggtctactaccttgctttgtgctattngttgcgtatgctagactcctcggtcatgtagagacccaacttctcaccaaaggcatgctgccccaactcaagatacctatcgaatctcacaccaggtatcatttcgtgcatctcaaccatttgtcatagggtaaacaacgtgatcacccatgatcacagtagtataactgtccccgaataataggcaatttaataagtctggattattattattgttatatatatatatatatatatatatggtttgttattttgattagtttatgatttttttaattaatttataagattatttttaagttttaacatacacacacttcataatttgttgttttgtctttaatatttaataattttttattttcttaatataaatattgctagtattattatttgaattgaaacattatttatactatttattttaatgttcaataaatttttaatatttaaagtaaaagggtataaatttaaaattgatttagaagttcaaactatacttatcaaaatatattttatctataaaacaaaattaaaacttatataaaaatcttataatatatttttgactaaaatatgttttaggttcctaataaataatcaatttttattttaggttcttgataaatgatcaatttttatttttggttaaaagttttgataaatcatggatcctttgcattgaaatttttttattagactcaacaaaactaatcatctactagggacctaaaatatatttaagcttagatattttaagtttaattataattattaattaaattaacaattataattttattacacacttctaatttgataaaaaaaattgctaaggaaatgggccaaatgcacaaaatcacaagcactatcctatagtcttagataaccagtagctgccatgtcagtttgaagatacacagtaagtaacgctatggagaactcaaaagattctcatatccaccccatgtcaagattgatgctattttacactaaagcatgtcagcagctgagttgcattctctcaaaacatgataagttagtgctataaggatgagagattaagaatgaccgaaatttgccacatccttgctcacacaattatactcaataaattgtcaaaactaaaaattggaggaaagaaaaatctaaaacacaacttaaacattctcaatctagtatacaatggaatttcagtttgtgtgtgggacatctcaatgatcaagatgttgtatgatcaatggttatcattatatgcttaaagtgcatttcctcattataagtcgaacaactgaacttttgatttaaatggagtatcatatccaattcttccaagtctattgattctatataacgaatactatattttcaagaagaaacaacagtgaaaattctgccttaaaagaggtttacgtttgaatcacctcagcagttaaaacacgttacaactatgtcgctgttgacaatagacagcttattttggtagtaattttgtgcagatactcacattattgggcgatcacttttgctgttgctctcatgttgctatggagcaatgataggctcttttctcaaaagatttcatctgctacggatattgcagcaagcatttttaatatggcttacggagtggtccaaagtctcaaccatgattttatgacgagagagagaggagtatgtataatttgaaactatgcttgaaaataacaggtggtagggtagacacatataagttagttgagtttattttaaagcaataattttttttattttttacaactttttgatagaaatcaggttattagaaaaaagcacttgccaactacatgctaagtggtaaattctgacaagaaaagcttaagaagcattggcaaacattgctagtcgaatttggtcttggcggttgactttcaaagtatagttgaacacagaacatatattatcagtattattaatattaattattattgttgcatattccacatgaacttttcaaacgtgatcagcacaaactttttcaaagctcctatttaacatttatgcaactaaagaactaaaatgcttggaactgccatttgacatcgtgcagctatttgcatcttccaaagcctggccatgtgctccaaaagaaaaatatcggttcatcaatttcttattgaaagagcccagcttatagctcaattgtagggagccatcaccatccattggtcgattggagcaagagggtcccattatatcaacacgttcttgcttattattcgaagaacgagaagagatagatagttcttgaaaaagattagatgttaaatgaacaggtagaggcacttgtggctttaccttaatcacaccttgcactagacctgcatgaaaatgttttttggctgaaggacttggaagataagtccttatagatagtgttcttttgttgtttggaagagaacacatttttgagtatctttgcctcaatgggattggaaagtcttccaagttgttccttgaactgaaagaattcatagaaacatcatcttctaaatctgaggcagcttcttttgtgtctcttcttctagaactttggagcagaaactttaagtgccttgcaccataattgacagaactagacttgctgttacatggggaattggctgagtcatagttgtttatttcacttgaccatgaatttgattctacacttgcctgatcataattggaatcacatgaattctcaatgcctgtgtataacaatatctcagaatctggtattctaaatgatgttccaggactgcctcctataccatgagtcctaagatgcttcacaagggcatttcttgtcacatagtcctgataattagagatccctccagctgaaattaactgcttgattaagatttcagaagatgctgatcgtgatttttgtctaagatgatccaagggggtcatcccatcagcatcacgaatattcaaatcaattgatggaaaagacatcagtaattccactacatcacattggatattatgaatcacagcaacatgaagagctgttcttccatcattgttcctgacattgatgatgtccttcatgttcacaatcttttcacttgtcagttgcttcatgagctcagtgtgcttgtccagtctacagaaaccagggcttctgaaaccagccactaccatgtgaagaaaagtatctccatagtgattggttaacgttgctaacaagggagatgctccaaccagaatctctaccacgggtaagtaacctctgtaagaggccacatgtaatgctgtattgccttgagcattagttgagttgatgatatcataggattcaattagatttctcaccacctacatcatcattaaaataatgaaaataagtaacaataatttattaaccacgaagaagatgcaaaaaaaaatggacatacaaaacttttgtagcatcaactgcccccagaaatatttaacatttaacgctaattttagtctattatacaagactcgacggtttgcaccccgagtcaggtgccaaaaggagccaattggaataaagcattgagaatcactgaaagaggaattcacacaattgtgtgtagtactatctgagcagttcactaaatattttatatttcacattcatctttgaggagcctgatctattgtgaagctagataactcaacgaactagatgttctgtagtatctataaacattttgtatactccacttacgtagttattaagcctccctggccaattgaagaaaaaagggcatttcagtgatccataaaataaaccaggcttttccataatttattaaggatctaatatctatgtccttaggacttctaagtataacaataccattaaacaagtagggcttctgaattttctacagcacattcaaagtgtgtttggttttcctttgagaatctccaaaccatgatttaggcaaaagttactttcacccaaaccataaatgtgggactttttcaccaaaaccaaaacatgcaccaactactaaggctgtgtttgaacttccatttactcatgttgaacaccaatgatccatgagagtggaattggcgttcaaacgtgccttggaaagtggaattgagataaaacaaacacactctactctgaagtaatgtgcctcacctcaacctggcctcttgcagctgctgcatgcaagacagtacatcccagggcatctctataagacaaaacctgagaaacagaaatacttcctagaatctgcttcagtatttcccaattccctcctctggcagcagcatgaatggccctattcatcacatccctcttgaaaaccttagaaccttcatccaacttctcttccaattctgcttcactgccaccaaggcactcctttcttgaaagagcagaatgaagaaggagcttaaagacctcacagttcttgcccctggctgccgcataaaacatgtcagtgacaccatactctccctcaccaaacaccaaaagagggtctctccccaacaactcaagaacaaagtccacattcccggctgaagcagcaatgtagagaagccatccaccatagcctgcaaggataagagagttgtgccctcttcctgtctcacactcaatcataagattccttgcaaccttggaccggcacttggcaacatcctcaaacttggactcatcgtcccacacggcttcaaggcggcgaattcggcgaagggaagtgagcttaataaggaggttggtgtcaaggtggagaagctcagtgaccagatcatagaggccatttgcagcagcataatcaattggagatgcataccaccatcggtctcctgtgctctcccaacgaagagggaagtttgaaggaggcatagtagtagtccaaattagagatgacccttttacaacaaaggacactcactaccactttcttcaattctagtagttgcaagcagcagtgtaaagatgcctttaagacccctcattaaagcaaaaagtgaaagcacacaccactaacagaatatacgcttattctcttggactagaagttgttgaaaaatgaaaatgaaaatgagaaattctaggaagtgagattaattaaccttgtaaacagtgaagtacaaggaaacaaaagttggaatccgtagttggccaccatggcatgaatttaaacagtgttctggctgaagttgaagttggtggcaaaagcaaaacgctcaagggaagaaaaaagggatagcaccaactataaactgttgtggcaatgtgttagtgacaagaggaaaattgccactagataggatttgtgagggaggccacgcacttaggaaaagttaaaaagaaggcttagaaagattgagattctctggtccgtgagttcacagccaaagatgatatttttattaaaattattgaaattccgtagaccccaccttgttggaggttgttttcattcacttaggaaatttcaaggatcgtgtcatcatttgtagtgggacatggagcacacatttagctgggcacattaaaatgagagatttagaagggacacatttttttttgttcttttaatttaaggagcaactttgccttccataattgattttcaagactgggacatcgaaacttatcggcatgatctgaaatttggtagccataaagttttgtggtgttagcaatttggagcgtgagttttgcacaccagaaatagagatgccgctagggacaacaacgtgagttttacgccttttggcttatttggaaaagaggggagggaacaaagaaaggcactttaaccattttgtctgtgtatatgctaaatggaatgcatgcatgtcgtattaaaaagataataataatgtttaataattatgcacatcttacagtttctttaatgaatatggttgtcctttcttggtacccatcttagactcaaatggcatgacctatacatgccaaagagatagcacttattgcctcctgtaaaatatacttacctttttaaatgaaaaaattgactatacgtccaatacacttgcaggttagaaaaatgtataaatattagagaagtaaatcaaatttgattagctaaagttgttaaattacatatgaatttaacggaagaaattaaatctttatgcaatcttgtggagtacaaaataaaagagaaaatctttatgcgatcttgtacaaattaaaagaaatttattacaaaagtgataaagttctttcgtctctgtatatatctctttttttttttgttctcttcacataattcgtatcctgaaccttacttgaagacttcttatgatggtgaatttttaaatacgattacttttttttgtcaaaactattgatataatttaaagagataaagttctctgtatcttagtaaattactcttttggtttgttctttagtgcgtctaaacaaattactgtagtgtggcctgcattatcccttgggattgaatgacacaaaacaacctactctttgtactgtagaggaaaggataaagaagacggtcattctgattctctcaaactcgatgaaaacggaaacgcacgagacccgtagaatgtcgcttgccactactaaaggtttttttactactattcatgttaagactaaggactggtttacactttttcattgttctaactaatgagtaattttaaatttttctaaaatattttcttactaacctttttacttcttttataagtattaactattaactatattttatattttcaagacattaaatacaatattttttttgttagatagcaagagaatttgtgagaagatataacacctcattactaataatccaattagccctaaaatgtattttagggtatgttagatgatttttttttcgtaatcacttatagaaaaaaaataggaagaaaaaatgaaagaaattttttcaaaagataaattattaaattacatataaattgatgcataaaagctctttcatattaatatctcttaaaatttatttttagtttatgcgtaaattaattttaatttatgtacgtacttattttattttattttctattttcttctcttataaatgtttatagaatattttatccaaccatatccctagtcctcttaaacattagtttggcctcaaaacaacatatcccatttttatttctctcttttgaagaactttttaaaaaaattattcacgttatcattttaaaatagcattgattattatatttttaagacttaaatatattttttgtttttccaagtattgtagttgtacaattttgatcacacaaattttaatcgagtaaattgaatcctctcaactattgcaattaatttggtttgggatttttaacctaattgagttcaacttgaaccaaattaattaaatctaatagtgattggtttggtatcgaatttgtgagttcacaagatgatgaacccaaaccaaactaacctgttttttatttttcgggttcggtttgccttgaagagcttgctcttcactggtcaccattgataataatgtacagtataagatatttaggtactgggcattggttgaagtagtgtactaaaaaggttgaattgaagtacgggttgtcacttgtaagtaagatcatgcaccaaattttttacataaaaataaaaaattatttacttcaaagatgtagtatgaaaattattgatgggacacaaatgattttatttttttatattggttatatctttaaatgtaaaaagtaacattttacattagttataattaagacggatgtatatatgttaagtaagcaattttcaaactatactttttatgtaaataaatttttatttttacctattttgatgatcagaaagtctcatacaccactcaatgcgcagtaatatgttggagcccatatgttttagcggttgaattggaatctttatcaaacaaaggataagactaacatgttctgattcaattaaaagatgtttaagttaattcattaaccatatacttatacgcgcagttttaaaactagttcattaaaaaataacgttataaaaacattctgcctagaatattcttagaaaattattttgaaaaaccattcctcccttacctagctatgacctaatgccatattaaaattagcggcaaaacaactaaaagaaaaaggaaacatgtggaagagagagcaagttagagcaataaacagatgaatatggataagaaaaataatttggaaggctagcacgcatgacattgtaactcgatgatttcaatgcaaacaacgagatacactaatagtaagcgataatggggaaaaatgaaaagtataaaatctgctattacattatacaaaaatatttttcattataggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatatatatatatatatatatatatatatatatatatatataacacaatataacagttatataagtgatttattgacatatacaaggactaccatgcattgtataccattctagtgtatataatatggttgtatacagaactgtacctacaccattctagtgcaaacaatgaaaagttgtaactcaatgatttcaataatgagatacactatgaggaaaatgaaaagttggctacattatacgaagaattaacccttcaaaaataaaaggtggccaaagttagaggagttaattaataacgagacagtattaaaatatgctgatatattatacagaaatattttcatagaaaacagtccattaaaatctgctgatatattacaaaaatatttttaagaaatgttacatgtacaacaatttgtataataacaatttttgtctatctctcacataatttattacatgtacaactatgtcacatttcaatagtttttcattataagacaaagcaagtgtggcaatgtagcattcttgatatgagtttggactctgtgtccgtggctctaacactgtgcctgtgacttttttatattcaaagaggaccagagtgaggaaaagcaaaagatttccgcttgttctggttttatggtaggtatttgcttgtgtcataggtgcacgaatcttactgtctttataactgctaaaaaatctaatcaatgaacttgtgtttttctcttatcagagtataacatagttgattatggaaatttgaattattatttgttaaaatatttggttgatatatattggtaggagagaaaaatgatatgttactccagttcagaaagaggtgtaatcttacatggaaggagaagatgaagaggccttcataacacatgtacacaacaatgtggagaaaacagaaacagaaggggatttccttgaccaaagccattgcctattctatatggaaatgcttggccttccacgctcttttagctggtatcttttatatttttttaagtatcacatcactgctgcactgctacacttccttgagcataaattttgtgaatttttttttttgggcaataatggtgattcaagcatcaaatagaaagaccaaattgaagaggaaattgatttggacagacaaccattccatggtgccaaaattgtgaaaggctacccgagcaattgattctgagaagtgatgggagattggtgtctttcgaatcccaaccatcgtggccaattcccttgctgttgtgatgaagcctacaaaaagtaaataacttcatcactagaatcctagattgagtcatacaagagttagcacatgtaaagatttatgaccaaaaattgtatgattttgtagttgagattttgccttatttgaaatttgatttttgaaaaaagtttagatagaagttttgttttgttgcaaattttatcttttatcttttgtttcaattagtaatgtaacttcaaataaatgtgatggcagattatatcttttaggaatttcaaattgaatgtaagcctatacatattaattctcattttatgaatttcaatggtaattattagatttaattttaacatctctatcttctctgagcttacttcttatgggctgaaacaaattttgattgagagctaaacacaatgaggttgagtgcaaacgctgctgagtgatccaatttccaggcagttgtggtgcaaatatgtccacttcagacaattcttcatctgtcattctaataatgtttaattgggaaaactatcacatatgagtagtgcaggtaactaaagttttttttcccttaagatctcaaagtttatggaacgttgtaatgtctaaagttgatacaccgctattggaagaaaatcctactattgcttgtatgaaagcttatgacaaagagaaactaaagaaggataaaactatatgaaagctttgactaagagaagctaaagaaggataaaactatcgcttgcattcacgacttgcagatcacattttcaccaaaatcatagacttggaaacacctaaataggtgtggaacaagatccaaaatggacttgacaacaacaataaggttaaatctgttaggcttctcatattaaagagagaatttgaatcaattgaaagatgaaggaacatttcaaggaacaaatcgtaaaaacagattttggaccaagaattaaaacatttaaactcaatattttaatgtaattaaatggataaaattaattcttattcttgttttttcacacttgggatggatgcattaagtgacagacttttttctcccttttttttcaacgagattaagtgaaataaatatgaatcattaactattattaaggttggtaaaatggatccggcctacacttaggatcaagttggacttaaaaaaaaagcctatttgacccagtccatattgcctgtcagaccaaatggacttaggttacgatccgacacaattaataatatataataaatattaaaaatatattaacatattaatataatttatagttttatatcacaatttatatttttttttaaaaagtaaaacatacaatataacaaatacaacaaaaaatgcatgataaataattttttatttttgggatttttttaaaatttgtttgcatataattaatttttaaatttttatttattttaaattattcaaataggcccattgacccaacatagggtttaagaaatttcaggcctgaattgaattatttttattatttgattcgatggactggagcaagaaggcttatccattttgttagccctaaatattacatctaatcttacattaataattaagattaaaatatagtagttacgttattttttatgtaccaacttttaacattttgaggataatggtatctttggagcctgttgaagccttatcataaatcaatatagaacaacaaaagaactgctatgcatcctctagggctcttaaattccaattttagagctcttaaatccaattttagagctctaaaattggaactgatcaaaattccaatatttcaacacttttgcaagtaactgtaaacaataatcaattgcaaaacgtatatattttggaaaaggaaattttggttagagaatcagtcaagttcttgacagtagaagagcaactttttatcagtaaatattagtttgctataatgctaattttgtttggagaggggattgacccgcgacctttcttttcttttcttctttctcaatcatccaacccaccttatatctctcatagaacagcaactaagaatatactattatgatcagaagccccaaatctacgttaaccttaatccttaagttgctaatgtaatcagtcagtgtttcttgagctgcggtccaacgcctaacttttctctatgtacagtatgttggtctgtaactgctatattatcctcctgaaaatatcttatgcctgtcctcgttgtctatcttttttggaagttactttgggatgatctcctaaaaaattctgtgactaactttgagaatgaagaagaattgttcagcagcaattgagccggttcatcatactctacaattgtccctgtacaagtcaaaatagtagtgcttgtcagcaacttacacaaaggggtgcaataatatgctaccataatttgaaatcaagttaaattcaacctaacattacactcattttcagtcccccacctccccattaaattcttttggatgataaccttcactatgagataatgttttcataatcattaatggtatgatcacatacattgaagtacataccttcatcaaggaccaaaacgcgatcattatcaataactgtaggaattctatgtgctactgtaatgactgtacatccacttgtttcttccctaattgtcttctgaattaaattgtcagtggcagtgtcaatggatgcagttgcctcatctaggatcaaaattctccttttcttcagtagtaacctagcaaggcaaacaagctgcctttgtccaacactccaattctctccattctcggccactacatcagtgaaagaatatttcatatcaataacaacattggggtggaaaagcaccggaactgtgaagttggacgtacagttattaaagttatacacctgaatggtggaattttttaacatatttatacctggtgcatcaagaagtctttgatcccgccttactatttcagcaagatggcacttgctgagaacctgaaaatagtagttctttcagtaataagataaacattggcattttcaagaaagtgtgttaactgctaatgctaacctcccaaagttcttgatctgcgtgttgttctagtggatccaagttagtccttacagtgcctagaaacaaggttggatcctgaggaattatgccaagcttagatcttaaatcttgcagaccaatcttggaaatatctacaccatcaataagtatagatccttccaaaggctccaccactcgaaagagggcttgcaccagagtagattttccactcccggtcctgcctactacaccaattttcttttgtgctggaaagacacaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaagcctgaaaatcataagaagcaacttagcaatcctatatacttgtgagtggatctagtcgtaaatcttaattatttcatttgctcgttaacaagtataattgagaaggaattggtgagagaggaaagagaagcatatttcaatcaccgagtactgcaacatgcatcaatcataaagtaccactagtatgtgagcacatcatagctacatccagaaggatctaatacaaacaagttattttctgcaaaattagttttcttttgggttttaaagttctaacccgagggtaatcaataacgtgtagtgtccctctttagagcttcttaaaataatgtagtagaaaagtggttctcacatgcatgcatgtaactgctatcactgctgataagatgaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataaattattcatgattttcttctagttgcacaatttttaattttcttttatatattgttatgtatatgtcgatatattaaaataaaatataatacatattgataaaataaaataatttattgaagcaagtagaaaatttttatttaattcacaggataaataatttacctgaagttacattaatgtctacatcattattatgattgaattatatttttattataataattaaaattcgaatgtatattttatgacagtatttttcttatttaaataattaatttaatattttattttatgaccatagaaagtataaaaaaatataacaaatgaagatggatattttttcacgaaaatataaaaataaatttagatttaacttatcttataaaatataactcacggtgttgaatattttttaatataaaaacaagtaggaaaattacactaaattcacaaggataagctttttttgctaaatattttttttctaatcaaagctataatatttattttacaaaaataatatatatttaattacataaaaatcaaatatcaacctaatcactatttctaaagcaaaataaatgtctaagaaatactatctctaacacattattatattaatacaaaattaattaaaaatattaaattgttaatccctcacacggatcaaaattcctagtttgagtaatagataggtctgcagttacaattatgttaaagattgtggaatgtatcgaaagaaatatatattttatttatatttttgtactttcatggtcatatgtggaatgattatgatttgtgccaatcgatctctcaagtgtcgaccaaccttgttagggcagcaatgatcaacataggtcaacactttggccttatcgcaaagccatgttatgtgttattggtgtaattacattgattaattaggtctctcaaatctttttattttacacaaggtctcccaaatcctagaaaaacttatactgaaactagtttaagaataatcttattaattttattgttaaattcatgaacattaatttttgaacatttttattactgttttagtcttttttcctgaatattttagtctctctttttttatatataaatatagtaatctattaaatctttaaaatattatacaaaatcaaaaagctttcacagcaattatactcaaaacaaatttagaaatttgtaattcgtaaatgtccctatcaccagaatctctgtacagtccaccaacctttgctgaaagatttttgtgtacgtatatgtgtattacgcatggctggagcaaataagtcaactaacaatatatagaattttaaaatataaatatatttatgtcaaatttacatgtgtcaaaacagtcaatcaaaccgtacggtttataaaaataacaaaatcaaattaataatcacccatttttttttttgtcaatttttttatttgacgtttagtttaattcaattttaaacacccgatcaactgttttgttacctttacacgttatttatttactattacatcgctgtactagtgtagtctactttcgttttttaccacttctatacatacctttctatttttgttagtgaaagcgactggtcatgatgtcgtttgtttaaactgatttcgcgtctgaaagcattcagaattaatttctcctgttttcacgcatatttttaaatgaaatttgtgagtgaaataaacataaatatattttaattattttgaataattttaaactaaatataccttcatttataacaacgtttttcgcttttccttttgtgtaactataatcgctggtaatttaatcacaaaatatcctcgcatttttttaaaaattctaaaaatttaaactctttctttgtaattatgttttttaaaaaaacatatactatatcacattttaaaaattatttaaattgattttaaaatatttctctcccactcaaatcaattctgatctacatctaaattaagcatgttcttaattttttaaataatagtttggataagaagaaggaaaatagaggggaaaaagagaaaaatatattattttattttgttgaaaaggtaaaaaaattaaaataaaactcaatttctatttccctctattttatttccaatttaaatttaattttttttttctcctcttactcttttcttacattccaccaaacattttttttattgaacactccaccaaacatggataagtatagaaaagtcatgaaaaaatgtcgtcatccatatttacatttaatgacgagtagatctaattatggatgaagtgaaggcgaagggaagaatttatagcaaaggccaaccagagaaagttgcctcaacccgaattttttgtctacttcgtcgtcctttgggagtttgtgggaaactaagaatccaagaggtaaaattaaatttgaactttatttgaaaattgattcaaagtataaacaaacaatcacaacttctcaatatgtagtagtcagtattgctgtgcaatgtatccacactgattactttttttccaaattaagtcaagcacaccctctacttatgctatcatatatgcaccctccactttatatgtattatttaatatttattaaaataaatatattaaatataattatattttctatatttatttatttattaaataattaaattaataaatattaaatgaaatgatataaaaaatatacaaaatattaaatcaaattaaaaaattaaaattacttccatttttaaataattaaattaaactaatttttagatttttaaaaattcttacaagaaatttaaaaaaattgaagaaattttaaaacataaaattataaaaaaaatgaaattaaaagaagatcatacgacttaattagaagtcatagacaaaaaaaaggcatacgactttaaagtcataacccatatattaaaaaaaagacaaatacgacctagaaatcgataatatatttacgacttttgtatagataggaaaaacaacttgaattatgatttcaaagttgcacatgaaaaaaaaagttgaagtcataatttttttgacgattttcaataaaaaaaattaaaatcatatgtctgaattagaagtcataccacttgctacgattaatcaccatttgataatttttttaaaaattatcccccaatgataattaattttaaaatccacccatatttggtcaaaaagtctatgtatagtgagtggagggcaaagtggacaatcaaaactttagcatgacgaaagagacaagctttctttatgcaataatttaaatcactgatcacactagccacatggtttgttatgagtccatgccttacggtcccaggatactgatgcttttaggggttatcttttgtttatttattgaaggttttattaaacacacgtttgatgaatgtcttatatatagcatccatattccatgactatatatatattgagcgatttagtattggacgaaggtaggtttatgtgttaggtgttcaatttgatcggataataaagtgtccactttgcaataaataaataaatatatatatatggccgtaattgagacagtgagattagccatagtttattcaatcctgctgcatatgttcacctgtttgtttagaaacattctgctgcagttgcattattattttataaacaattcaaggagaattcgtattatgtaccccaaaaaaagaagtgaattcgtattatttcacatggcatgtcacatgagtgccatatccatatgtagtgtaagcaccaatccagctcatacatcaccgctggttagaaatagctaaacattataaactgccccctacaaatatcactgtcatcctcttaccaaaagacacacacttctacatctgtgacttcatttggcttcttcagttcttcgtgtattgtttggtttaaaagaagaaagagaagaattttaatgatgatgaaagaaaagagttagattttaatgagttaaagaaatatcttatttagtttatgggggcagggcaaaaaaaagaagaaaaataaataaatttagtgttaatagttagataaatttgtttaattcagaataatttagtccaattaatataaaaaattctctcatttttagatctcttaaccgtaaggtgtcaaaatggagtgagacaaaattttagctttctctatctcctcctgccaatttttttttaagttttaaccaaatgttaaaagcttaacaaaatacatgatctctatttccgcatccaaacaatgtcagaatggattgagaaagagtaagcagcgctatatattatacttaattttgaagaccaaagtcacgtagctatcaaatagctagatatatatggaattttgctttcgcaaataaaatgattttttactattaagttattatattttattctaaaaaatgtacgtccgtataggctaaaaatgtcatgcatagtatcaaaattcaaatccattctcaaaaccggggacaaatatccttagcagatattgtcccacggtcctagcaactagcaaatcaactgttcaaaatgagcaaacactaaaaagaattcaaaagaagaaaagatgaaaatgaagaagaaaaataaaggatattctttactctttactgtatataatgctagagatatttttaagagtttttttatagaattttatttttatttttaataaaaattctaaaaaataattataactgcatcaaacgttccatgtcacgaggtatgtacgacagatgatttggcagtgtggatttcacactgtcgttagttgtgaacttatcttcataacgagccagcatgtgtttgttggacgttgacgtgtctagcgcaccacagctacctacgctgttgtgttgtgtgtgtctcgtggggccaaacccataccaaaccaacactgccacactaacacgtgattttattttcgattaaaggaataataaaactgctgagtcatcagttagttcacgaatcagatcagaatctttcaagtcattataatgcaattccaatccccgtgtggctgtggaatctcatttcaaagttcaattaaagcggccatgatgccagccatcgcttgcacaacttgccaaaaatctttaatccgtcatttcttgtcaaagttcaaccaagagaatagcaaaataaatgacattgtgagtgtagacttccaattctgagtatataattgttttaaatatttaaaaagataattttattatctataataataataatatttaatttaaattagaattatctttctggtaaaaaatacgtgttctaaaaaaatgacattgatcataaataattaagtttatgaaagtcttctttatttataatctcacatacttaaaaaaaaaaaaaacgtaggaaaaatgacattgggcaaaagtctcaggatatatcatccaaacgcgataagtacgtaatcatatcataattaaattgaaagtaatatgaataatatagaatcaaaaaagaaaattcgatgcatgcatttggaatattggctatccatgtacatccccatctgtggaagaaagcaccttggagaacaggatgccatcctaatcctattgtcatttgttattggggagaagtgcaattgacccactagagttgttgcaaccatggttggaacttggaaacttggaatcattgtgtcaactgaagaactagtatatgactaataggatggaataatataaaatgaggacttaagtaggcatggcaacgagacccgagcccgtgggtacccgtcaaaatccgctccgattttaacggggaaaaatcgaatttgttattgatgatacctgcctcgcccccgccccgcgacaaaaattcggggacgggaacgggtttggtattgatgatacccgccccgtctcgccattaggcatgacaacgagacccgagcccgtgggtacccgtcaaaacccgcctcgattttaacggggaaaaactgaatttgttattgatgatacctgccccgcccccgccccgcgacaaaaattcggggacggggacggatttggtattgatgatacccgccccgcccccgcccccgccataattaaattacaaatttacccttatatataataataaaatcccaaaaccctaaccctccccctcatttctcattctcgatgacgctgaaccttggccaacgactttctgaattaattccattttggaagctttgttgctgcaatggacctctactctttgttgtgttttattttaattttggaacaatatatatttaaatgatattatattttgggagaaattaaatatgtagatccataatgattttaattaaattgattgattttgtttaataaattttaaattatgatctcatattttgaatgtgagtttgttattaatttttttgttacctagtcaactttttttccgtttttttcaaaagaaaaaccatattattttttatttttatttttttaattaatagtaggggtggggcgggggcggggcggggaaaacccgaccccgacggagacgggatgggtctggattttataacccgatggagaatggggacggaggcggggacgggttttaaaggcgggggcggggacggggaatacaataccctcacccgccccgccccgttgccatgtctagacttaagactcgaaatactaccaaaacagtgttttatatatatatatatatatatatatatatatattaattcaagttattgtcagtttataagtattttcctctcttaaatcactaaactaggagtttttttgtcgttgaactaaaccttttaagagataaataaaagataaaacagataatgtttcaaatatgttgaatataataatgtaacatttaaataaaatattagttaaagacataaagaccaatctcacacatgagattattaattaataagccctttagctctttaacctggattgagcggtcattattccatatcactaaaatgtcttaggtttaatgaaaattgaagccaaagacaatttataaacaacctcctcttaactcatggaggagtcttttaaaagacaaaatcatgaagacttataagaaaagtaaaaaatatcaaataatcctaacaatatgctattaaacgtttgtgttaaaatggcctaagccacgcgtgagactttataaacaaagatgtgaagtttaaaagttaaagtgaataatatctccaataaaacgaacctaacaatataacatatttgagcaatttgagtggaacattagtccttgaaagaaggcctaagtcacatgtgtagttgtgaaaccttctagtgtcatgaaaaatctataacctacacactcttttccctcatcctattgagatgccttttaaaggataattttaaaggtctatgagagtcaaagtgaacaataccttaaatatcatgggtccacaatataataaatttgttaagccaacattaaaggaatgcgtaggctacacatggaattgctatgccctttagtccttaactttgaccgaagactattaggtttttatagtgttcaagtcaaatcaattgattgacttttggtttaataacatgtttgtattttgaactcgtgaacatgatgattcgataaaaattaattatttcgttatgatgtataaaaaaaaaatttttaatttatatttttatagtgaaaacatattagtcttgtttaatctataggacgtctttagattttaatttttacctttctaatattttttacccatatgactcatgtggccattacgtaaaattaaagtaggccctctttaatttatttgttttttctgtgtgtgtatgtgtcagtgtgtgtgttttaggtggtcttgttaagttgagtaaatattaaacctacactttttaattatcaatgagctaccttgcatgttgatcaaagttttagttagaaattacttcaaatgattgtcgttataactttgtcttcatacttttgccttgagaattgtgactggtcaaatctaatgtgaagtcccattttttggctttatcggtgaacccctaattttataggtaataacaagtttgtaattgaaaaaaatataaattaaataaaaaataaattaaacgttaatttatttttattttctgtttttttatctccttctcgtgacagtcttctcttccattttgacttcgccggcaactccctccaccaccacccctaacctcctttctccgtcattaacccaccacacccacaacccagcattggaagagtgccatatcccaaatctgtagccacgacctccccgcattctccgacgctctccctgcttgttgcacttcatcctctctgaccactcttctccggtcaaggccgtcagcctcattgcaccatcgctgtcgctaacaaggcacctccgtagcagagcaagcccatatcgtgtgactctccttccgtcgacttggaattcatactactagtagcagagcaccgccgtcatccgcctcctagctggcgacaactcctaccaccaccagtccaccaccacaccacaatggcggcgcaacagtgaggagcaccatgaaagaaatccaaagcaccaagaaagaacatgaaaaacaggggaaaaaaaaaaagaacatttaattgacctcaccgcagtgtcaccatatctctggctcctcctcacggcagatggacacttagtgtttgggattttgttggtgaagaaaggaaaaagagggaacggtggttgtggcgggggagagagaagaggggaggttgtgtgcgtgaaagttgctggaaaaagactgttccgacactggagatgctcggcaggtgaacaattgacggtggcgtggttgtggattccggcactgttcacctaacttttgcttttaattttttttttttaacttaatcatcaggtaaccgataaacaatctagaccgttcattttgatattaatatattcaacgatattgagcattgcttcatcaatgaatcctatttttggacttcaggttagacttaatcattgggacttcagttgtactatgtgtcaaaaaatcaaaatgagagaggtttgcactttgcatgtgttaatattaaggcgagtaaaatacatagttaattttgacgttaccgttttttttaaaatgaaaattttgactttaccgggtacccattcgttggatgctcttggaatatttggggaaacagacgacaagttttatttataattctgttcttattaataagtgccatcttgccccctttgaaaattaaaaaattgttttgcattgtttacaaattattataaccaattttcaattcattgtgttcttgggcgtggttaattagttaaaggaaaaaaaaaggaatgaaacaatcatttaagccactgaatcatttaaggtgtctccaaaatgttttgaatatactcttaaaatatttttttgttaatttaaattattaattaacaaactttattcttttataatatattgtttactcttaactttattagtaagattatataatttaaagacaatcatcaaaaatataatttaaatataaatatataaatgtttttttttttgttttgcatcgatgacatcttcaaccaatagtcagatattaaatgcatattgaatgagtattaacaaaattaattttgaataaaattggttttgtgaaattgattttagttaaaatttattttaaaatgatgtaatttatatctggatgttttaattgtaaaatcaaataagaagtgaaactcaacataatattttttattcaacataaaatttattcaaagttacttgaagtttgtgatttgcaatttgggaaaaaagggactggagtttgtgaaagatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattaaaatccattacattatgaaattaatcatattatttattgatagtgaaatgttaaaactatttaattataaaaatttcactaataactttgaagctaaaaaaagttaaaaataaaataaaataagaattgataaattataataaattatggttgagactttgttttattttgtttaaaactgttaaactttacacaatctaaactgttaaaatatgtaaagttcctgcaatataatgtaccttgtaaacatggattttctatctcatacttacattagcgtatgaattaaagagacaattttttaatataataaatataaataaattcttattattgggttttctttattaataaatttatttattttttatcatggaatagaaatatttttaacctcttaacttataaagttaatacatatataggataaaaaaattgtagcaaaaagttattgtgttgatgaaagcgttattacatatttaaatcccgaccaaaacatttactactagtccaagaggagtattactaaatgagaagtagaatattgtcattaattgaagtattgtcatgtcatgatttggagccatgtgggatgaaagaggaatccaaatcataattactctttgtcctatttggttttccggtttgcagactataaagtaatgtgacaaagtgacaaagagagaaggaatggaatgaggtaacaatgtcgacagaatgacaggattggagtagggttcacgaagtatatcgagattatacggatatttaaaatatttgtaagtgaaatggataattgttcataatattaaaattggatatgggatttggatattagagtacccaatccgttccattccacccgtacatatcatatttatatatatttacaaaataatatatatatatatatattatttatatataatttttaaaaaataattatatttttttatcactaatattagaagtgtctaatttctcataatatcactattaaagagtaataaatcttaaattattgtgttggatcattatcacataatggaaaattttaaatatttaatttgaatttttgctgaactatgaaaatattgactttaacaataattatgttaaatgattatttttgtaattttatttatttataatttgaattttaatggatcaatattatattttcttgtttttaatattacttgtgttacttttaatgttatgtttgagttatttaagaataaatttttactataattgtagtaatttttattgatttattattattaattttatatattagtaaagtacatgtcgcatatatagatatgaatatataaatatgagaataatgattaaaattactacatgcacatgtatataacctgatacaaattatttttaaacacaacatatatggaaagagtactattagacattactcatacctatgtattgttatccctagattggaaaagtaatatcaaatattaccttaatctaaatttacaaaaattgattgactaaaaggctccgagatttttatatcataatttaaaaagttttcaagttatagtcagttttaagtttttagaaattagttttttttagtttaaaaataaactcatttaaaaattctttattttgttaaaaattgtttaaggatatgtttctcatattacaatgatgatgtcaatatgaatgttagcaatgatggaagtgatctcacttgcatagggctagtgatgatggtcagttgttattaatggtgatgatgttagttaattttggtggtggtaacttgaaagagtcattattcaagtagtgagagtgcattattataaaaactaaaaatcaaattcataatttcttctctttttttagttttaaaaatgaatgtaaaaatattttaaaattgaattaaaaatcactttatctttattttagccaaacatgttttgtttgaaaattacatctgaaaattaaaaaacaaaataaataatcaactttgacttgtaaatttgatgtatattttgtaaggtttaatttaatttctttcaaaccttatgttagtttaatttaggagacaaaataaaaaggaaggagaggagtgggagtgtgataaaatgagatggttttannnnnnnnnntttaaaaataaactcatttaaaaaatctttattttgttaaaaattgtttaaggatatgtttctcgtattacaaggatgatgtcaatatcaatgttaagaatgatggaagtgatctcacttgcatagggccagtgatgatggtcacttgttattaatggtgatgatgttagttaatgttggtggtggtatcttgaaagagtcattatttaagtagtgagagtgtattattttaaaaactaaaaatcaaattcgtaatttcttctttttcttaattttaaaaatgaatgtaaaaatattttaaaattcaattaaaaattattttatctttattttttagccaaacatgttctgtttgaaaattacatctattagaaaacaaaataaataatcaactttgacttataaatttgatgtatattttgtaaggtttaatttaatttctttcaaaccttatgttagtttgatttaggagacaaaataaaaaggaaggagaggagtgggagtgtgataaaatgagatggttttataagttgtttagaaaggaaaaaagtgaaagaaaaaaacttcctcttatttggttgtacaaaaagtgagagaaatacatagaaccttttggacaaatttttagtttctcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctcttacaaaaactaaatctccacatgaagattcaacatcctacttcaacaatggatcttaacaagatcagatcttaaggttaagatctcttagaaagatctcttattggagattaaacttgaaatagaacttcaaggcaacatttgtcatcaagcaacgctatcaaatttaattgtgtatcactatccaataattttttttctatcttttatatataaaacagataactaattcatcaaaaccaataaaaatagttaaatcagttagttttagttaataatatcataaattataattttattttaaaaatatttaaattaattggtttaagtaatgattatattttctttttggtaaataagtagtggttacatttaataaggttacatctccacaaattaatataacttatatcattaatagactaataaatgcatgagaaatgaatgaatgtctcgttaataaatttcacaaaataaattcccctgtgcaagacttatctatgttcttaacagttttgtttgaaatgtaagatgttaagttacttacttcaaagttttctgtattaagtttgaaaaacacctcaaggtcaaaaggataaaatttagtttgcctggtattttctacctatgaaaaattagctcagattatttctaccttgatctttctcaatacttaaaaaagtattttgcagggagagctactttagatatgaaccaaagtactaaaaagaaaacccaaacctgagagatgttccatagtctttaatctgggtaaaatcatattgtttatatgagatcttagcctctctctctctctctgtgtttttgggtccatgatttatatatctattcaaatttcgaaggctttacaacaaagggaaacctttcaaataaattttcaaaacatagaagacttttaagaaattacttatataaaaaaatagataatgcccaattaagataaagtgttctaagttttagccagagcagtgtcaccaacccatggttcaaaaatgaaacaatggatattattatttgcttaagagtattactaaatacactatataaatttcgtatacactatatgtgaacagtgaacggacaaaaatgcccttcgcgatttgaaacttacggatttcgttaccttcatacagattacggattgtcgaatccgtaagaatctcacgattttttttaagtaatacggattgtccaatccgtatggcccatacggattgtccaatccgtaggttttttcttttttaagttaaaatatattttttttaaaacaatttaaaataatggcacatgtagatttcaaacctgtgaccttcatgttttttaatgcgacgttccaaccaactgagctaataagtcaattatgttaaaaaataattaatgttgatacatataatactaaattttttaatgtatatttaatacacatatcttaatctttaattatttagtttatctaatttctttatcttttcttatttcagattcttattttattaattagagatattatgttcattttatcaattaggataattgttaggtatgatcctatcaaataagattctcttttattttaattttatcaattaatgagttatatataattaattttatttgaatattgaattattttgaatttatatataattaattttaattttaatgagaaataattcaatattcaaataaaattaattatatataactcattaattgatagaattaaaataaaagagaatcctatatgataagatcataactaaccattatcctaattgataaaatgaacataatatccctaattaataaaataagaatctaaaataagaaaagataaaaaaattagataaattaaacaattaaagatttagatatgtgtattaaatatacattaaaaaatttagtattatatgtatcaacattaattgttttttaacataattgacttattagctcagttggttggagcgtcgtattaaaaatatgaaggtcacaggttcgagacctacatgtgccattattttaaattgtttaaaaaaaatatattttaactaaaaaaaaaaacctgcgtacggattgggcaattcgtatgggtcatacggattggacaatccgtattacttaaaaaaaaaaacttacggattgccgaattcgtaagattcttacggattcacatataacgaaatccatatgaaggtaacgaaatccgtaaatttcaaatcgcaaagggcattttcatctatgcactgttcacatatagtgtataagaaatttatatagtgtatttagtaatactctttgcttaaccggtaaagaaaaaaatgtcaagactaaatggcccagaccaatggaaaaaaggtttacggtggcccaaacaaaggaagagaacatggattgggttgggcattttctttctatatcatttcattttctaataaacccaaacaatatcgagattatcctttattaaaaatttaagaaacttataacttgtcaaatctataatagatataccaaccaactaaattaataaattaattatggtaaaaaataattaatatcattatatataatactaaattttttaatatatatttaacacatgtataaatttacataattttttttaaataattaattttgatctaataattaataattaacgtatttttttacatataaaaattataatttaaataaaaaccataaatttaataaaaatgataggtttaaataaaaacggcattgggttgatatttgaactgtatcatttaattctttgctccgaacttcattcattttatcgctggcagctgaaaagtcaactctactctactctgcaactcattcctaggatttctacaccttgacaaatcctaggtactcttgtagtcttgttcgtttcatttggtttacgttagcatccacgaaactctggttgattttttttttttttttgtgtgtgttcacaaatgagaaacatattttcattattgttgttatcgttctttccgtctctgattttttaatgtttctaattatctgatttttcaatgtttctaactatctgatttttccttagttgtgaagttgaattgtgtccattatcattgttctgctttccatggttgaggattttaagcgaattaggagatttgggtgggtcagtttaggtaggtctggggagaacctgaattgatgaattataaatacttctgttttgtactgattaaaacaaaagtgcttttagttgagcagaagtacatgcacattttatgtggcaaaatttggcatattttgtgttgtgtgaatgtgagtgtcagtatgagaagtgtaccaaatgttccgtagtttatgcagtgctgtgttgttgttcctcatttaatttaggccttgtttggatttgtaaacacttacataagagaagagaagaaaataagaagataaaacaaattaaacttgaacttctcccataagtttgaaatcaaattatgtacttcaatttttatacaagttatctcatccaacttctccaaaaattgagatacataaagttgattttaacttaaaaagaagttatactcgtcttactttttatttcctccataaatgtttatggagaaacaggaccctagagaaatgtcttttggcatactttacttacctgttggctattgtcatccaatttctgttacgtacttcagaaatttggattgaatggagatgacaatgtgtcaatgtcaacaacaacttgttccaacatgattagattcagaggcattatcgggacagcatttgtatcaccatctcccaagaggaagcatgcaacaggaatcttgagaaattttaccatatgtgcctcaccatttatatctttacttgaccctataattgttcagtccccttcacttcaagtattggcttccaatctttcgctggccgatgtcccccaacggtcagaggagtggtttgcccttcgcaaggacaagcttactaccagcacatttggcactgcgttgggcttcgggaaagggagtcgtcgccctgagctctggcaagagaaagtgtttgcatcggagacacaaattatggaagcaaacaattccatggcatggggaacactcaaagaagcagtagctgtagacaatataaaaagatcacaggtgatgagatgagctcaatgaggtttgcagttcattcaaagcagtcttgtgactggctcggtgcctcccctgatggtgttattgggttcccctcacaacttgggatactggaagtcaagtgtccatataacaagggaaaacctgaggctggcttgccttggtcgagaatgcctttctactacatgcctcaaatccagggccagatggaaataatggattgtgaatgggttgatttgtattgttggacgccaaaggaagtactatatttcatgtgcttagggaacgtgactattggaacttgatacatgatatgctacgcgagttttggtgggaaaacgtgcttccggcgagagaagctctactgttgggtcgtgaagaagaggtgaaatcatataagcctgcatctactcaccaaaagacaggattagcaattgctaaaagcataaaattagctcatgaaacaaagttattttgcagagaacttgcaggccatgttgaattttatagctgattagagtttagaagtaataggttaagcattcattttgtatccaaaacattttcattttccaatgtgttagttgctttctgagacggaattggtgcttaagctactgcctttggcgcactattgtcttcagagctaacagcatttgtatagtgttgctcttcaaagctaacggcattttaccctcgtaagacgtttctgggtgaagcttttgtgatataggtgtttgtttttattttattttttgaggaaaaaattctaaagtggttttattattttgaaaattttctttctttttaaaaacagtgtaattattactacttttttaaaataaaaaaatactctcaagataaaccggtgaaaagattaatttgactgttatcgaaaaaaaagattattttgacttgcatgtctactaggaaaaggaaaaacatacaccatccacaaggacatgactaaaaataaggagaaatctatttaaagcagcatcaatttatattatgtaaatccaatgtgcgaactgagatgtagataattaagttatagtagtcttcattctttcttaccaccatagcattttggtcgttctgtcaatttggatcgattccctactttttcttatccacctaaacatttttttattctctagttttccaaacaaataaaaacttataagatacattctatagattagatattcaaactaaagagtccctctatattcatattcatttgcagtgacacatttttacctcttagcaacaactttttaaaatcttgcaataatcgtgccttagtttttgaatgactttaccacaccttttcatttatgctatgccatagtttgtttctccgtttcccctagcagcagaaagcaactaactttttaagaatctaatatcgtactctccaagttttcatatgcttgaacaattgtagcatctttctaaattaaccgagcagggaagaataactttcttaaatggccaacataggttgctaccaagacgtacatctgtgtttcggtgtaacataaactaacgtggcaatgtgtaggaaacaattctttattttattaactgcatttaattaatattaataaagttnaatgtgtaggaaacaattctttattttattaactgcatttaattaatattaataaagttcacttcaagccaagaaaaaaggacagtggggatgagggttttttttttttttccaggggtaggacaagcgtacttttctataacgccagatgccagatggtgaatattttacacaccgttaaaatgtcattatccttttagagccctcataatcaaggaagaataaatcaggataaatctcaatttcaaggtgcacggctgtaattataagagaaattctagacagtatgcaaattagataaaaataatcacaggatacatgtaaacacaggaatcattctgaacgatatacttttattatcacgattcattctgaacgatacatgtaattttgatactagaagagagttcttctagaagtcttattcattccatggaggcaaagcaaataaatagtacaagtaaaacaactaatcctgaggatctcttattcattagtccttgcacttcatctccacattcctttgtctttaccatttgaactttggcgagaaatactgcaaacataagaagaaagaaatgagtactgaaaatagcttgcagtcaaaggatagttattttattaaacaatatctaaattaagatatatgcatctgaaaagttttattgcccaccttctgaatgagcgacatatagtatggcttaactttttcaacatcaattcgcacattgctcttactgtagagatcatatttgttgtgttttgtattgcataatttataagaaacataatcgattccgttatatgttcgtcatgttaaggtgaagacaagatataaattgatatgctaaaacctaaagaaaaataattagcttactgaaatatttctagacacttcaagttcttaacatcttcactatacaggtgtttgtacgctcctgtctggtacaaagttgcaagattatatatatatatatatatatatatatatatatattgtaaattgcatgttatattgttatatatttgagaagggttatattagttcatagtagaacttagtaaaattaaatacgtatgatgaaaagagtgatatcggataaggaacaaatgccttaaaaaggtaaagtggtggtgtttcccttagcaacctgcttatagatctcaatgcgttattatgtgcataaattagataaagagtaatatataacatttctgtttcatttttttatattacatcaaaatctgtatgggatgtcggattaatatttgcatgtttatatcgactcaccaaatgtatgtactcatcatgttccaacgacatcatcacattgtccagtccgcagccttcggcatatatcccacttttcgtattataagctgaatttttgccatctgggttgtcctcgaagtactacaatgaattcaaagaaatatttttgagctgaatatataatcacaaatatttgtcatttataaggtttcttttattgagaaaattagtaagtacatacctttaagtatttgttcatgaaaagcacaaccaagatcgaggaaacaaatcttctacaacatataaaatggtaaattgattatttttcgtttggtttgtcagtagatacatacgatacatacgtgtgtatatatatatgattttcagaattttttatttgtacgaattccatttacatagtcaagaaaataagttgaaaggtcaatcatgaatagtattaattagtgaacaactctcatcaacaacagcccattgaagaagtccatcaaagcttggaaggagaagaacctttccgagatgtgcaaaccaacgaaaaccatcaagtcatgatcaataatgctttcaagataaaattcttctcattctttatgttgaaattttgcttctttttgaaataatgtaaataggtgaaagcaatataattaattaagaattagtatttaaataaagtttatatatgtgtgacgggtacaaatgggagcagtcaaatgtaaccaatcttcataatattagggtagtcctttctagtagcttcagctgtctctgcaagacatcttgaatttgagattcttctcaattaggatccctggcatccacaattttatcaacagcatctcacaacattcccatatacccattttccactctattcaatttcccatactcctccctcatcttcttaggctttgtttgggagttaggaggagaagggaaggaaagagattcaaggggaaggaaagggaggaaaatgaaagaagttctttcctccttatttaggagttaaaaatatattaagagaaggaaataaagaattaataagatacttttacaattttgcacttgaattgtgatttaatgctttgtattttggtgttttattaacacttgctggggtacgatagtaattttattaacactgactagagtaggatagtaattttattacttttccttctaaaaacccccaaataggggagaccacaatttttaggatttgaaggatttcagggaagttttaaaaatcctcaaattctttccctcaaaaattaaatctcccaaacaaggagatgtcaccaactaaacgtttctcttccctcccttcctctctaaaattcctctcccaaacaaaaccttaggcgcgcctgcaataatttagttacatataagatatattacctaagagtcattgtaaatattaatttgtgtatactattaagtttaaagttttgatatttgataataccatactgaaatacaaaataaattaatacacaattatttgacattgttgaaatcaaacttgcttacaaattcataattaagtttatgttgttgatagaattcttccacatatttttgcctttcgctttcaccataagaatttctattttttggagagaaaaaaacattgtcttacttagccgtcactttgcattggattatatgaaaagaactaatctataaaaatgtaacattacaattgaatgcaagcatgaaagaacgatttcaggaactataaattcatcatgtgaaggtgatttgaacaatgggaagtcaccatgcatccaacaccaactcattggtgatttcctgaggatgttcattgttctcctcaacttgagcccttgttggttgtggttgctcaaaaagcatttttcttaatatgagaagtaacagaagacaaaatgttagggaataagaaaatctcaatgaaattatgctatgactaaactggttgtggaagggagtatatataacctgcgtgattatattacagtcaatcatcatcacgtggaaaatctctaagaagggaaacaaatgctgtgctttatatacagtgttgacatattcggatgcatggaattaattgatacaaatgctctagctgctcaacttacgtgtgactgtcaataagggagtataaagggtcagtggcagatctagctaggatcctgggtcagtgacaacaattgagaatagtgtattcaaatatataaaattaaagagtataaaatatgaaaatattaaaacataaaagtagtggattcaaatatataaaattaggagagataaaatataaaaatattaaataattatatgtaattttttaaagtgaagaggtatatgtgcacaccctcactatgttgtatcagacaacttttcattgattagtaagtactacttttgtattcaatttttggatataaataattaaatattatctaactgtagctgttgatctttgtggcagttgtgcctaagagcatctttagtggtagattctaaattgggatcttagacaattttttgatagatcccatagtaccacataagattgaagatctctcaagacctttccattttgttctttaatggtagatctcattttgagatcttagtgagagagaaagaggaaaaaatttattcttttttgaacaatatgcagatcttaaagattcttttacaagaacttattctccatgttggagatctctctatctcttttattgggagatctaataaagaccagatcttgaactcaagatccttgctcaagttcttgcactaaagttactcttaataaatctatttgattgatggtaaactatcactggtaccctcatttatgttttgctgagataaaaaagatcatcatatgacaaatattatatttactcaataatcaaattgatatgtgcatatcaatcatcagcagctaaattgatatgttcctaacaattagcaaacaaatactgatttgcctttcaatccctaaaatacatcaaagattacattacagataatcacatggctattaatagcaataatatacacatcagccagtaatatttattgttatgtaaaataagaattatataaattacattaaaaatgtagtgaataatgaagtgtttaatagattactataattaactaagaaagactttatttagtaattgcatcttaagatgcattgtgaataaagtagcaactaaaccatgagatatacatattcaattgtaaacatcgaataaagaaaagtactaattccaaggccttctttccctcagattcagcatgtgaatcgtgaaccacttggcttatgcagctcctcaaaattcggtgcctcatttgttgaaatttgcagctcaagctgcaaatcctgcatcctctttatagagttttcgagttcaaggttcatatcatcgagtgctcccttcacatgaagaagcctttttaagctttcacttcttgaatctgctgtgcctcttcaagagtgcttagctgctcactacatttattcccagattaacaatctgctcttgaaaaaaaaaaacatcattatgatgggaaaacaataatgtcaactttcaattatgtatagcagcaaattctaatgagaggtttaaaaacaaataactgttaaaacaccaagagagtaactgatatcatcaatcatcagaataattactcctgtgattggtgaaacaacagcacttgcagcaaaattaacaatgattcaaacctagtgtatcaggacttgatttatctccaagacaatgtagccaaaaactcaatgtcgcagcatctgaacgctattaatgtagcttcacatctcacctgctacaacatggattgaaagttggcctctcccacaagtaccccatcaaaacaaacctcaattggttggagtcaaatgagcacaaacaatatcagctggtaaggtttactgaatttaaagaaataaggcaaaaacttggtgacaatgttctatctttttaacttttgagcatttgttttaagcataataaaacattattttaattgtgctttttagtttctccacttgatttggaatagagtgttgttcaaaacctctttattggggtctgtcatggttgtttcaagggtgttatcttttgcatttgcttgcattagccacccaaatacaggaagccacgatcccttctaggacaggttatcagtaaaacctgtcaaattgcattcaaaattgctcaaaaaattaaaaacatactactcagaaaggtacatcggacacgacactgatacttcgatacgagtaatgtttaaaatataggatatgggaacacaaacaaatctaatgaaatgaaatataagtaacatataacaaatatctaaattgatagtatattcatctttttaaatcaattttttatgatttttcaatgtataaattgtgtaaagataaagacttaagtattcaagccaataaatatatatttttaaataaatctaataagaagtgtcaaacatgggttcaacacggacacttcaaacaaaagatgtccgtgcttcttagaaaacatatacaagtaacttttccttttgctaaaaaattgtaatagaaactaggaaagcatacaaacagaaaaagtagaagcaggtcctttgtcctcaacgtaacctttgtcgtttgtctcctgtgtgtctcttgtgtttggtttagatggtagaaataaataaataaataatattaatttaaagcacactgtaaaagatgtaaatctcacgtaaaaacatgaaaagtataaaatttgtctcctatttctctatcctaaatcaaacatagcccatttttatgctcctcctagctagtgtttcatttttcattattcgtagacaaacgcatcctctatacaatagacgaatattttatcattaaaagtcatatttacttctctgatatatatttttattcaaatttcttgtttttttatacgtttatgcattaaattattcattgaattcatgatatgtgtagaatggagagtgcaagaataagccagcagatgaaccttctactatgtacactatcatgtttaatagcttaggaacatacgtatagatgttcaataacttagcagcatttttaaaatgttaacaaaaataattttataaatgttgcaataacttggcaacctttttaaaatgttacaagaacatatttataaatgttacaataacttgacaacatgttttaaatgttacaaaatgttagattgataacatttttaaaatattacaattaatatgcaaaaatgtcactaaaagtctttagtggcatagaatttatcttatatctgataaaatgtcgcaaaatataataaaatcatttattcataattttatgatatttttaaatatttccaaaagcatcttttgttgcagtgatactaaactataggggtacttttgttaataaacacaccatttgtcaatacaaaaataacaaaatgttccttggcctaaggaatcaaaactcagtttgcgaccaaaacttgaggtcatttgaacgcaaatgaggtttaaggtgatttgaacgtgaaagcaagcacattcatagtaatcctcccaaaagcttacacccaaaacacaaggcaacaaaaacgtaatttatggtttttgaatgacttttaccacaccttttcatttatgctgtgccttagtttatttctccatttcccctaacagcagaaagcaacaagtatttgttttaatgcactcatcttgggcaaaaggaagagagctaattgttgttaaagtgtcattatccttatgaatccctccatagtcaaggaagaataaatcaggaaaaatctcaattttaaggtgcacggctgtaattaaaagagaaattctagatagtatgcaaattagataaaaataatcaaaggatacatgtaaacacaggaatcatgccatttttgaagacgtccaacacaattacccaacaggttagacttctataatcaaaacatcaaatcattctttatttaagagacaatcgaggccaacataacaagaaactctttcaatacggatcggggaaaataggaacagaaacaaatttcccagaatatactcaagtagaaaataaatagtattcatttttaggtctcaagtctccaccataaatgaatttcacttgacataaacatggatatttaaagacatcataataccactttccttattttcccctccaaggatggcaaaaataaaaaataaacagggtacatacaccactgcctggcaagagtgaatttatcaatacagctaatgaaaaagtaaccataagtctaaaagatcagagtgttcagactggttatgcatgcattagagccaatcgcaaatgttatttgaatgtgatgttgcaaagcccaatgccccgactgcagccctcataacttcataatcacaacgtgccacgtaactgaaaaaccatagtatgcagtaggtgatcaataataatcatggtaatcatctggttcctgcaggttacactctagtagctgcaggaaaaaaaaaaaaaatgatgtcccactttctctacaagagaacaatccatgaatgaatcccacttccaagagaccaaatacagaatgccacacaactccaacagcacccaacatttcatatgacttccatcggagactttctcctcacaaagacttcttcaacaagatactatgacaaaccctagctttggtcatgaataacagctgatttatctgatccaatcttcctatcttctctttctgaacatttgactagctgcttagagcaagaagaacaaagcaattccagacaaaatgtttcctcatattcactatcattgatgcagcaaccacactggctacatctgggtatgcatagagtgcatgccctgcaaatctgagtagtgtgttccaccccttgacaactcaccgccggacaatcatacacaagcctcaaattctggcatagtggacaaacttcaatgtctatgactcgatcatcatcacaggaaagatacaagttgcccctgcaataatagtgtggtttgtgagagtgctggagcagtggactatcagcccccaacaagaaactcagctcttcaaaatgcttttgtgtaacaccataaagaccacctatgtgtaaatgcttcaacccttgggtacccatagagttataagcttttaaaatacccacaataccctcaatactgagtcttgtacatcctggaacacgcaactgcataattttgtggaaaaaaattacttagtagtaaaataggtacagaaaaaaaaaatctaaacctgagctgagctcctcaagtattcaatgctcagataatttattgcaataaaaagttgacacaggccagggattaaaaagcagaccaacagggcaacaataaatcacatgatacatgaaactataacgaacatcgtcaaaattactttaacaatacaagatctgtaaaattcataagaattatttaacctgaatggcatctaagcagtaaaagaagcttgaatgaatcaaagttgacagttgaagaactaattttttttatacaagttgaagaattaatttcccccaactagaatattagaattaacaatgcattaattgatacaaatagcaaaacaatagaatattagaacagtaaggttggcaaattaccaacacattcatacagttggagtcaagcatatactgcttaattattttttgccaaaaatcaagcatttcatatacctacatacctctaaaataaccccaaattgatttcctgtaatggaagacagaaaaagaaatccagaaacaaatacttatgaatgaagatggtgtaaaggtcaaatgttctgcacaaaatttacagacatgccaaactataaaaatgggtgcaaacaagtgccctaagggtgaaaatcaataaatagaaaattattatcaggaaccaaaattgtaaattattattacagtgccctagtgtattgaaaatcacagtgaaggtacattaatgatactaataaaatcttctcacgtttgattccttaaacaatgtcctaaagacacttataagcatcctgctataaaaaaatagaacaaaattcaacatttaatcaaaataaaacaacagcaccagctaacatgatccaattattcataaaacaacatttgcatactttagatgaatctaagtttcaatttgaaattaaccaacagacacagattgctagtgcatgttcaccttggttaacttgggattgccttgaagaacccgcttcaaaccatcatctgttatcctggtacactcgaccagactcaagcactgaagatgaccttgagccctgttggtcaattgaaaaagaacatcatcggtaattctctcattcaaaggcggatccacatgaatactcctccataaaagcggatccccacaaaccgtgaaatgcaaagatttacacaccctttcaacaacaagcagatcagacaaacccagataaccaagagaaaaactcaaggccgggtgaggagcaacatcacccccatctcctcccccatcccgtctcagaacatcaccagagacatcatcagacccgctcgtagcaggcaaacccgacacttcatcataattattaacagatccaaacccaaaattgctcgatgcagcagcagccccatcatttctcacagaaaaactctcgccaagccctctcttctcctcaacacacgacgcatgtaacctcatagcattgttccaaatgaaattcaacccagcaaaaagctggtaattgccatcactcgcgccaagctcgtcccttcggtacccaccataatcaacaatctccaaatcctcgagccacccggtgatggcggtgacggtggtgctgatgtccatgccgaagggatccgaaggcaaaagatcgacaatgtcatcgtggctcgcaccaccaccacctctatctctcccataatcaaaacaattatcaacaacactcttctctggaattcccatcctcatcggcgaaaccaaattatcctcagaaaaaatcggtcgatgagagaaattcaacgccatcgcatgtatctatcgacctatctatgtacacaaccctaaatcaataaacaaaccctaaatttttttcgagacgcttttttttttttttcttttccttctcagaataacagaacaatacaagatgaaaaggaaaaaaagtatggcactagcagagatctaacaagaaaaccctcgatttcggatggcaaactaaaacgacgcaccaaaaacttcacagagtttcttgcgaataacccaattgacaataatttccctaaaaaacagctagaatataatcagaggacggaaaatagaatcgaatatatccacagaacaaaaaatataaaattacaaatcgaaatccctactctctcttctttttttttgttttttgtctcgtcaacaaccgataggcctgaagattaaaaggggaagggaaaaagaagacaggataaggagggaaaaggagaagaacgaaagaatttacgtgagaaacgaaaacgaaaaggaagaagaagaaaaaagagagaaaccctaaattgaaaatgagaaagaaagcttatagggatggaattggaatcctgaagaatgagttgagaagggaaaagggaatcgcgtttcccctcgggtgggtgccgatgccgatcgagttcgcggtagcgagcgagagagaaagagagagaaaaaaatgatgaatatagtatatatatacatacaaaaaaaaatattatgaggaataagaaagaaagaaatttggggcccaaaataaaaatgagagagaaagagagagggtaacggtgaaatctcgagtgaaatacggggagatttcgaagagtgtgggggagggaacacgtggcggcaaaacaaaagtccttagaaactttcttaggcacttctcaatagggtgcatttttttaaaaaaattacaagtaaattttaaattaatatcaatttagaagaaattgtgacgccttttaaattcaaaatcataatatctgttataattttttaaaagtattaaaatctaaaattttacaaggtttcattttttttataaatatgactttaaagtcataacaattattattttgttttttacaattttaaattttgtaacaataattttttatgtaaagtattttttataaatcataaataattttttattttaattatttaaagaataaatatatgttttatttttttattttatttaatattttctatattattttgatatgatttttaatatttaaatattttattttatttaatatatttaatttttttatattttatatggatttttaaatatttttatattattttatttaatatatttttatattttatatttttattattgttatgaattattatttatttttaaattaaaataaaacttaaatataaataaaaatattaaaatccaatacaagaagataaaaaattttgactcatacccataagaacatgtgtgagacattatttaattattaatatttttattaaacgaatatgcaatacatcttactatttttatttaaatttaaacttttataatattttttttaatttacaaaataaataataactcttaaaaataataaaaatatattaaataaaataatataaaaatataaaaaaattaaatatcttaaataataaataataaataaaaccatataaaaatattaaaaaatatacattaattctttaaataattaaaataaaaaattatttaggatttgataagaaaataattattttacaattttaaatttataaaaaaataaattattacgactttaaagtcgtaaaaaaattaattattacgagtttaaaatgatatttaaaaaataattaaaatagtgtaaaattttactacttcaatatttttaaataaaaaaaatataataannnnnnnnnnnnnnnnnnnnnnnnnnnnnnnnnnnnnnnnnnnnnnnnnnnnnnnnnnnnnnnnnnnnnnnnnnnnnnnnttaattcagaagacataattgcaacttattcttgaataaatattaatttaaaatatacgcttaaataataatttttaaaaaaaaattacaccctattaatacttttgcccactttcttcgcaactcttatgtatgtggcgggagaaggaataactctttcgcatgtattgttaaagccaatcatccataattatcgacaagtggttagttcaaattcaaatagaattgaatttgaatttcttaaataatatctcaaatttaaatttatgaataaaaatatatggttaaaagatttattaaagataattagccaaaaaaaggttcatagttcattgaaatgtgaaaatttgtaaaaatcaaatattgtgagatgatattttattttgtagttatttgtgaaatgatatttaatatttctaaaaattggtaacttgatttttgtaaggtaaatggattcctctactgtgtgttgcatatttgttaaatctactttgttatatgaataaaaaaatgttttaatattttatgcatactactgtcattggtttaggtttttttaagagataataagtaaaatgtataaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgctaaagagattcaattaaaagaatcttacttactttatatgttttgaggttttaaaaagttataaataaaaaagatactgtgtcatacgtaaatgattaatgtggttattgacatattttcttgacttataagacacacacaaaaaaatagaaatattattcataaattagtatatacaattagccaattacaataacttcctaggttttgtgtaattatacaagtatcacatatatttttaattattatatttatctctcttataagaggtatttgtgtaatattttcaaacatataagatgttattagtataatattttcaaacttaaataaggcaagattagtgtacagaaaattaaaaaggtgaaattgcatgtgattttattaaagcttaggatatattacttgtaatgtagtccttgattttgcaaaattattattattattattcagtctccaaaatttaaaatcatcacaaattgacactttttagtggtttcaagttgttattatctaattttaaggatccaaatataaaattttataagctcaaggacccgattgtaattttcttttaatttagaaacttaattaaaaatttgcaaacaatttaaagacctagggatcaatataattttttaaaaataaaacaattgagttaatgatattaacatagtgattaaaagtgtcattctgtacttcataaaaaaaaaagtgtcattctgtaaaactattgtttaatagagtggaagaaaatggttctctccatagaataaaaattgcaccttaatttcctgtgatctcacgtgtgttgttttatggaagattgtatttttattttccggggctaccaaggaagaggcaatctacataggcttgatccagaagacttttgaaagagcaaatggacaaattaagtaagaataaaataaactgcgtaattccatattaaatgagcagaagatggttttgggagtaaatgcaggtgaaaatttggggggaaaaaatacttaggatttcccaccactggaaaatcaaaaaccaagtgtttgattttgtgttggacaaagtcaagaagaaactaaagggtggaaggagaaagacgttatttagaataggaagaagttataataaaatgcattatattattgcccaagcatttcccatcttttatgcaatgagttttgctttgcacttccaaaatcactttgtgaccacattgaatgcttaattaacaaattgtattagagaggaaacttcattggcttagctgataaagacttgcaaacttcattggtgattgaaatagagaaatgattttcagtattttttcttcatccgaggcacaatgtatataaataccctttagaagaagtatgaaggaatcatggcagcatgttactcgtattttaagagtaacttttggggtgaatgataatatatctaatgattttactttaaaccaaaacttgacacatttaaacttccttatgctcttagtgaaacgataatcaaatgcgtgcacgaatacatttaaattgtttattttaagattataacgtgattgatggaagaaaaagacattggtgttattgtttaagcatggctggtaatttaagtttataatattttattataaatttaataaagaaaataacattttggttatgatatgtattccacattttgggttgcttgcagaaggaaggtagcaacacgttggaagttgggacacgaaaactctatgtaagaaactatgaaacacccccaatgaaagatggccatatgctaatgctattttttcagacagtgatgttaactggtcaattttcaacccaataatataaccgactatatatccagagcatacggtaaattatctaaaatcatattaaaatatggttaaggtaattttagataaattttcacatatttatttttatgttaaaaaactgatttagatccaaaatcaattcagagtttaaacaactttgggtagcttttatattcgataaaaataaaattatactgaatttaactataaacttacttttataataaaaaatttcacataaatcatatcaacataaaattaattttaaccaaaatcaattttataaaattaattactttttaaaagcatttttttctcacgctcatccaaacatacttaattggtccaaaaccaaataaatctttaaatatggggtacaaagtcgactcataagtctatttaattctagaaaaatacacaaccctttagtattagacgtagaggaaaatgatattaaagtagaccgagttctttcttaaactatattagtttattatgatgaggagaatacactttctatttgcttgttcgagattctagaccttttaaaaaaccaacttatttacattttaaatatacattgctctatatttagtgatatgagtatagattctgatacaaataatgacctcgatcgtctccattgactaactactaaggatttcttttactttgtgttagcagagaatgatgaaggagggactagcatatttacaacacattgacactttttttttctggtatgaaaattgaaattcatttaaaggtagaacaaattaagctagacaataggcaatagcataatttatgccatgttctagcacaaaagtgtgatacaaaagtctccctaaagctatacagcccaattatagctacataaccaaaattgaggttatattacctaattcagtaataacaataaaattgcagtaacaataataaaaacaagaggcctgattatgctaccaattcagtatggagttttgaagatctagtatcaagatgattcattgaaagttgttatgtctcgacaactatgcccccatacacttactaaacaaggacacaagaaatgagtcaatgagaaggtgataatacctgagattcgtagtacctcctctatagagggggtaacaatacacaagtagttgatcagcagtggtaatttttctttatggcgcatacaaaaagagattatccttttgggtttctaaggttgtcgcttttatggatctcagccgtatggataaggcttatactaattcagtaatttatgattacccctactcagtgcattaaaattacactcttaaaataattagtaaaaaaatgttgcaaaagaatacaacattcatttgacaaaccatcaatgctacatcctatatgtattaatatacaatcttaaagtattcaaactttgatactttgttgcaatatataattagagaataatgtaagtttacgcccacaatatactacaggtcttgagcgttggaaaagagcacatccaaatcaaagaaaataatgcgttcagcaacagaaaggtgacatttcaatgattcccataaactcaaacaaattacgcacgacaagcttgcaaattgatgcttgcatctaacagatatactcattccttgaagcaaaactgacggttttgaattagaacccagtgtatgtatggaccctcatcttagtcattgaaaacagcattaacaaattgtcaaataaaaaagttcatcaaaaaccatgatcctatttaattcctcgatttctttcttgacttggatgaaggcttggtttgctcggaaactgcattctgcacagctcctttggagtttccctggtttgattttagatttgaactgttagatgaggcaccagtatcatgcttatctctaactacagcaccttgagaccctctcacttgagcagctcttttgtccttcctcttgggcctatatgttgatctctccctcttgggaagccacctttctggatctgggggaggacctggatttgcagggtcaaaccctttaggataccttggctttctctttctctttttcttagattttgtcttattctttccttcctcatatgtttcagggacaccaatacgaggagcatcaacttgtttcactccagaagtacgctccaagctgtccacatcaattccctttaaaccaggtagagccttcagttgcttttcataaagctctgccttagcaacatccatgcgggcaacggttgttaccagcccaactagtgcttctatgctttcctggcttttgacgagctgctcatagagttgagcagcatcctcttccttcccatgcctcagcttgaacaaagcagcttcttgcattatagtattgagcttattgtcctcagtcatagcattggaccaccatttagttgcagtgtcaagcacagcagctgcaccatcaatgtcaccagctcgttcttttaaagacacaagggtggcaacagtagcaggcatgtgttggatatccgatatcttagtgagagaatcggctgcaatatgtgggtggccagcagcagcagctacctgagcccgggctaagtgaacaactttggacttatcagggaacttactagcaaactgtgctaatatttcctcagcccttccagctttgttctctctaacaaagagggcagcttgcagcaataccggtatcacactttctggaaacatgtctggtaatgcagaaacaagttctcgtgcctacaaatagtaatgatcaacagtatgctcccttgcccagtttcaaaagaaagaatggatatacacaattgatgattcaagaaggacaagacagagaaagaagaaagacctgctcaatcttattggcatgaagaagtaaaagaatcctatttgcatatattgcttccttttcttttgctgaaagtttcaagtctagtccaggagctagtcgaaagctttgattctccttgtcttttaatcgatcaagtttccttaggctatcagaaacatcttttggacctttcagtgaaacaagattgttcacggccaccgcaattgatgattcatcagccatatctcgtttaatcacatctgtataagcttcaatagcatcttccttacgcccaagaagctgttcatccatgataaattaatatttccagctcttggaaaaaataatacttgtttgaaggagaaataaacttgagatctaaacatttacctgctgaacataggctaactgtacagctataggagacaattcaatttctatctcatcatcagccaagttatcttccatcaggacctcttgaccaattctgatccaaaatatatgaataaacataagtatatggcttaagttaataggttatcaattaatgagtaaggaagtaaagcaaacagtgacaacaaagcaaatttaaatgtaaattaaaacaatcaacaatgaaattcagattgtgcctcatttctagtatccccatctttttcacctttgaatccagaaccacagctcccagatcagagctctggtacaaatttgttcggatggatgtcccccaaattacagtcaaaagtttctcactcgcacacttgtcaaacaagaaaattaagatagaaacactatagaacttcaagggttcctccctgccctaaggctccagttccttatcctcactcacccaactgaattctccttctcactcatttccaactgcctcatagacagactattatcctgcaggtcattagcttgagtatttcccatccttccctttttgtacccttggcccaaatcactgcatgtgtttctagccatcatcacgtacatctcattcccatgagtctaccacaattaatacagcaaacttaaattgactgggcaaatggaagagacatagtcacatacatcaaacaataacatgccaaaaaaaaaaacaaatcatcaaggattcaaagattctctcaaatactttagatttcctaaatcgccaacaatacttaataaggataacctggccatacataaaactaatcctaatctcaacaaatctctactttgatgaatgtcttggaaatttataatagatccagcttgaagaaccaagctcctcaaaatcaaatggagaaggaatttttatctgccaaaaatcacaaacaataaataaatacttatggtctctctactcactattagatacacataaccttatctgtcaccattaatgcttctaagatgtccttcacactacccctcaagtagaagcctttcctctggtattcaacttttactgagcatcaaatccacttttaacaagagctacatcttaatcaacatgttactacacaacaagccacatgacttttaacaccattcatcaactacagtttatccaatcttttttccaagtcaaaccatcagatctaataccacttattaggatcaagggcatccagattcaagaaacgaatccagtgggcttgccaagatcacagcaatgggccagataccatatctcaacccaaaaccatgaggcattatgttcatggatcttttcactttatatggacctcaatttgtccatgcttttccaacgtgggagtactttactcacaccccacattccaatcatatttgatttcccaacttaaaggacctaattactattggtaaagataaaaaaatgtaagtttgtaccataaatttcaagtgcattaaatttctaaagaaagctctagaattcgcaggtacaagctccaaaagtgccgtagatatggtatctagcaactgataagtcagacataccacactcatattacagtgacaaagagcagggggggggggagattgttatactatagtatattagtattatatattaaccatgaaaatgcaggcaaatttgttcaatatcatgatttctataatcaaaatagcatatcaccttcggcctgacaataagagttgttctgcatctgtgtacttattccttgcaattaaagaacaagcagtgttgtatgccaattcaaagctgcttgttgccttaacccgaagtgaatccagcattccttgaacttcagatgacttgccagccataactagagcagcaacagaatttatttccatgttatcaatcttggaattttggagcttgtggtagatatctaagcaagcattcattttcccaagacgatacaatatctgacattccaaaagcatagtttcatcattgctctcttgtcttttcaaagactccaaagcttcatccaacttgttttgtctgtataagcagtatgcctatttagaaacaacaaagtgaaaaacagcaatcaatggtaagcattcatcttttctattagatcatgcatgaagcaatggtatgatgaactcaaacaaggttttctttcaaaacaattgaatctgtatggttcttttaaaaggagtggagcctgcatatggacttgaatttgtaaaaagataacaaattatacagacacagtgaaatacagaaacaattaatataaccaatttaagtaaaccaaataaatggaaaacaaatacatcaaacaagaacatgcaaaaaataacaaatcacctaaaattcgaactatttttcttgactatcaagttcactcatttataatttcctcgtctaagtatccaaataataaacatcagttggaaaaagctgctaagagtcccacatacagcagcagaatggttcaatttcataaaaaaaactcaaaactaaaaggttagacttcagagtcagacatttgataatgatttaataacaatttgcatctttgagtttgattggaggtatgctgcctaaatctttttccttccttcttcctcaatttctcttgcagtcacaagttcacacttactatcacactagaggataatctgcactattataccatcctaactgtaaaacccttccttgtccactaacctaaaatcctcagttcttattaacatgcattttaccatttccatccagtatcccgcaattccatgcttcttgcacttcaaccagctttttatttatttttatatctaattcaatccttaacctctaaacacacacgtaaacattcgaaatctacaaaactcatatagcaataagcacatcctcagatccgtttccaaattcgacaattgaccgacgaaaaagcagaaaaaaagcggaaaatttacgtgccttgaggaaatgaaaatcatcaagctgcttcttagaggactgaatggcggagagtgcgtcctcgacgcgatcattttttatcagcgcgacgaccttgcatcggagcgcgtcctcgtcgccgggagcaatggcgagaactgcgatgagaaaacaaatgaaggcttaggatatgattaaaacgaaaggcgtttgagaagagaagtgagattaattgacggactctgatcagtgagcttgacggcattgtcgtatgcggaagcctggatgtggcggttaagcgtggtaaagagatcttcgagggcaggaggaggagcagactgcgacggcgccggtttgggcttcggagccattaggtttcaggcagcaaaccaaatctctgaatcgtgccaacgccaattgacttgcgttttatgttgtgttgtgtggttcagtcgggaaagaaaacgggtcgggtgtggctgcgggggttttcttctttgtgttgcctatttttttttttttttaatattcaatttaatctataaattctaacatttgagtgttaaaagataaaaaaataaaattttatttctgaattttcaaaaaaatacaacaaaatcgtcttcttgtcaactctcttccttatcccaaatagatttgcctctggatcatgaaacttatttatctataacgtcatgtgtataaacacataatcacttcggttgatgatgaatataatgaactaatttgtcatcaaattttcaacaaactaattggtgagattgtgcacaatcgataccctccgactcacctccacttgtttagaaaaaatcaaagctctaaattgacaaaatgctagccaaagattcctaaataataagtttaggaacagagtttaatgtttattcattcataatataaaataagtttatattattatctaattataaaatatcgtttgaaaataatttaaaatagttattttaaaatttaataaattatcaaatttattatatataataaattatgatgaaaagattatttaaaaaaatttacaatcgtataaccatttttctcttatttaaattacacatatgatcaattttctatctaaccgatgattttgaacatctgatctgatttttaagatattaataaattatacttacactttttaataacttgttcaaacattacttaatatatctccctatttgtctatgcatttactgtaaaattttcatttttcctcttttactgtgacccacagggcaaaaattattgatatagttttgaatttttttactgcatatagttttaatttaattacaattaaaagttaacaaatttattatatatactactctgtatttttttatgatattaatttgtgaataaataatgatgtgaagttattttatattgttttgtgtataacttttttttttcaattgattcactttctcttgaaaaagatatagcatataatgctagtcttttccatctttttcctacataattgagattattttttataattaagtgagatcctatataaaactgacggtcatgtgaggttttaataattttttaagtaaataatttaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttaattaaaaaaacattattatatgataaattgtgtgtagagagagatggagcgtttcaaatgtaaaactcctatgaaaaaagtaaatgaaaactttcaatgatagtgcttgtattacaattaaaataaatcgagtgagattaaaactcaattacgaacaccttttatggaattgagagacactactaaatttatgtttagaaaagatttataacgtatgtgtataatactctcaccatgtctaacgcagaaacaacactcaagaacttttatgtttttttttaaactaatgtgaaaattagcaagacccggaactgaataaatgatgctcacacactcaaatatataataaaatattttgtattgtttttaaatttaattacaataaaaactagatgaaaattttcaataatagtccttgtattacaattaaaaaaattgagtgagattaaaactcaattaggaataccttttatgaaattgagaggtacaacactaaatgatgtctaatgtatagaactcgagtaaatgacatcaatttgaggtgtcttatgaaatggcgccaccaaacagtcaaacacacagtttaacatactgacaacttcatgagttagttgcacatagtgaaaattagttaaccaaatgatttttctcatgacaaactatcaacaagaatctctatttagattaacgtctcctccaatctatatgtgacaaaaaaaactctccacaatttatttgttttttacactttttatgttattttttttattacacttgtgtaatcaatacagccgtatacctctcttcctacctagcttggcacattcaaataaggtgcatcaacttggtacaccactcttgctagtgtaagaagtatgtttattaggaaaatttaattcaaaaaaaatatattgagattatcttaatatcgttttaaatttttattactgcccataaaaaaattattactactagtaatagtaaaaagaaaaaagaaaaacaggccggctcgttttaaaattataagatagcgttgattatgacatgaaatactattatattccatatatttttatgattttaatttttctaatgaaatattatattttatttgtagtattcttattttttcagttttaactttttattattgtgttttttaaaaaatgactaactcactcttagagtagacatgttttcaatgttttaattatatttatttatttatcttaatatttttaaattgaataaaaataatatatttatcatcttaaaattatataaatatttaatatctataatataataaaaattaataaaaatattgttgggggatttaaaattattctagaaaattaacacccctcatcatgcatgttccattgggtccacttgcggatgaatagaccagttgatacgattaattattattgaaataatttatttaatgataatcattggtaattaataagtgtgcaagtgaatataatcagtgtcaatttgaagttctctttgtacattaataccattggtacataatttacaatgttcctttttaaattaaattgagtattttatttaactaccgagatgagtattttaggactgtagttattaattttcaaatttaattaaagagaatattagtaatacctataatgttatatctaattaagtgaagagtctaactcagatcataaagtattcaaaaaaaattatatttatcttcgattcatataaattaaaaaaataatattaaatataaaatttgttctaaatttcataagaaagttatactataaattgtatgaatcaatacaaaaaatgacaagaaaatccatcccatcttttctacattcatcttcatctctcgatctctttgtatttcttcatctcattctccactctattgtatcaatttttttcttctttttatttctcccctttcttaacaatcatatgcactgcataggagtgtttaaactttaaacaactaaacataattatcctagtatttagtttcacaacacttcttctgtttcaagccttggaaaatgtaaattcgacttacataagggtcttcgagaaacgaacaaaaacaaaggtccaaaccagacattatttatttatttttaattaaaaaattaatattaagatgcagctacccttgcttcattataatattaagatgattgagataattctaattatagtagtatatatatatatatatatagcagtagttatccttgttgcaggcaaaagcatccattgatataccatagtccttttagtcatacaaagcatgaaaatggagttgatatcaagagaaacaatcaaaccctccacgcccaccccttctcacctcagaattcatcccctctccttcgtagataacatcgtttttcgcaactacatccccttacttttcttttacaactcctccacaaaccatgaccaaacatccaaaatatcaaaactcaagaaatccttatcccaagtcttatcccgatactacccttttgcaggcaaactcagagatcaagtttccattgactgcaacgaccaaggagtgtcctttctagtcacaaggctgagatgcaacctatcatcaattctccataaccccacggaagcatcgttgaatcctttgttccccgatgaactacagtggaagcctatgaagaacaaaacttcaactatagtagccatacaaataaactgttttgcatgcgcaggaatagcaataagcgtgtgcatgtgtgacaaagttggcgacgccgccactctttcaaacttcatcaatgactgcggcacactcaaccgcgaaaaggaacaagaaacaaacattgagtgagtttgtttaaatttatctttttaaaagataaactgtttttctattgtgagtttgttcaaatcatttttttctgatttatttatcttaattaaactactttaatttaaaataagtaattttttttattttttttttggagacgaatcttatctttctatttttttttataaaaaaaaacatacatttttaaattatttctatttaaacaagctaagtcattattacccttcgcagttcccgggggttcactcttcccgcaagaaaacttacctgttttctcagaagctttgttcgtggaaaacgacgccgtttgcagaaggtttgttttcgaggcctccaagatcgactccctcaaagccatagtgtcctcccacaacgttccaaaccccacgcgcgtggaagttgtcagcgcgttgatctacaagcgcgcggtttccgctctagggttgagtttcaagacgacgtcgttccgcaccgccgtgaacctccacaagagaacggttccgccgctcccggagaagagcgtggggaacttggtttggttcctgttcgtgcttagcccttcggaaacggagctgcatgagttggtgctcaaaatgaaacaagggttgggtgagttttgtggcacgtacgtgaagaagtatggagggaaggataagggcatgtcgttcatctcggagtgtctgaagcaggctgcttcggttccagaggctggtggttcggatgatgaggagagtcaaatagtaaccatgttttgttgtgcgagttggtgcaggtttccgatgtacgaagcggattttgggtgggggaaaccggtgtggttcaccactagtgagtgtcccgtgaagaatagcattgttttgatggatacgagagatgggggtaggattgaagcgcttgtgaacatggaggagcaagacatgattaggtttgagagtgacgtggtgcttcttcaatatgcttctcataatcctgcggttggacatggtaattaagcttacgaatttactgcatgtttgacgcactttcaatgcagatccaaccactaaaaataaaatgaaaaaaaaaagtatttttatctcaaaagtaaaattttcattcaattttcaaacatgcactcaatatatgtttgacacttagtgtatgtttgaaaaaccagtgctaagacactgatcgtactttggatcgaaaagtacgtccttctttacttttgaaaacgtaagttggactgtgcttaccggcaacccaaacacctctttaattagccatggtaaagtcattataggaaagagttcggagatctctgcaatgcaatgtaatgtgtgtacacgaataattaaagaagaatttggtctataaacgttggagaaatattgtttatatgctattgttaatttgttattacttgttaagagagtttgacctgactcacctctatgcatgtggcactaaaaaatttaaaggatgagattgagcaattcatttttctaaaaaaaattgaaaaaccttttcctttacctgcaactacgcttttctctctttacagtgaattaattaagatagaaaaaactgcgatcaattaactgcacgcataagtgggttttatgagtgatggttttgtttttggtacgttgaagcccaaatttacataattgatgttaatttgaacagatgtcagacgcgttaatcaaggggtcaatttggatctattaaaaaaaatgagatcacagcttgcaactatctcatctagcaattttgccatggataactctatctattcatttgtcgtgtaagagtagattttttaagaatcaagtcatttttttttttgccaaacaacctcggtatattggattaattttgacattgttgaagtaaaaaagtatatctaagtttaaagacatttgtctgaactatttaggatgggattatttaatctcgtttttatttcaagagtttagatacgaatttagtattcctctatagtatttttttttagtgacacgatatgatatagaaaaatatagattttatcaaataccaatttgtttggttttacaactaatcatattgtgtctttacttgataagaaaatgtgcctatctcttcatgaccatattatactagtattattatttaacaacatgaaagagtccaaatatgttaaaaaatccgttttggtcctgtttcagctgagatcaagatcgattattccaattcgttgaaacttgtatcaatgattttattttttttatttctccatttttttcaaacagtcatattccctcctctccagaaaaaaaaatgaaaacagaagaaaaaataaatgaatgaaagagaaattaggagaaagtagagagagatagaggggctggagagatctggaaagaatatgagccgaagaagttcaggtatgtaaaatctagtcatctaatcattattcattagatatgatattcgttaaatgttataataattatctttaaaatcataataatgatggtaatcatcagtgatattacatattaaactcataaagtagctaagaaaaagtttacaaatccttgcattgcaatgtgcacaaataatgaattaagaatttggtctatcaagttatggtcatgttagagaaaaaaacataatttttactgtcacatgtaatttagtgggtcttagaagtaatcattagtttttcttgataaagaatcgtctctttttattcatgaccatatttttttatttaacaagatgaaagaatccaaatttgtgaaacagttcatttggtactagatccctatctatgctaaggaaaccccaacttatggtgtgtttgtaagctttggtcatgttaaagtaatgctaataaaaaataaattaaatcaaaccatgtttagtaaaattaagttaatgaaggataaagtcagagaataagtgcataaccatctgcaattataatttcagggattcttattctggaagtggtaaaaggatctttcaattatggtgatcataggacaaccatttgattaggatcagcagagctttctatggcaggaactgactgcttattaagaatcatgaaaatatgcattgaactatatgaactacaacagaagcgaacaaccatcagttaagctagttgatcaaagagattaagacagtgttaagaagttggaagcatttttatctttcaaaatgaatctaaaaaatagtatgtctactcaaggaattaacgagcttcaggtaatatcacgtttactaacacacttgttctagtatgtctactcaggtactcagactctcagcaaaatgcaaattcaaatgaaaattttgtggacctattttcttctaaaatacaaattacatctaggcttcaataagttttgtcataggaaaggagtatttccaaatttgaacaaattcggcaactgaactaggtttcatctgattatgtaaaggatataggaacatatatataacgatctttagttgcattactttgcattttcatggacaaaattaccttcaactcttgctgagaaccactgtgggcttacaaacacaagaaatgcttctccaaatattcagttattattaaaggaagcaagcttattgataagcttaatgtttgtcatcacacatcatccacttttatctgtgcttaaatatcaaaatcctttctaattggaaaaaagaataccccagccccttaaagttgatattcttggaaaggaagaaaagaaaagttcaaatagtaacagtaaatcatcctttcgtgcatttagttggatttttgttgaagatgcagaaaagggcagggcaagaccgatcatgctatgaatagactttgatctaccgatgaataatctgctgaatcataaaagtggctagggacttcagcaataagccttggatcataatactctgacatatctatattctgcaggccaaaattcatgttgtagcattcagtttgtagcaaaaagaaattcaggtcctcctccaaaggtgcagaagctgcctcaccacccaataataggtttctttggtaaaaatccagatcagaaatgcaatctagattaaatccctgagccttcaagctcaagtttgaggtgaaagtgggctctgaagattgatcattcaccataaggcttttgatttgactaggaaaggcttcaactgcagatcctattgaactcacaggactcacataatcactcttgaaaccagcatacaacggtttggtctctaatttggcagcaacctcttcttctgttatagaggcaatggaattaattgcggcaattgattgtgactgatcaacctgaatgtgatgctgtgtaacattaccatgcaatggcaactggctgaggctatcctctaactgaacaagtgtcttctgttcttctttgagtggcccttttggaaactcactccaagagtactgtgttggtatggtgcaatcaaagactgcatggtttgcttctgatgactctacagatgtaaaaggttgattgaggctcttctgtgaacttttttgtatcttggggtcaggaatgtcactagtggaacctcttcttttttctgttgtaggctctgacacaactcccttgagattaccttcatgacttgtggcatccatctgaagtagtaaagttccatctgaataactgaagctatcaatggcaacatcattttgttgcttgtttgcagtgccaagaatactaaaacttcctggatcttttgaaggtgaatccgaatgctttattctacctgaggaagatttctgatcattctccttttgcaacctactcaagtagagcctgtatttctgcaggacaatttttttcttatcaaggaaccccatgaatttcaaagttaaaagaccactaaacagtttttcctcccctatttctctttcttcacatttaattttatgagagggtcagcatctatgttgtaatatttctgaatctaacaaacatatactattttactcagaggaagggagaagaagaaaataaattcttccaaactttatagtggcagcaaaagttggagaggggagtttccttcccctcccctccaaacttctaaaccaaacaaggaaattttatcaaaatctctcccttaccttcccttttatttctcttccaaccacacagtatcttagaatgaacctacgtaatgattcaaggtctaacagaaacagcaaatcagaaatgatcactcacaatatggagtaataagatgcccagatgtttattgaaataaaggttatgactgaagtgtcctatttggcagtctttcaatcataatagttgaggactgttaatatagtatcacttaagcaatgcatatgagttagtgatatacctgcaagtgactagcaacattttctctagtcaaccacggaacattcatcagatctagaattttcttgggaccaacttctgccaaaaagaaattatgttatattcttgtacgtagaagataagagggttaacattaacaaaaagagtatgatcacaattcacaattatactttgtagggaaggttgataggaaacttactatcaaatccaatttgattcactgctttgacaaacttctgatgaagatccacagaccaaactactctggctttcttcatgggagaatgatctccaaattctttgtcatcatgtttgttatctgcatcttttcttttcttaattgaggtaatttcttctacagaaaacaggttaccatcatcagagtgatctgatccatttctcattaagtgaatgccctcgaagtcaaaaccctcgtgactttcaaaatctcttgcctcatgcatcctttttctaaagacatgttgccatatgtttcgcagttctttcatccttataggcttaaggagataatcacatgctccatgttgaacacctttcatcaccctgcttgtttctccatcaacagacatcactggacaacattgccaagtgtgactggtcagcatggactttttaagtcattttgataaaaaaataaattatagtgatatcatttaaagaaaaagttgaatatattattaaaagagaactgactgataacaggaagatccatctcgagtccaacttgctccagaagtttgaaaccatccatgtcaggcatgttcacatcgctgatcactatgtcatatgcatctttcctttcacgaagttttttcagggcctctgttgctaaacaacatgtagtcactgaagcatataatagaaatgagtcagaaggaaacaattgttgtcataacaagagcatacgtaagagacacaagatgtgcttgcttccaaaatttgccaatttcatgaaaatttgctaacatgaacatagtaacaacaacagaaggaggatttcaatttggaagttactaaagacgtccactgaataaaaagcatgaagcacctccatcttattattgaattacatgtagcctcagtttcttgagctcaggcttttggatagtccaatccaatccaacttcatgaacagcttgagtgcttgactgacataacacttaagcaatggtttctaaatcattcactctctagaggtcacatcactgattggataatgtttcaagcggcatggggtttttatatgtcatatatagtatgtgcttgtaaatcagtttctactgcttaattgtggctagtcaagttaaaacattcgcttcacattggtaacttgggttcattaatatatcatcttacaagatacacataaaggtagcaattgagaagaaaccttatccttgatttccattctctaattaaggaggctaagtattgaatctcagctcaacttatccgtgcaagtaattgaacccaaagtgcaaagatgcataatgaaaaaaagtcaacacaaggcttaatttccccacctaccatttaaagacaggagatttcaaactcaactacagaggacagatgcttggtctttccacaattgtattgcacacacaagttttgcttgttcagattaattcagttacttgctagtattttataagaactaatctcaaatgccactacttgtgcacaactatcctctcactgacactaatgctgacacatggtaacacttaattaccaatggtaactatgtgagtaggaggtctaaattctaaaaccacaggaatcaaattcgacaagggcagttcatttttcccctctatggcttttcgtagtggcaatttgttgcttaaaacttcactgggaaccatatgttgccgaagcctcatggcaacagaaaaccccccaagttttgatacttttattataagtatataacacccttcaaccttaataagttttatcatccaaaattcccagcttttttctctttattgaaaactgaaaagaaaagcttcctactttgagaaacactaagtttaaaatcacaaagaaacaacttaaactgaccaaaacaaataagccaaaacgcatgcagccatcataatacaactcaacacgagcacatctcatcacacactcaaaattccgaacaaataaatcaaaaaccagaaaccaattatagaagatatatagaataaagcaacagtcatagtttagatttcaaagtcctttttttgggcaacaaaacaataccacaacagaagtaaaacaaaccaaccttcatataagcacttcttgagcatcttttcaaggatccgcaaccatgttggatcatcatcaacaacaagaactcgcaaaccagctggaaaagcatcgtggcgtggagaagagaagcaaccattgtccatgttagttagagagaagagtcctatggatcactgcttgtgagttcaagagaaaaatggggttggcttgattgggttttaattaaaatttaaggtgaagggaatatatgtatatttatatatgtatatattttcatgcactgtgacaaaaagcactaacgaatattaacggtcccagtggcgcatgttatggtcttccaatctttgtgctgaaaagaatagtactatacttggaacaaggaagttgttttgagtaacaaggagtaaagacataaaaaaaaaagcatggtgaggatgagattaaattttatgaaaagatggcaaatttaatgtacaaagatgatgagaattagaagaaaatattggggtggtttttgctttgccatactaatattaaaaataaacaaaaaagttagatgacaagattgttcaattgaaaataaagtatgttttattagcggatatggtttttctgcaaactgtatatataataaggtctattctaattttcaagaagtaagtttataatatttataatagctaacgggttggtttctgtttctttacatatttgttaatgaggttgaagtgggtgatatacggtttaaattgcaagagcaagaacaaaacaagtatcaagccgtattctttatgaaaaaagatgtttggagataggaatttatcagaaaaggggacaagaaatatacataaagagaacatcacctctatgttgtctgcttagtagtatctttgtgaaaaggaaaaataagaagatgaaccgttgtggaaaggcacgtggaatgcattctagagacaagagaatatggttagacaagccaatacattaattggaacccaaactaacatgatcagtttatatttaagtttctttaatataatttatttttatgaacacttgcaaaagtaatttataatttaggaaaggtaatcagaataattttcaaaaaatgtaggagttattttagggttcccccctcataaactaaaatttgaagttgatgaaaataagtcatcatcgaaaaaaataataatagtgtaattgtgcgtttaaatttttttgatctacttttaactgtggtcagttttcaaaattcacagcttaaggtgtaaaagaacaaagtgtaatttgtttcggtaaatatttaatgggattttgaggtctaaaaaaaatatgagtaaaggaagaaccaattttaaacaaagagaagtatttagaattttataaactacaatgaaataaaacttatgaaacataccatgagattataattcagaaggtgattgagcataaataaaaagataagtaatgtttaaataaataaacggctaaatattttcttaagatattataattcataattaacataattatgataaatttaaattcaaatagtatgttattttaagcaaatgcaatcacagaaatgagcaaatgaagcatccgccaaccccatttaattggacaaatattaatgcccttcttagccaatttgcttaccacatgcattcaaattctccatacttgagattcccccccaatatatgttcttctaatagaataatcaattaaaagttacccatttcttttaattaatagtatccaagcaacgaaattaataggagatggaacgagaataaaataattgagtcccctaatatcagtaactcaatgatttcggtccaaaaaccttaaaatatattaagtgggtgcatgaaaaccttttttttagtgtctgatgcccagtaagcccttataattcaaagcaactttatgtacttggaactttattttattgttaaatggtgcaattttatacgacatatatgtcttagcataagcatccaacattttcaggtttagaaacccatggtgttgtcaacgcgtaaatgatgatgagcttcaaaaagaaggcattctgattctaaccaagacaaaacacatcaaaacgcagagggacaaaacatcaatgtcagggcaagacacactaataagtaataacccaagtgaattgtttgtctccgcaccattggtgcgtgttttctccgttttgttgattattagtaacattttcaatctaaccacgtaaatatgacgaaatgaagattatagcacgcagcaaaaggggaaaaattaattaatagtcttaaatcatcacatataagtagttggttcgtccctaaaaaaaaaaaaaatggttcaagtaatatttgatctggtctctttaaattttgaaaagtcttatacataaaaaaaatgtggttaaaatgagaaatcttactaaaaagataattaattctcccatggagtcgagagaaaaaaagaacttcctataattgatagagattatttattaacaaaattagtggatattttgtgtcaatatcatgaatactaaaaaaatttatcactaatttataatcttaactcatttatatgtaatatgtcaatttttttaatttatacaaaataattaatagtngtaaagaataattagaactaaggttgctttttttttttttttaccaaagaactaaggttgctgtaaaaaaaatagaactatgatattctagactctctaacttttttttaactcctatgttgattccaaaccaaccgaagagccaaaccttatacttgatcatttgtaaaattaaaagtaaatgttatggtggaaacttaatcaccacaatgaaaaaaaaaggtgatgaccactaaccaggcaacaactactccttaaatgcaaataataaacatagtttggtaaaaataaaagggttgaagttgaaagtcaccatagagaattactaaatattaatggaggttgcactaaaacaaaccaaaataaaaatcaataggtatctaattatcccattgcattataatcaatagacccattacgtgctccataatgacataagatgatccaatcaacgtaaattaatagacccacaatatatattatatttacatatatattcctactaaaaaattgaaaagggaaaggggaaaaaacgaaagaaatagtgttacaacttacaactgttgcgtaccaacgtagggatggatagatagctctaatcacgttcattgatagaggccacgatccccctatcaatataacatttgaagggctgcgatagctccatttgcaacgcatatgaggcctaaaaggtggcatcttctttaaacctcttttaaacaatggtttatttgaatcaaatgccacttaagttccgtgatcaacagaagcaagagcaaagtgggcacttggtttttttttcctatccctttcttttcccatttattctctttcattttcttagtacaatataaaaagttttaagagaaggggacttgtcacattttaagaccatggcatactatatgccttaaagtttagagtaaataatgtatgtaatgatagtataaaacttcatctaatcataaatgaacataaatttatttacttttataataattattatcttaaaaatcatacaataattttctattgaataataatataaaaaatttacatttcatagaaataaaagtctaaagtttacaaaaataaaaagtccaataaaagctactaaattattttgatcttatgatataagctatctcttactcattcttttctttttgtccggggaaaagtttgttttggaggtttcactttcaggtttggggttaaaggttatacttttgttgagtgggatggagtacggaggggggtttagtgaaaaaggaaaaaggaaaagaagtgtagtaagcaaaaattgaatgaccctaaaaaggaaattcccactaagaaattctttatgataaggagagaattattttatataaagatagggtggtgaggcggcgaatgattggcaactcacaaaacacaaagtggatcaactccatgcaacttcagctaagtggaatagcttttcattagtttaattaatgcaaagttaagaaaatggttttgccttatattccccctctatacataatgcttcttcagttgctctttacctgtatattcttttcttatttgttttggaatttatttacttttcattgtgattttttttcactgttcttacttttaactgggagaatatgctgaataatgcaatgagcgacttcaattgggagaatatgcttgctcccaatcatttgagccacttgctttcacatattttctggtcctattgttatgccatagcagattttgatagttaaatacggagggtggggttgtgtcatgtgtatttaaatgtacttgaatgtattcaacaagaaagaaatgtgtgttttttttttaagggaaaaataagtgtacttgaatgtatgtacttttttttcctctcaaaaaatacatacttgaataatgtagtattggaacactgtgatccaagcacttatcatttgccgctttttctttttctttttcctgtggcaaagtggtgtagcaattcaatggatgccaaagcccaacaacatgcacatggctattattgggccttttgtgacaagagaaggcctgataaaaagaattttcttttgggttcggctctatagtctacttcactattttatttagaagaattttagctcgtaaagacagaaagaggttgttgctttctgcacaaaaaaattgcttccttcacttggaattagttacacttttgacaatcctgattgaccaatccaaaggcaagaaaaaaaaaacattaaaaaagatgcagaaaacaatttttgggtgcaagaagcaacagccaagaaataaaaacagcccaacaatctatccataaactcaatttgtgtaatgctcttatgctcataatacttgagtacttgaaatgtacatagtttgtgcaactaaattttacaactatcaaggtggtaagtacgtaaaccttatctttttgggatagctgtgagttcaaaatttagggggaaaattgttgggagatctcataatttgtacttttgtggagtctcataaatagtttaaaataaacaaaaactttaagaatacctattgtttcacaaacccgaaaaaaaagttaatgcacttgttagtactcttggctttgatggtaacttaataaggctgcagaattttaagaaaaatttttaaatttaataatttttaataattaaataaaaatactacattttttatattcttttaaaataataaaagttgatgtgtttatttaatattttttattaattattgagatgttattaaagcaatatcttataaaaatataataaatgttttatgtctttctgattgttaaaagtttaataactactattttttttttacaataaacatttgggagtccatcatgcattgttggataagatcgatcgagacatgaaagcagattaggtttggtttatcgtttggtaataaggtcgtggttagacatggtgattgtgtagtatataggcttaagcagtgaatttagggattgagaatgaagattgaacaacttatatttgagatataaactatttaattttcatttaaggattcccattcataaatgcgtgaatattaaatataaagaatacatttccttaatttagatagtgcttttgataacgatggatgattttttttttctctcttactcaggatgaaaaaagaagagagaaatttttctttgtcttaatcctctcattcatctaaaacttaattaaaccaaaattcaatcgaaatataagtaaaatttgattataaattattttcgttaaagatcaaatccaaatattatccaacaatacaatattaactagtgataaaaaaatttgaaacatcaaacaaatttttatacgtacttgattaagtttcaaactagtgacaaattgtacatgcattggaggatgtgaactttgtttagctgctaaatatgtgcagttattactacgttcatcaatactttttaaaagttatattattataacaataaaagctccactataccagcttcgctcccagacttgtttctgttatgtatgaaaaaaatattattattttttaaatcttgttatttttgttaaacttttatgaattattattgatgtttcattctttgttactagtgcaagtacaatatgccgccacatatgtaattagatggttcaagagttctcgatcagactgtgctaggagggacactaatggtacaacccattgtttcatctttcagagaaagagcaacaaaaagtgcaacaagagttgaaggcgaaggtggttgttgctcctgagcttgttgagtcccaagtatatctatttttgagtcatggcctgttggggccccttatcaaagagatgtagagaacgtgtttgtgttgagtcccatgggaatcatattacctcgtgttttttttttataaaaaaaagtttaataatcaaattcatcaaaatatgaaaatataagaactttaatcacgcttgaccaaaatataaaaactcaaaatccttttttttcttatttataagtacattatgcactttagcaatacaatgaactgtacacgttaatatgtaacttctcgaaacaataactttttttctttactgaataatactcatgtcattttatttataattaaagtcttaatacaaggaatagcatgatggaaattatactgactagacataaatagagtcatcctaattagtttatggacaacatcattaacttgtctagctcatttcaaaaccaataataacgattgcagaaacaaaaactcttaaaaattataaagaaacatatataaaaaaatactataaacttcaaaatacactgacatatgaataagttttttttattattcaatttttcaacattgttttgatactcacctcgtagatatcatctcttaagttctaactttgtatttttgttttgtctcgtattgcatgccaaaacttgcaatcctaggagtcagacggatgctgccatacgggaaataataaagaacaaactgaagtctgaagggctttcaattccttttctgatgtcaagttgcaattgaaaaacttggaacatgtcaatgtgaaatctgttacttggacaactggactgatgcagcgattcgagatggaccacactcttctagacttggtctgtcttgatgccaaaaggccatgttgggtagttttgaagaggataaatgagggtagtttaaacacacacacacacgctcagaatttgagtgcataaggtgaaaactgtaaatgaatatccaaaatggtaaaagatgaatgctccactacaaattcctaaattgaaagtatgaaaattgagaattttgagtattattgagttgttgggttctcccacctaaccaaatcttcagagttaatatgggttgagttgaacttttttttaccatttacttgtaaccccttgttttattcattcaatggtccaaacataaaaaagcacaagacaacatggcccaaagttacacagttaacacagattttgcggtctgaaaaagcacaaattgaagtaattacgtaatacctcctttttgcatcatttggctttggcctttcttttagcgtagtttaagcccttttcgactcataatatatttgtacctcgttaacattttcttgtatatatcatcaacttataatggtagtttcaaaattcaaattctgtgcaaaatattgttagaaattaataccattaatgtggcgcatggtggcatcaaagatacaacctattaccaacacgacatcgtatgtcttcttgttgtcccgaagccccaagacaaattgttaattgtttttaggagcttcttacaataaaaacaagtgcatgggtcgctttgtagcttgtgcttgttcctttcgtgtaacttctttttagaaaaataatagagaaaaagaaaaggtgaacctaaaatcttcttttgtaggaaaaagaggattccaacatcagaacagataaagacactaacgtgaatgaataatcaaacattcaacaaagtcatcgatccaaaaagttaaagttaattagtgggagaaagctggttatagttgagatgctctcaactcaaaacaaacagttaaattaatcaatcacttaaaattcttgtagcaaaattattattttctcttccttacatccatggatttatcttctttttttcttgttttaatccctctgttgacatcatttgctgtttgccaacttgaaggtgagtttcatatacttttcaattcaatttcagttggaggaaccataaaccatgattgctaaaactttctcttattctttttgaaccatcatgtcatgtaatgatacaaaacacaaactctaaacttcttcacttgcagaatttgttagcattgattgtggagggacaagtaattacactgataccagcacggggttggcatggatctcagattctgggatcatgcaacatggcatttcagtggaagtagaaagtccaaatggaagcatggtgcagtatcaaaagcgaagagactttcccatagacagcaagaagtactgttacacactaagcacagaagagagaagaagatatttggtgagagcaacgtttcagtatggaagcttggacagtggagacacttaccctcagtttcagctctacttggatgcaacaaaatgggctacagtgtcaatatatgatgcctcaaggatatatgttaaggaaatgatcatcagggcaccctcaaattctattgatgtttgcatgtgctgtgctactactggttctccttttatatctacccttgagttgcggcccttgaatctttcaatgtatgccacggattttgaggacaatttcttcttggaagttgctgcaagaataaactttggtgctccaactgaggatgctgtcaggtgtgaaagctcactttttttaatttttaaatttgatgttgcttttggcacataaatgaatgaagagaagactttccaaaattttccttcagagaataagcatcagtagaagtataaaaccttattgccttttcaaggaaaattgcagcatggttagcttgattgagaagaaccactaactaatgtgatgagtgatgacatgaatttggtttaacatttttaagcaaatgtgtttcttaggtacccgtatgacccgtatgatagaatttgggattctgatcttattaaaaggcaaaattatcttgttggagtggcaccaggcacagaaagaattagcacaacaaggaacatagatatagagacaagagaatacccgcctgttaaagttatgcaaactgcagttgttggcacaaaaggagtactcagctacagattgaacctggaagacttccctgccaatgctcgagcttatgcatatttcgcagagattgaagatttgggtcagaacgagagtcgaaaattcaaattaaagcaaccttatatagctgactatagcaatgcagtagttaacattgctgagaatgccaatgggagctacactttatatgaaccaagttacatgaatgtgactctggaatttgttttatcattctcctttgttatgaccccggattctactcgaggacctcttctaaatgcactggaaataagtaaatatgtacagattgcttcaaaaacagacaagcaagacagtaagttctgttagctttttttttttttgtgaaaatagacattttgtttcataatgcataagcattgatgctgagcaagatgaactgatttctaaccatactttcattttgcagcaactgttgtaaatgcatttcgattattgtctgctcaaagttcccagacaaacgaaggcgatccttgtgttccaactccctgggaatgggtgaattgtagtaccaccacgcctccaagaattactaaaatgtaacatcttcaatcacttttgttgacaattttgtttcatagcgagtgaattgtcattctttgaatcactaatctctgacacttttgaatacttaagaatattgaattccaaaatgcatcaaaagagtttgaataatagaatggcaaatgctgtctgttgggaataaaataggctgtggcatgatgaaagtcatgatcaaacatttcaaaaagttcactgaacattttgctatgctaaacatttattggaagttaaagttgaatatttttttactaattgctattgtttgtattagaattctttcgagaaggaatgtgaagggtgaaatcccacctgagcttagcaatatggaagcattgacagagctgtaagtacattgatcttcataatagaagtactcacagtttttctttaatgagatttctcttgtaatttgttctttgttacttaggtggttagatggcaacttgctaactggacagttacctgacatgagcaaacttataaatctaaagattgtgtaagttcttgagtttgacgcatgcccctccttgggttggagcgcaatcaaaacttcagctcatatttcaaatttattagtttttaaccccaaaaattcttctttctatgttttcctttttcttattttcatttcttaattgatgacatgcaggcatttagagaacaacaagttgacaggtcgactaccatcttacatgggtagtttgccaagcttacaggcattgtatgtagcacttaaatgtttctcatctctaatttcagcacttgaagtacttccctagttaacctgacttttcctaattgatattgttatcctcatatgtttattaatcacgcaacatctgtgaatttgtgacaggttcatacagaacaactcatttagcggggaaataccagctggattaatatctaaaaaaatcatttttaagtaagtatgctcagcaacagaacaattttcttacatattgttcatgtatatgcaattgctttaaacgctcactgatttggcttgacaatggaatcagttttaacataatagaacaaggatcttttcaactagtcttgtaccaagattgaagtaacagccatatttaatttctgttccagctttgatggtaatcctgaactatacagaggaaacaagaagcattttaagatggttgtgggaatttcaattggagtactggtgattctattaatattattcttagtaagtttggtactattgcttaatacacggagaaaggcgtctaaaaggaaacgtgaggaaaaaggttagccatccagtttaaatctaatgcttttgtttcaacttgattacaatcaaacttcttcaaccaagcagttttgtccccatcaggcatttctggacgcactaacagtaaacctggatactcatttcttcggggtggaaatttaatggatgaaaatactacttgctatattacactctcggatttgaaagaagctactgacaatttttcaaagaaaattggcaaaggaagctttggatctgtctactatgggaaaatgagagatggaaaagaaatagcagttaaaagtatgaatgaatcatcttgtcacgggaatcagcaatttgttaacgaggtagagttcaattttgtcccttcagcattttcaaatttgaattctgataggcaacaagttctgttgtgaataaattttatcttaggaagtgtatatcaaccaaaaagaaacgattccatgaatttcattagtataacattctccaaaataaaaatgcaaatacctcactgtcacaaccttcttgattccagctcatgcctaactgcagctgcattaaaacatggatttcttagattgctaaacgtaacaacagtaatacatgaaaaatcttaattttcagttatttgattatagagtcaaacatgcaggtggccctcctatccagaattcatcacagaaatttggttcccttgattggatattgtgaagaagaatgtcagcatattctggtttacgagtatatgcacaatggcactttacgggatcacattcatggtctaatggctaacctccaaccccgtatgcatttatttaattaatagaaaagtttatgtcctgacatatatttccaatgttatgacagagagtttcaagaagcagaagttggactggttagctcgtcttcgtattgcagaagatgcagccaaaggttgatcaatgactaccttcacggtccataagtagaattagtatggtctaatgtttgttagttcctataaatatgacaagttttcgttttagtccttcaaaaaaaatgttggtttattttattataaactttaaaagatttgaaaatgacttttatgtcacatatatttcagagtgattgctgatacaacatatctaatctaaatgtatgtcacgttatgacaaaataataataataggccatttatttgatgaagaatagtattaaaactaaaatttgacatatttgaaagaattaaaaacacttaaattgtaaagtgttttacctccaagttaaaacagatgaagaacaaattccaatttctacaggtctggaatacctacacacaggatgcaatcctagtatcattcaccgtgacataaagacaggaaatattctcctagacatcaatatgagagcaaaagtatcagactttggactctccagattagctgaagaagatttaacccatatatctagcattgcacgaggaactgtaggctacttggatcctgagtaagtcatgggtctcatgtgtgtcttttcccttgaatgtgtgaaattcagtttatatttgttctttacaaattacaggtactatgcaagtcagcaattgacagaaaagagtgatgtgtacagttttggagttgttctgctagaactgatttctggaaaaaagcccgtgtcatctgaagattacggtgacgaaatgaacattgttcactgggtatgtttccttttcactaaccacaagatgaaacattggcatcattaaaggatgttaaacaagaactaaacacgaacatgtacaatatcgtacatcaaatgcaattaattctgccaggagcccaggagtatattgcaaaattttaacacacttaagttcaactaaccatatcttaaaaattctgttgtagacttaatggtaaatcagcattaaaatcttactagtttaaaaagcattgttttgcaggcaagatccttaactcgtaaaggagatgcaatgagcatcattgacccttctctagaagggaatgccaaaaccgagtccatttggagaatggttgaaattgccatgcaatgtgtagaacaacatggtgcctccaggccaaggatgcaagaaattattttggctattcaagatgctatcaagattgaaaaaggaacagaaaataagctaaagtcatcatcatcattttcaggtagtagtagctcaaagccacattcttcccggaaaactttactcacaagctttctagaaattgagagccctgacgtgtcaaatggttgtcttccatcagcaagataaataaattggacatgcctttcattccatgtgttgattttgtttctatatttacttctttttaaccattattattctaccaatatgtacttttcaccagtaacagtgtgaccctgactagtgacaacattccaaattttggaaccaattgttatcttcttccagatttttcttttgtttaacatgctaattgtaaattggaatggaaaactaacactactagaaaaacaacattcaacatcgatttttaaccagtattaagaccggcgatgttgaaattttggaagttaacatcggttttcaaaaatcgatgttaacaacaagtatacaacatcgatttttagtaataatcgatgttgctatataagaaataaaaggtaaaaaatgtaaaatctgaaacttcaacatcgatttttgttaaaaatcgatgttaacttatttgacaatattgattttctaaagaaaatcgatgttgatgtgatgtaacaacatcggttttcagagaaaaaccaatgttgttacatgaccacaacatcagttttgtccctatatatgtaacaacatcgattttcattagaatactaatgttgttacatacataaggacatcggttttcaatgaaaatcgatgtcgtagtgtaagttaatatcaattttgactgaaaatcgatgttatagtgtaagttaacatcgattttgacgaaaatcgatgttatttttttaattttttttaatattttgttttttatattacccaaattcatcctacaaatgaaataccagacatccagtcacaatttcagaatacaatacaattaaataaaatttgaataacaaataaaattcaatagtatcaatgtacataaaatgattttctaactaagtgtttatacaattgtttaaaaatcccttaaccacctaacctaatatttcatctctaactttaagataaaatgtagtccactgaaccctaataaccttcaatctctcggcttccagtggtctttcatcaataaaatactgcatgacataataaaacataatttaataagtataaatataaaaagtagaaaaaataaaattagttttgaattagataattatcatatcccagttatccctaaagtttccttggactatcgtcaacatccaatgcatgacataatagtcacactcagtgcttcctttttgcttattacactaaattaaataacatatggtcaaagttaaacaaaaattagagtaaatagtaataaaaattattttgaatacataaaccattatttattaaaagacttactttaagcgcaattcagttagtagtagcttttgatttatttcctcgagagtcatagactcccttcaaagcatgcttaagagaaacatacatgcatattgtacaattaacacattcatgtgttagaaataataacagaaatgtcttacaaattacaacctgcctgttattaggcttgttatgcaacgaacgaaaccacacgacaacattaaccctaggacatataacgaccaattactaatgtgcattgcattggagagaaaaaagtcattatactgtatacattatgcatccatttcttaatatagtcctcgcattcaagtatcctatttttgtagtaatgtagatttatatgaaatatcatacctttaatatatatatattacatttattaaatataatgttattaagtttaattatatattatctttattaattactttaattaatactatattagacatatttttatttgtttatttatgtaagtactgcactaataaaatcaaatacggcattaaaactttttatatctaatttactatataaacatcactatagatagattaattatagctagactaattatctttattatccagaatcttcagattttatcgtattttgatgaattgtgcatctatgctcacctaatcataataaaaacataagatgaataataatgtaaaaaataattgccagattgtctaaaatattcaactatatgcttcaaaggtgataacatattgttttctattgaggagccacacatatgtgaatcccataaggaaatcagaataagatacatgatttaaaaagctataaaaacaagaatacattttttcttcaacttcaacccgtttacaaaacctcgttgaactccataatattttttaacgaaattatattgtactttaaatcgacacctaatgtgttacgtgtgcaatatcttaattagtgatagtttgactgtcattatgcattccctctctcattacaatttttttataaaaaaaaatctgattcaattggtggaagggggagcagagagaactgctgattattatgaagaaatttcttactataaattaaataatgaatgagtagggtgtgttttggtataataaaaaataacaattaaaaatttattaaaattaatgtaaggaatctatgataagacaataatctaaatcaaactctatgaaggtaaacgtctaagcttggcaacttgaaacaagaaatcctacaaataccctttccttttttataatacctactcaccacacgatcagatatgctgaggagagagaaagcgatagccagcaaaatattttttaagtaaaaaataaaaataaataaataaaatatttttttttaaaaaaaacttggtgaataaataacttctaaattattcagaaaaaaaacccttcttaattggtccttgtaaagttgtaagatggagatattttgattttctattctcattatacattttttttatttcattgtgacccttatgttaggttttgtgacttttgagtttgtcatgttaaaaacatgggaaattttttttaaccactgtatcaatttatcttaaaatcaatagttaatattcttttaaatttttcttttcttttttctttctttttccaatttttgtctctcttatatttttttcttttcttttctctttgaacattgttgttagcgtcattaccaccatcaaccatcaatactagaattataacaaatgcaaaactataaaggggaaggagacggtctacgacaatgtatttatgtttagctttggtgatggagtttgttgtgggatttgcctttggttttgcaattggccacgatgggttttgtggtggatttattgtgattcatagtagattttgcgatggttaagagaatctgattttaaggatggtaaagtagatcagtccatccaaacaggattggacttatccacttttggaaaataggctagaaatactagctcgtttcactttaaggtggaccagcgggctagtccacataaaaaaataaaaataataattaaaaaaaccaaaaaattattaaaaaaatacaaatgtaattaatttatgctagattaatacattaagttaaatttagcaaagcaagtagcaacattcatacattaaatttaaaatttgctaaaaacaagttagaaacattacaacttccaaaatgcaaaataattaaattgaagaagtagttgcatctaatcatcttgagtagttattgtatttgatcccttggaaacagttggattcatatttaaagcacaaaagtcatcctcatcatcttcatctataaatcataatcaaaaaataaaaatagctaatgaataataatgatttaaaataaaattaattggcaatttaaattgtaaaataatgaaattaaaaaaactatcattttcagcaaaaccatgcaatcaaggcttcgacattttctgacaagagacgatttctatacttgtttataacatgtgatccaatgttaaaagtagattcagaagtcaatgtaataataaaaatgttcaacacatcactagccattatggataattatggaaagtgattataattatccctccaccattgcaacacatccaactcttcatagtgcacaaaatccaagtttggctcattcagataaataataagttgtgaccttccaactttagaagcaagttgactactatgcattttcaatttctattatatatgacaagttgaacacaaaaaaattaaataaaatcaacgaagtagacaacacgaaaaagtaaatattatataataacataataataataattcataagcatgtatttataccaaacattctttgatttattcccttgagttcctttgacatggttgaagaactagtatgggttcttatgtcaagattgtgaataaagacagcgttattaatgtttcttgggtttgaatacctctcaaagaccatgtataactttgttcacacatgttgaatcttttcctcacttgtagattcatcagttgttaagtaacaataactcaatgaagtaaacttaatatgtgggtcaagaactgctccaaatgcaagaatgatgctataatgatcccagtatttcttaaacttcatcatcatcatttcccccatactccttataacctcatcttgactttgtaaactcttagtaagaacatgctgaattttccaaaacttgcaagaaatataggttggaagtaggatatgaagtgtctgaaatcaattttgtagactgattttgctcctgtttgcaaggatcctccgtattgtctccatcattgcatttgttcaattgcaattcaacacgccacaagaagacaaaattgtgcgtgagatctaagcaacaataggagttgttcatatttgggtttgaaatgtggataagtagtgtaatttggactgaatatctaatttggtttggaaaatggatttgcatatccgaagaagaaaggaaaaaaggaagagagaaagcaagaaagaggctaggaagaagatgaaggccaagtgaggagtaaaaaaaaaaagattctcaaaataaaaagtacaaataatgtgtaaaatattgctagtgtttaaacgagagggtgagaagaatgagacaacaacagtctcattttataattgatgtatgttttttttatttataatataaaaatatatcaattatatgattttgtcattgtgtaatgaatttttttatttaactatagattttgttatataaaaatatagggtatcttgttaaataacttaaggtcacgctgaaggtggctgttccttttcgattttctgttttaaaatgtaattttgaaacagaatcgtgtccgacaaatatgaggctgaattagttttctacatcttttcaaaacagattttatcccatatgaccccatttgagaaacatagcaaaatttgatttaatggttattgtttttgtttatacaacctcacacttcttccttcacgccccttcacctccatcgccctttgtcgtctcgccgtatcctgactccggttagctaccagaggcggaggcggcggagtcggaccttaggccgccaccagcagcgacgacgtcattggtaattacaacttcgcttgcatcctcgctgcccaccaccattgcaccaccaccagcctccccttcacatacccaaacagcagtgaagtaggtggcgatcatgaagttgcagaggaaggtgtcgcgggtgcgggtgaggtcgaagatgcggcgcgcgtggccttagcactgtacggaatcgaaatcgcactgttccgcacccgcaactcccactctccctttatcttcttcaaacccattccattcccgccgccgcagaaaccctaccctccgtcgaccacccctagctggaatgggtctccttcgtcgaccacttgaacaccaaaggctacctttccaccacttttagttattttctatttcgcaaccggatttcaaaatcaaaggttttcaaactaaaccgaatttgattttcaaatgtcttaaaactgaaaacagaataccattattatctttcttcttcttaaaaaaaaaaaaaaacttaattatctttattttttggaacatcaataattttttaattaatttgctgtaaaaaacaaacacaacatatactctctttatttagattttttttagataaacacaacaaatactcttggtaaatattttaacttttattctcttaatcaactgcttatagcaatttccctgagtacctaatcactgctaaggtaggacgaatcgtctcattaaaagtttacatgcctagtatttttctttctttctcaaacaatatataataagactttggacaatttttttgcctccaacaaaaaatacacacaaaatttacgtatatactaatatctatccatatagatacagtacaggacccttttgattcctttccctctacaaagagacaaaacctgaattaattaacaagaaaacagtgtttgcgtgagccagcacagtagtaaatatgatcacactcgtgttgtctcatgactcatgactcatctcggtctcattacatctatgactcagcattccacataacactatcatagatacaccagttttagggtgggaaagttacgcatatttttcatcatggaaaagtttttttttaagcccttggattttttatactttaatctaatggttacgtatttttcatgattttctttttttcttcctctttccttattcccttctttcttctcttagaggctgcagaccatgacgccgttgctaaactcgattttccggcgacacctgagttcctcttacatctgttgttcctccttcgcggttgagtctgtcattgttataaatttcgtagggacaagggagggctattttgggaaaaaaggagttaaaaaacaaaaagaaaaaacaaataataaaaagaatctgaaccattaatttagaagcagaaagatctaatggtccaataaaacttccccatagtggaaacatgttttaagttttccaccctagaactggtctcatagaaaacaacgaaacgcaacatcgtaatacggcattccgcttccgttcattgtttcttccttccctcgactcaactctctctcacccaccacaaaactacgaaaacaaactaacaaggaaaaaccttctttttttttttttctcttttttgttccctcatcctcatctattggattaactgattaatattatttggcccccttctaaaaagaagattcttcatccttccacacacacaccccacaactactgggagagaaaaaaggaaggaagttttgttcttttctgagacccttttgattttttatattttttctgctctgaagaagaaagatggaaatgatggcataccatttttcccggctaccttactcggattccctcaaactgctagaggccgatatacagcatgcaaatgctttgttagtttcatttctctctctctctcttcatcttaacaacttatccatcactttcgctcttcttatgtatagtttttttttatgaaaattgaaaaaaaaaaggaaaaaaggtttttttttttttttttgtagagaatgggttttgacttgattaaaggctctaggacttgaaatggggtgtcataatcacttgataagcatctgcctgttactgattgagattgatcatctttaattgctttctagtggttgataaagtgggaaacttttgtgctttttagttgaatttgtgctcagactggaatttggtggtaaatttgattgtgaaattctttgtttgggactatgaaatataatgtgtatgtttttttttctttttctttttttgtgttgtgcatcctctgaatttgaatactgggtgtgtgctctctagggctgctgcaattcccagagccaagggtgggactcttctccaaatgaaattggtgtacaaccacttggctcctctctttctgttgttgctacagtggatggagtgttcttgtacatgctttctacacagatatcttgacctcttccacatagttgtatataaggtaaatccctagatggatagaaatttctagtttgtgatacataaaaagttatattttggtctctggtgctaacactagactagcatttctagcactataaaactttctgatggtgataaactgcaactaaaatttacaactttcttgtgtagagactacaatttaaaatgaggacaattatagggaccaagtgaaaagtttaacaaaccttcttgtgataagcttttgattcaacaattttggttttgacccttgtttttctcattattgttgttgttggtccccttttttttttaccaaaggtacacaatgatggtagatcaaatatgacttctcatggaaggaaagcaagcatccgggacttttatggtgcgtgaatctttgactctcaaaaagcaacttttattttagttattccaccctaaaaaataaagtgctatatttgtggctgcctttatttattattcctcactgttttttggggttaaatattgtactttagccgttatccttccatctctcgagcggcttcatggtagcttggagaagttgaacatttgtaagaaaggtcattctagaacagatggctcaagttatggcaagaaaatgattgaaggtgatgagaaactaatcaatatcgatttggaaagagaagatgaatgtgggatatgcttagagccttgcaccaaaatggttttgcctaattgctgtcatgccatgtgtatcaaatgctaccacaagtggtatgtattcatattaaacatgcacatttagtcgtctaactgcatgttcaaattgttctatcattattttttttgtgtgtacaatggttgcactaggttcgagccttagatcttatgcaaactacccaaactctccaccactagccgaccctagtgattctagtttatcatcatttgtaacacccttatgctgaatctttccaacctgcaggaatacacggtcagaatcgtgccctttttgccgtggtagcttaaggagagttaattctgaggatctatgggtactcacttgtaatgaagatgttgttgatgctgaaacagtttccaaagaggacttgttgcgtttctacctttatatcaacagcttacctaaagatcaccctgatgcacttttcttaatgtattatgaatacctgatttgatgttatttttactaaatgagagaaaaattgtacagatagggaaatccggactgcaattgtgaatagtctggtaagaaatatttctgatttgtaaggcacagctctgctaagataaatttctgttattctagcccagaataaccccactcttgccttgttatatatcgattactattactattccaatttactttgaactagttgtttgagtcacggtaacaaaatttttcttcagattcaatgatctctaactaaagctttctaactagctaattcagatttaatccactagcctattagacatgagtgtttttacttagttgaaaaagaatgatgttgactatgtggatcaatgggaaacatttgttatttttagactaaaaggtgcatatcaatatatcttgttaaggttaatgataatcaaatttttagttaacaaggtgtacatatttgattgacagattaatagcttgtattcttctcatataatgtgttgttagtttgttacatgcaacatttggtgtgtaagtaacattttttgaaatgctagaagtatgcatattataagacaaatgacgaatatgcataatcgcttaactatatgtaatttatatgatgatatgaatttacaggagtaggtatgaatggatagattttgaaaatattacctgttatgtgtatatgttttaaaatatgataagtagtgttttaaaatatgactttaaaattgtaatttttattataaaaatattgcaatcatgactcaaaatacgactttaaatattttatatttaaaaaaatattaaaatttgtgttttgaatcatgatttcaacttcatgttttataaatttgtctagcattcccacttaaatttagctaaagttcaaggataaaattaattaagtagnnnnnnnnnnctgctaagataaatttctgttattctagcccagaataaccccactcttgccttgttatatatcgattactattactattccaatttactttgaactagttgtttgagtcacggtaacaaaatttttcttcagattcaatgatctctaactaaagctttctaactagctaattcagatttaatccactagcctattagacatgagtgtttttacttagttgaaaaagaatgatgttgactatgtggatcaatgggaaacatttgttatttttagactaaaaggtgcatatcaatatatcttgttaaggttaatgataatcaaatttttagttaacaaggtgtacatatttgattgacagattaatagcttgtattcttctcatataatgtgttgttagtttgttacatgcaacatttggtgtgtaagtaacattttttgaaatgctagaagtatgcatattataagacaaatgacgaatatgcataatcgcttaactatatgtaatttatatgatgatatgaatttacaggagtaggtatgaatggatagattttgaaaatattacctgttatgtgtatatgttttaaaatatgataagtagtgttttaaaatatgactttaaaattgtaatttttattataaaaatattgcaatcatgactcaaaatacgactttaaatattttatatttaaaaaaatattaaaatttgtgttttgaatcatgatttcaacttcatgttttataaatttgtctagcattcccacttaaatttagctaaagttcaaggataaaattaattaagtagactgattcatgagttttttctttttcaatatgtaaaatttgtataccatcacaggctgtgtcctagtttggcttcttttggaaagtataacattgacaatgattctagacttgcatttgttcaaacacatttctattttttacaacctctttcacctacccatttttttaaggatacaaatcatctaccatttttatccctttcacttaacccttattaattattttcacgcaaggacaaaaaactacgtctattttaacgagtgatgttaacttttataggaacttgctccctaattttatggcttcaacgtaagctatttctctttagagaataataatatatagatacgattatacatcaaatatcttattaatatatattattttattttaactctccttattatattatattattacttattataccactaatgcaagttgagtctagtaaatgaaattaatctcttgtaatagagaaattattaggtgatcttaaacaatcataattcctattaatttttatataacatttaatcaagtattgttaattttttattgaaaaaattgtaaaatctaaatgtattatataaacatcgattgagacaatgaccattgatcaagtggtggttcgagaataatttttcatcacaatataacaaattaaagttttaataaggtgtccatatttaatctttgaagcgagatacactaggggggaaaacataatactcttgctcccaatttcaagaatcgatacactaatggaattgataatcgatccataatttgaccaagaaattgatatttgttttttatgcattccaaagaaaaacaaacaccaactacaacgttcgaaactactcccacgaaattagcaaggagattgcttcttcttttttgtttttaggttgcttcttaattttaaatagttgacattgcactccatcgaatattaatcattggattcaattttaaattatctgatgacaagttgtaacaaatttaattgtactcataactgtttagaatttgcaaagaagtcaaacacctgtagattcaaaaaaaaaagtcaaacacaagctgattttacaaagcaatcttgacgtttaaaagcaggttttatgaagcaaacctgagtacgctaaaaaaaaacttaatttcttcacctcaccactatctcagtcctgtgactatgcgcaattgcataaataaaacgtttgattaagaaagataagcgataataaaatccattgannnnnnnnnnnnnnnnnnnnnnnnnnnnncaaaaaaaaaaaaaaaaaaaagagggaaatataattgacatgtgttcgcacttcacgcacgcccaaaacaattgcaatgtgcttcccttttcttcttccaagcttttacccccagttgagagttttgatccctgaaatgcggaaaatgatgattggggttttggtacaatttgcttgattatgctaaggtagtggaaaaccaaatgatgattggggttttcggtataaattttgtggcactgccttttacaaatgaatgaacctctacgcagaatcggaaatagctacccagagttcaattacttgtagtccagattaactagttaaaccaataatttaaactcagcagcatggatatcaacataaggtaccgacttgaatgaaggtctcaaatctagtcacttgtgatgccaaaaatatattttacttacaggatttattttaacttgcagatcaatttgcaaaatacatgaaaattgaataatatgtgtaattggaaattttaatatcaaattcatttacagttgttaataaaattctttttcacgcaattatcaccatttttgggttgaaaatcagttatattttatagttttcattaaatgaatctaataggataaattataaaatgatgactatttcaaaaggagcaacttgacccataaaaaataaaagatcaaaataattttttataatatgaaggatgaaaataaatcttaaaaataaaataaatcctagttttttttatatataaaaatttatcctcgttttagggactcattttccgtccctcttttttttttttttttaagtattaaattttaaaaaggtaaagacaacctccaaacctgaactcatacctaaaaaaatgaaatactgggaacgtgttgtgtgttcccagatcaaaatcttgttttggttcaaaatgggcaaacaataactttacattattatctcaatccctatctctctctctctctctctgctttgctctaaggtattttctcttgttcattttcagggctatgtttggccaagggtaatacatcggatctacatccgttgtttgccccttgttttcaattcactctgaacgtgtaaagttttaaactttattagataatcatgcatttgggtattggagtggatttgtttttttatgtttttgtatgggaaagccattttctcggatgggcttattgtctgagatagtttgcggcatgcttttacatatattgtgtatgtgttagataagatactgcaatcccagattttgttgagagtgtacaacttcagtgcttagaaacttcctcagttgttcattttttttcaggcagtaacttccaatgagtggcggatgtatttgttgattgtaattggtagatgcatttgaggtgcattttgtgaggtcatgtgaaagatggatcttgaaggcaaaaaatttgggaggggtaagaacttgacatgtagattattgattgtttgcttctctttttttattgctgatgcaaatgtgctactagataactatatgttcttagaagtggactttgtgattactgaatagttgaacaggaaacactgtgaaaacatatgcaatataataattcacagaatgcaaattagatttcttttgagtggactgttaaaaacaaaagattggtagttatcagagctttctttaccacagaaattgtttacagtagaactttcttgatgtcttggttcactgtttattggagccacacgaacagagaatttcgtgaggtttaaagtcagtgatatagcaaatggagcttactggacctaatgatcatgagatggtcatttataaaaatcctgttgagggctcgctctaacatttaaaagtgctaattccccacctttcttttggcattagttcattgatgactagataacattgtgttcgggctctatcatgtatgttaatttattatttactatcctcagtggattatttgataaactagtgcccaatgccaatattcatttttcttattactacgtgcatgtggccatatttgtaaaagcaagtatgagtgaactgattgttctttcttttctactaaaaacttaagaaatgttcaattgattgttatgattaaatcttgaatgtcaattcccagttctcccattatcttttaaaattaaagaaaaactgttagtgcaggtatttccatgtcttatgtttgggatgtaattatcttcaggcaaataactctctgttaatgttgatacagaggttaagattactaattcattattacgccattagacatattttgtctgttgttaatattttttttttctttcttgagggggagctaaatcatgtatggaaacaggccatcttagaaacagaattagataattaggtaaatatccatagatatgtgtttttatgctgaatcttttgacttgcagatctattttaacttgtttcctagagagtgttctgtctctagtgctctcatattgtgtttttagatagaaaaataaatatgctctcctagatggctagaattggaatgatttgaatttcattatgaacttatgtttgttaatttataataaaattgtattatgacttatgttgagttgtgttatagacttatgaactatgttgagttgtgtgttatgttatgtattgtattgtatttggatcttatgattatggtttttcaacttaagcttgtttaatgttgtgttttagaggttattttctttatctatgttgtttttatgtgtgtgtgtgtgtgtgtatgtgtaattttgcattttaggtattgtcttatgatcctctacttaaaagttttcaccccccttatgatcctatagaatctcatgtttaacaacattgtgtaattgtaactgaaacccttcttggcatggctctcactttctgcagtgatttacctatttaccaaggtgaaaagcttttcctctctcaatccctttgagagtattgggcctctggggatgctcaattagagtattttgatcagatttattttttaaaataatcacatgcaatatcactatattatctgtcattaggtgcttctgattaatatctgtcagaacattgatttaaatggctcctcagtttcttttctttctttttgaaaacttgcaatcaatgcatcaaattcatttttcttaaagtatattttgcttagtaaggttatttcttggaatcaggcaatagagaacttggaggtactcgtgatctcataaatcagtatagactttggccctactatgaattcttctgcaagaagtcactcccagtgtcaatttcagagacacattatcttcacaatgtggtgggtgacacaaaaatcaggaagggagaaggaatggaactggatcagctctgtaaaaacatggacacgagtgagaaaaaaacttgcttatgtccttttgacttggatgtactaagtgaagctttccatatgagggatatgaatccagtccacctttcttctgtaagatttttctggctgcacatttgatcctattcttaaagaaaaccgaatagttcaaattcacatttgattgttgtgttaaaaagatgtgttgtgctgatgtgttatacactggccagaaggggctaccaaatgcagtgcccaaattagagaaccagtctagagatcatgagaggaagaacaaaaaggtcaaagataaaggtgagaaatataggaagcagaagcatagattacatcaagtaaataatggaagttgtatagagaacatcagaattagaccccatgatcctcatcccttgcagttgaagaaccaacaagacaaggtttgctcagtcctttatcccactcttctgtgtggtgtgttacgttaaattaaatgcaaaatttattatttacataaaatttgctgcctgtaaaataccaaatactagaagtgtggtattctataattttattgaccttgttttcgtaccatagctagtatatttcatattctgttttgaaagaggaatcggcatcagttattagcattaaccatattaagctaatacatgattttggtttgactaaaatattaacaagtcttgctattcatacaacaatttttttatccatctctctccattgcatcatttattacatctcgcatttctctctttctatcttagtcgtataattggctgtacaaataacatttctttattaacatattgttgaggttaccattttttattgtttaatttgtcaagttgtcaatttttaattatcgagatctgattatgagttattaaaccgtaatatgcaatattgttttgttcctttatgttttaaagtagtaaatgatatttatttgtgacttaaattgcactaaaacccaattttatctctatttaagtctttcagaaaaggagggcagagacaagcaacaatgacccttctgtttgcaagcgataagatactagaatgagagcaaatttgaattttttttttcgggaaatacgtgatctaattcagaaactgacagtgaactctgctttgtcacatttaacattttctgttatcttctactctaaatctcgttacatgtcttgattttttctatttggctcgcctaaatactgaatttctatagtggatggggtcagccaagggtgaggattaaatgaaccatggaaagtcaattttaagtgtatagtgcgggaacaaaagcatatcatgttctgcagtttgtttattaattaaattaaagcattatcattttctttctttctttctttttttaagttttgcctttttgttttatcactagtttttcctaggatttcaattgtatttttttattaaaacaattgatggtgttaatgtttttaaattggactgatcattaaattgagaaaagtattattccatgatttgtttgaccatctttggtagtagtaattatgtgtacattttattatatttaataccatatattataaactcaaaaaaattagaaaaaatgacttaccccaccgtcaatcaagaatttttacactgattaataacttctcattattgctaaattgagagttcttataagatatatcatatttatataatttttcactgattgaaaattatttttaatactttcttttatgtgtatgtaaatttttaaaagatttgaagcataattatagtaaggtattactggttctagtctttatataaaaaataaataaataatttaagaccaataaaactaggtaagttagtttaattaataaaatcaaatttaaatcttattccaaaaatattaataatggtaatatttaacgatattacacataatttaagggatgatattttttcaccaatgaatgtatttgtattgttaataggtcaataaatatattcacttgcataaagaatgaatgagaatctttcaaaataaattaaagatataaaaaattaacaaataatataattggatctatgttcttataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatttgtgacattggttaattcaattggtatttttttaatttgtaataataataatttattaactttactaaacctcttaaaagagagcacaagacgtgcgtttttaatatatattttagtctattcatttcttccaagacttcatatttctatttttataataaaatagttatttatttacggaaaaaaacaatttgtttaatggaaaaaaatgatttgctaaatggagatatgaacaacacaaaatgtaagttccttctcattattaagctgaaaaatcatttaaatttagtttatttttcctttctctgataatctgattatatatctttttnnnnnnnnnnnnnnnnnnnnnnnnnnnnnnnnnnnnnnnnnnnnnnnagaatgacaaaatcatgtgtgtgattgagttattttttcctgggaatatatattataattaataaattatctttattacaaaagttatcgttacataccaggcccatgtatttgacgattacaaaaattaaaagaagagcaagaattgcctattaaaaaaagtgcgttggaggtaaaggaaaaactattgcaaaatataggaacttgatagtaaatcaaattgtgggaatattgattgggcaagaatgaaatttgcgggatttttttttaaaaaattaagcacctatcatgaaggaacaatgagaaagtagttagatagtaattaataagagattatatatgaatttttactcatgaagaggtataccaatttcatgggaataatttttgctcccctcatgctgagactaaatattgatagaatatgagattatgtcttttcccaaaataaaatgttttataacctcgtaataaacatgggataatttttttccgatcattttttttagaattactacttagaaacaattcctatattatgtaagagaaatttataatgttaacttttaaaccatacaacatagacttaaacttttatttgttatatgctttaaactgtgatttactatacacaccagacgttaagtgtatattataagtctggtgtgtatagtgaatcacggtttaaagcatataacaaataaaaatttaagcaatgaaagtcatcttgtgttgcattacaaccactaatcagttggtaaaaggatttcagacaagacttaaaggactgcataagttaggttaatcaaacaagtataatctagatgcattcatctctaactcttaatgtcttacttttgcttataattgagttatatgcttctgcggttgtttgtttgaaatgttgcatttaaaaaaaaataaaaaattaaagactcaatacaaccccgcggtcttgagtccttgtgaaaatcaacttatacattttagtttttagagaagttaaataagcgttttaaaaaagtgcataccttaattttaatttgtaaaaaaagttgagttagtttacttttaaattttattctcctataaaggttgatagagaagttaatccaaacaataataacaagcttcgccaaaaaataaatgataactaacaatttacgtaaagtacaattcattattctaataaaggtttcagcaattgaaatccaaaataatcatttcaattttttccaccataggtcaaataagagattatcacctgtcattacatttctaatctactaaaatgttttttttttttttttnnnnnnnnnnnnnnnnnnnnnnnnnnnnnnnnnnnnnnnnnnnnnattcgtaataattaaaaaaattgaacgtataaattatatttggaactttaaagtggctataaaactacttttggtccatggagtcacaagttctgataaatctgttgtttaaaaagattggctcatagcctaacaacgaaacaccttggaaaaataaaacattaaaacaagttggggcattgagggtcatcataaaggaatctaacttctgctctaggtgatgctcgatccatctgcaacaaatcacattaaatacttaacaatacagatacatctaattgatttagaccatgaccaaccgtccaaccctgaaagtaagaatcttcaatgccggtgatcttgcaagcacaaaccgtatcaaatcaagtgcagtcttataggaagttttaactgtgattttcacatcttgaagctgattaaagtaacagttactgtagtcaaacaccttcgaaatctggtgtagctccactgccatgcaattgcactatgaaacaaagagaaagctaaatcaaaatatgacaattacaagaacaaactaagaagcataggtcttcttggtcacctttataataagtgtctctaggttagaagaacttccaagtaataaagaaatagtaaacaaaagttctcttgcttcattgaaatctacaccatccaatttcagatattttatagctttaagctgcacttgcggattatctgcctgcagacaaaatctatgcaaagaaaacaatgcaaaggtgagatatatttgaacacatccatctcaaaatacaagttcttagtataagacaaggcaccaaattaagaatgctggttcatgaaccaaaatgcaaccttgtttctcttcctgaacaacaaataaatgaataggataattttagaaaataaacaagggcaaccaagctaggaggtagaagaaatgtgacaactgtcaatttgtgatgagaatataaagcactcaatgcatgatgcatcattcattaacataatttatgatcgtcaaatgtttaaacgatatttagaggaatttgtgtagattttaaaaattgagtgaaagtgtatataattttcttagactgcaaagaaagtttatataggttttaaaaataaatgacaaatatgtaatatccttaaattttggaaaggtttgtgtaatttattctaaatattactatatgtgtttctacatgtgtgactatgaatttatttatcttaacattttattattatttaaaatgtaattactgcaaaatttaatatctctatatgttatatacatccattgccaacaactcgatattaacttataagaaaagaaataagattaaaaaaaatgagcttatctcgtgagttaaaattaatgcatatataagttaaaattagctttagaattagttaaataagagaaatgttaaaaaataatttatgtataaattaacgtcagcttataaaaaaaattgatttccaaagaagtaattaagtcaaagcggaaagtacaaataagtggtattcaaaagaatacataagcattatttaaaattaaatcctaatacacatgtaaagaacagtgctaactaaactcggtaagattgagcttttaagatatcatggtcttaggtacaatttctactactatactttcattgccataagccctaaaataaagataccttagccatgaaataaggtactctccctttccctcccctaaactttactaataaaaaatgtatattgcagttgtcaatttgtttggaatgactgtaagagcaatcaaactgttcaattgcaccaccatctaagtgaatgatcctagagatcctaggagggacactagatatgaagcaaggaaatacccacaaaatttaaccctcagacacaagtaccaaatggaagtagtctaaaactactgtgttttcatcctttccccctccccccagcccaaccacatagtagtgtatgatgcttcatctgatcatcatctcagttctttttttcccctctcttttggaaacattggtacaaaattctatttcttgtaaattgaattgtagcaccttttgttgtcattgtagttttctccagatattacctaggtggactaagatcagcacaagggcataaagaatacagagatacagtgacatgtcaaagaagcaaaattgttcgtgtggtcatctgaagttgcaacaacgagctcggcctctagacaatttgtcccaaagacagatcatctgccttggtgattggtaatgtgcagtgaagtagccctccatgcatccatactgacaaaacttccaattatgggagtactggactgctgccatggtattgttatatcgctcaacccacattcccatacttacatcctccattttaaacagctgccaaataatatacttcagtcacctataattttaattgatgtggcaacttggaaagggaaggggaggattgcaaaaggtaaaatacagataaaaatttaaaaggttaaccaacccttagtttcctatccttgtgttgagataggatgaaagtaacaatatcactagaaattacatatgcaggcccatttgcataaggaggatatacttcttctggccattcctgcaacaacaatgcacaacacctcagagaatggaacaagaacaatttacaacattctatgcattctccgtacttgccaacaaatatattttaaacaaccacaataaccaaggaaaagaatccaattacagaacagaaatataattatgaaacactgctgcatcctactacaaagtgtcaatcaaaactagcaatgtgttgcaccagtgcactggcacgttccagtaatatataaaacaactaaaatcatatttgcactcctatgcttactaactagaagtaattgtattgctaaatcttgagattttagcccaccctttaggaccctatttggacaaataaacatcacccacacaagtggtcatggcagcaaagcagttggtctagggtttctattctcccatgtttttaagaccctatgtaaggcaaaacaaactacactaacatgtgttgggggtgtaataggatataaagagaattataaccctaatatctacatactatatttaagctccaaggagagctgccaattgattgttaaaattaacaaacaaaagaaataaatgatacaaaattcatgtagtaactatcatacctcacaagtgactgcccatttgccatttctcagaggccgatgccgaagattgagattgcccatataaagggacttttcctggggtaccttctcaatttccttcaagacagtatcaacccttataaatgtatcatcatcacatttcataacatatgcagcagtcacattctgaatctgcataaatgaacgttaacttctttactctagagaacacaaaaaaaaaatataattaaaggaatcgggggtggcggggacagttttaagtggctgaaagaattgaactcaccccaaactcactaatggctacagttttaagcacaacaagctcatagcggtccataaagggcaaaatgacaatatcaccaaagtaagcagcctccttcttcaacactgcatttacttccgttcttggattctttaattggcacaaaaacagaaaatttagccatataatatcactacaaggaagacatgaaacaaaaatacacacaatgccatctaagaattccaaacaaacccaaaagggccaaaactaaaattttcatttgtacacttagattgcaattgcattctatttcaaacagacatttcaacatggaaatcaaacatcttaacgtatatttctgattctatcactaagcccaaagtggaaaatcagtgttggcaaccaaacctgtaggattacaaattgaggaagtattatgcacaagcagtcaaggtaggttcccttatatcaacttgtcatgaaccaagtaccccaaaagctcaagctatagggtgaaagcaaagcacaaacaatttttttattaaacacatccctcatgcaagatctgtatgggctttaagcatggactatggataaacctagccaactgtgtgctaaaatttagcttttattaagaataagggaggcaataagggttgaactctgaaccacatgatcataaaggctcttataccatgtcatgaaccaaatatcaaaaaatcataagtttttaggagagtgaaaaagcaaatgaatggtttgtatatcaaacacaactgatgtaatgatttatggtttaacctaaaacgtcaatcttgtcccatgcatttgtaattgatttacagcaacaacattatgtgatgagattgtaagaataaaagttgcacttgtagtcatcttattcaaagaagctagcttcatggaacccaaaatagcttagtcaaggtgatagctattcctaaaagtctgttatcactcacataacatgcttaagtcacataacaaagtcaatgggttacattgccaatgacggatcacatttttgcaagacaaattttggtcctaaagtattttttccttttgctttctaaaataaatttcagtagtacatatcatgttaggctttattagacccaaaaatattttatcaattgctataaaatataagtcataccttccaatacccaaatgtcaaattatagtaccaaactccaaacaaagaagcataattaacatgcttggttagttggttatgtgaaaaactcataataagagctcaagttttcttctgatttgtttattttatttgaaagaccacacccttacgcaacaaatgaatttgatacaagctctttgaaaccccacacccagattctatttgcaataccttcataaccaacagattaagagactcaaaagctcccctttgaagctcaaaccagagattctatcattgcccccatcattatttaaacccattttaccatgaaataaccctaggaaggttgtctttctcttctctatgaagttttttctgtgtcagtgtgtcatatgtctttcttggaatcatgcgtctctttgtgctcatgtctgagtgaatcacttatatacttttatgccagataaaaataaagacagaaaacttactagtgcaacaaagaaccgtgctattacatctgaagacttgattgcagctgattgcatccatgtctttctaacagccatacgttctgcaaagtgatttgaagctgaaagaactccaataaaaagtttaataggatgtttaggtaaaggtctggctttccaggtctctgacatttccagtactctttgaggtgagaaacttggatgggaagtaggaagagaagtagcataaattgaatgaacatccacatcccctttaattgccaatcctgtagcatcctcaagtgtaaatccctgaagattagacaaaaaaacgttagacaggaaaaaaaaaactgtgaccatagaagtaaattatagaaaaatggaaatatattccatgtattctcaaattttaagctataagagtcacccttcagcatgtagaacaggagttattaccattatcacaaattattgagggtaaaccaaaattctgtatctataaaacctataacatgtacaaaaggaactcaccagaattttttgaactccaatacaataaagttaaagcaaataaaaacttatatctcaccatattattgtcattaagaagctagatatcgcaatttcacaccatctagatgtttagtaaaaacattggatgaaacacctatattatctcaagaatctcaagaaacttacagtccgatatggaaatgaagttacatggcgacccccaatattaatatggtatccatcaacaccagcacgcaatgtaaggacaaacattctgccctctactaaaggaaatggccaggtcatttctggcttttgctcacgccctataaaccgcttaaaccaagatgtcatcttggactctttagcatctaaaatgtcattccgcatccatttctcacaccgtctgtatccatcaactgccaaatataataacaaaaattataaggatagaaacagacagatgttaggcatcaccagactccccataaacaactggaatatcatattgacaataaaataaaaatattcataaaacaactaagacataagatcctattactaagtagtagtacatgatatatcgacactataacttataactacaataaccattacatctattatgctttatagctttatgtaaaatacaccaaccaggaaggtaaaccttatctttctgttgaccatgcaatgaccaagaattaaggtgtgcatattttcatgattgtttttcaacctttgttattccacctttacaatgatatcaaatttatattttacaataatgacaatgatggagactcaattctgcagcactttctttaaatatgacacacatcaagatgaatatgaaatatgatatatcataccaagcatttcttcttcatccccagacggcagaccatcacatctttgagaggttccccagtgcattcggtaacaggtattatgctcaattactggctgtttgctccaatccccccttattcgaggattcaagtgaaggatctttggaggatcctccccatccactgacttcagcccttgcaattcaaccatgaattgggaaactgaaactaatcctccacctctcttcatcttggcaagctggggaacatactccttatgagcataatggggtgtccccaccacagtgattgaagaaccagctgcaagcccacagggaagaaacatcaaattatctcctttaatcaactcatccccattcattgacagccaagaagggcatgactcgggctttccatcaaggatggagttttttattgaccccttctcgtcaaccttatctacgtccttccaagccttcaaccccaatatccatgcctcatccgccattctctcaagcacagacaaatcattggtcctcttatattcccgcattatcttcccagttatcctaccatatcgtggtggaatctgcttcggagactccggaaaacgctcttcctccttccttggctccgtgtttggtctcaagggggcaccctggtccctattatcttccaatctcctatgaaatgcatctttataaacagaactcacaaaagacttgctcaaatctgaatcttcagagtccccaacagctgccccctccaacctatcttcactctcatccccacttaacgttgatacaattctcaaaaactgtggaaacttgcatgacacaaacaacaagtacaacaccccaatgccaaacaaaaaatgagacaatctaaacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattaaaaattattacattattacattagatatgagttttacacttttacttttatttctagttcactaccttttattaaatgttaactaatgaataagagtgtgaaaaaaatattatgttatcaatatctctctaaatattaaagagtattgaaagtgacggcatttttaattttcttataatttagttttcgtgtaaactggagtactttcttttacaaggaggaaataaaatccaatttgtgacattggttaattcaattggtatttttttaatttgtaataataataatttattannnnnnnnnncaagaagggcatgactcgggctttccatcaaggatggagttttttattgaccccttctcgtcaaccttatctacgtccttccaagccttcaaccccaatatccatgcctcatccgccattctctcaagcacagacaaatcattggtcctcttatattcccgcattatcttcccagttatcctaccatatcgtggtggaatctgcttcggagactccggaaaacgctcttcctccttccttggctccgtgtttggtctcaagggggcaccctggtccctattatcttccaatctcctatgaaatgcatctttataaacagaactcacaaaagacttgctcaaatctgaatcttcagagtccccaacagctgccccctccaacctatcttcactctcatccccacttaacgttgatacaattctcaaaaactgtggaaacttgcatgacacaaacaacaagtacaacaccccaatgccaaacaaaaaatgagacaatctaaacctcctcgagttgggaggatcacttttcgctctcttcatcttcaaaacaacaacacactttacaaacacaagaacaatctcctctcctcacaagaccaaattttgaaggcaaacccacattcaaattttcaacaacaaaaaaaaaaaagccatgcattaggcaatataaccgagcatttttcacgagaatttgaagaatcaaacctcaatgaagagggagtgatcgagtttcggaaatcaaccaatgtaacaaggcatcaacaaattgggaagaaacccgtttcaagtggaccccggagaacccttaaagcttcaagctttagacagaactccgcgaaaaactcgatctccacccttgaaccctaatgcacaaccctgctataatgatgacaattgaaatgaaaacgaagaggaggggacccagaattttaaaattaaaaataaaaattaaaaaatgaatgttcgttactttattgtattatttaatttaattcaattcttattcttatagctgaatttccgatactaactgtgtaccctatttaatgtctttcatttgcaaggagggtatttggaattttgttgtactgttgccattagtcaggaggatgagttttttttcttttgctgtataaggaggaggagaaatattaatatttaatagacataaataatccatcacagaatttttcatggtttgaaatttattaaaaattattacattattacattagatatgagttttacacttttacttttatttctagttcactaccttttattaaatgttaactaatgaataagagtgtgaaaaaaatattatgttatcaatatctctctaaatattaaagagtattgaaagtgacggcatttttaattttcttataatttagttttcgtgtaaactggagtactttcttttacaaggaggaaataaaatccaatttgtgacattggttaattcaattggtatttttttaatttgtaataataataatttattaactttactaaacctcttaaaagagagcacaagacgtgcgtttttaatatatattttagtctattcatttcttccaagacttcatatttctatttttataataaaatagttatttatttacggaaaaaaacaatttgtttaatggaaaaaaatgatttgctaaatggagatatgaacaacacaaaatgtaagttccttctcattattaagctgaaaaatcatttaaatttagtttatttttcctttctctgataatctgattatatatctttttcgtaaaaccctttttgttttcatcattttgggcatatgtgccttgcttcaacattaattagcttttctcatgtatcggtaccttgttcgactttctttattatttattagttaagggaaccacgttctcattatttgccggcctacgtttcttactttcttgatgcctaagaagtttgcatcaaacaaaaggaaaacaatgaaaatatcgattagttggcaaattgacaaggttattctttacctatataagtttaaagtaagatgctaacttaaacttggtctttcatttactgtagattttttcatttggaatgatctttagtgaaaaataaaatttgagattgtcaataaaacttacttaaaactttatatcacatgaaatatatttaagtatgtttaaaaatagttgtatgatgaataatttatacaaattaaaatttcatattatatgtttaaataataaataaataagttagcctataagttgaaatgactttcttaaaatcttaatcattttttagtgttacaataatgacatttttttagtcgactatcatatactttctttttttaacataaagatcagtataataaattttgtatctttcaataaaacctaattttctccagtataattaaataagattttctataaactaaatttttatgttaaacaagttagataatggagttttattatgtaatttattatttcatccctacatcattattagggttaattacattgatcactccttatgtttatcattattacacttgatactcctatgtttcagtacattacttttagtcccctttcccaaaaattgtctaagttattttaaaaaataaaatagaaataaaatatagttgtatgataatccaaatttactccttcattttaacattgttgattaggattggggtgacatctccttttttgtctacttcctccattatgcctgtctctgacgccaactttctccaccactgtgacgtcaaagaagagagaagaggttaagagagggtcatgcgagaacgagttgaagatcagaacatagaaagtttgatttctgaaaaaataaattgaatacaaattaataaaaggggacaatataattcacatactattccgcttttgtcaacagcattgctagatactctaaattatgtaaatacaaattatccttaattatggaacgtgtgtttattttttgttgttggtgtggtagttaagtagtactgattaaattgagttgaagtttttgtaaaacccaattatccttagttccatgagaaattgataaacctgcaacttgatttcttatatgaaagttgttaaagttccaatgttatagtgaacgagagatatatagggaaagatttgaagtccaattataaaaaattgtcttgcagcattgcaatgcatgggagtgcaaaaagcttcaacataaaattctttctcttatccatattgaaatctattttctctctacaactgcttttttctattttttaaatcccttgtttaaaggaggaaagaaaataacattttaggggaaaaaataatcaaatgtcaaatggattgcacgtgatttatttatgtcaaacattcaaatgatgttaacatgggaacgggcatctgttgttataaaaattggcctagtcatcaccctgattgagctattggatcatatattcaataggtgggttactttattaatttgatatatattttaaaaaattaaaatatatataatatacttaagaaaatgtaatcaattcatacttttatattccaaaataaaaattattttcatgatcaaactataatattatataatcatttgttactataaattatttataactattatcattaaataactaagaaaattcttatttttgaggattaaataaaaaatttattgaataaccataaataagtctggtgaaaatatataaaacatataaatattatatcataatcaatataataataattaattattatattattatcaagataaataataataattttatagaaacatattatatatcagttaataattaattattaacaatttaacatgttatagaaattgaagaaaaaaaaagaaaaaaaaacttctccatggaatcaccaagtcaccaagtttcatcaaactcattcaagtcaatttgggccaattgaattttcagtcctgcaccttaaccgaaccgtcctgcacattggatctcagtccaattagatgagccaattttaataactatgggtgtaaccatccttaaaaattaaggagctttttttaggaataaaaaatataaggttgttaaacgtgtaataagtgcaaacattaggaaaaaatttgtgtaatttactcttataattatttttatatttaagattatgaaaaggataaatattattagtttatcatctcttataattatttttatatttaagattgtgaaaaggataaatattattagtttatcatttgaattgagcatcagtgtgaatttactgatgtggattgttttagcttaactaaatatctcgaatttgagtttgaatatgtagctacattaaatactcggagaaagaattttatcattcataataattctttttgactcaaagaggattgaagatgcatgtggtttagacattttttatttctttagaatagagtgaaataaaattgaatcaaatgatatttatttcatttcattccacctaataactttattttctgcaagtttttttaccaaaaaatacaaaaaaaaaannnnnnnnnntcctctaataaccactacaagaagaaatgagcacttaatttggcaccattacagtgtcaatagatgtgtctcttttcaacaacagatgaaccctagctcgcttagcattcagccatgttgtaaggtgggccagtattttagacccaaaataagttaagcggagtggactaggccagcccacgaattagcccgttatttttcttcttcttctttaggctgtgtttgttttgaagaataagagtgatatacaagagaaattttatacttttttaatgtggaactcacatctcttacactttgctttaacttaaaaacttatcttttattttcatcctctcaaccaaacacacccttaataaaaaaaaaatactactagaaggaaatgaggttgatgggctcatcattgggcctaaagatagaacagtttttttttccttctttttaatgggttatcaaaataaaaggatgacaactataaaataacgaaacagaaatcagtgcatagccacaagaacatagccacaattaggggtgaaaataggccaggccaggtcaggctttgataggcctaagcctgacctgtttcactatcattaagcttaagcctggcttgttacctgttaaaaataagttattaaagcataagtttggcctgcataaaagtctggtctggcctgaaagcctgtatacaaaggctgattaaataaaaaaataattaaaaataaaaaattaacgtaatatcgatgcacaccgacagcccctacctcaaactgaagcccaaaatgcgatcctccaagtttaactactccatggtaaatgtccagaccattggagctgacttgtgttacacttggtttgatagagatttgagtgttgctagagtcattctatgaagtagtcataattcttatgtgtataagtttgtcaaaatcaaatagacctattttacttattcccacacttgccattcatcttcattagtatatatattatatagactttatgtcattcatcatacactatattattgttaataagaaaaaatatttttagaaaaataaatatattatttttaagttttaatatatannnnnnnnnnagtccatacaatataaatcattgatttttttaataaaaaataatattatagataaattatatttttttatgaactaatatatataaattagtaaaaaaaattaaaacaaaaaacttaatttttcttagaaaaaactcttttgaaaaaaaaaacaattatgaaatcggttccccagaaaaatcgatttttggggaaccaaagtactgtaaataaaataaaacaagtgagaaatcgatacttgctacagtagtagaatgcatcattgatgtaaatattttttgggttgaattatttggataaatatttatatttttgtattttttgggtaaaaaaactcttattttcttccacttaattgtaaaacaaatataactaatttattctatattcatttttaatttttaataatataataaaaatgtttcaacatgatgacactcagtgtgcctaatttatccctcaagctaaattccaaactataaggaatcatccgagattaaaaaaaaataataataagtgaagaatcgagatagagaagcaacaaaaatggttatcttgtcataccaacaaatgatttctctctttaaaatctcacttcacaccaaaatgcatataaaaaatcagtcgtaaattaaaacctttcgagaaaattatggtttaattagaatagtggttaaaattaattaatgactacttgaaaacagaaattttcgcacatattaagaacgaattcaattttgaaacctgtgtacctaaaatatttcttgcaagaactcgatatcatttggccctatctgaccttgtgtgttgtttcgaaaacgaatacatggcactcagagcaaaaggtaacgaaatagtaatgagaattgttttaattagcaaaatttataaagtattgggatatcattcggtagattttattttttttcaattaatacaaaccttcttgcgtcgcactgttataataagatagattttcctctcttaaactttcctattaaaataagttatttacttctcaaaaacctttttttggctcaaaatcttggaaagttaaaagtcacaagagtccaacacataatcgacaaaaaaatgcaaatttgattctcccatttttatgcttttttgctctcttcattttattactttggtttgtatcatttgttataacttagaacattggttaactttgcccatttttgttggctctgtgctgccataatttccaacgtagatatcagtgttgtcactaaataagggtttgatttggtccctaaaattggaagctgacgactttagagacgtatagactttgcttggaatttcgctactttgtcaaaacttgtatggtggggacatttcataaccatggctacattatgcacactgatgagcctctcaatcctacatctttagaaacggaattcacagtattaccaagtcccactctaacaagagcattacccttgcattttaactataaatttgcttgtgccgcacactaagaaaagttccatatcaacatatttatgcaagtagtttcattcatttataatgataaattgagagaatgagtcatgcgacaacgataaaattgtgtcttggtgacttgttaatcataaattcaaatccgaaaacagtctctttgcatatgcaagagtaaggttacgcacaatatctctctcccttaacttcacataaggatgaaccactcgacaatgagatacaaattttttttttataacgataaattgacttttttttatccgtaagaattgaagacatgttagggagtttacaataactcacacccctagttcaaccagttagaccccctccacaacgataaattgattgcaaacaaattcaaaataattggaaagatcaaacacgcggtattttaaaactctgctcactccttttgaaccccagcattttcattcagttttcacccatcataataagaaagaaatcacaatggtaagcctaaatttcaataaatttaggtttagttgaactaaaactggaggaacaaatagtattaaaaaagcaaactctctaaaagtgggaactattatttctttaaaaacaaacttaatcatacatgcactaaaagtaacaaggtggtatcagcatacctgggttcgaagtaagcacttgaccttaagaagagagtgtagcccttggcaccaaataagcgattataagtaccaacatgcactcaaccaagcatatacataaaaccaaaaccacataacagtaatttccattgtagtaaagcccttttccccctggtactcacaaggccatactctcgaaagggattattaaggattgaaaaacataaccatagttaataatccattaggcccacaaacaggtgtaacatggcataattaaatactccatttctcaaaggcacaatttatgctgaaccttgcaaaaattagaggaggagcaaaatcaaagttttcccttgtcttcctccttcatcttcttctgccaccttctcttcttgtaatccagcaacatctggggcatcttctccatcaacttcgcagtgtttgcgcgcttctcagcagaaatcctatcacatttgtgtcctttcctcctggttttcatctccttcctttcaggatcgtagggccaatcttccccagcaaggaggacttccttgcgaattctagcacgatgcctagcactgatactcagcggcttccatgcccccagctcccagtatccccacacacccttggcaagctcatccttatatttccccaacttctcacgccaaggatactgatattctgctaccgccttagccaccgaactaacacctttgcccgccattacataacaacctctttttctctacacataacataacaacctcaatcagacaaattcacaaacacctcctaggctaacatattttttttcctttttaaaccaaataaattgatgttaccaacttcatttttcacagttgttctctgaaggagtaacacattagtaaaaaaagaaagaaaagaagtaccgttcaaataaaaaaaaagggtctaaatttaatttaattataacaaaaaaaagtgattatgttccagggaggtaaatcataaagtcaattatggtgaataaagtaaagcgaacaaaacacaatttaggtcacgaatacaacacagaacaagtgggatctagttcataagcgagaaaaattaaacaaatgaagtaaaaacaaagttagacttacactttgtgggattgtcgaaccctcttgagtaattcacctaagaaacaaaaaaaattaaacaattaagaagagaaatacagtgatatgatagcgagcaaatcctctaataaccactacaagaagaaatgagcacttaatttggcaccattacagtgtcaatagatgtgtctcttttcaacaacagatgaaccctagctcgcttagcattcagccatgttgtaaggtgggccagtattttagacccaaaataagttaagcggagtggactaggccagcccacgaattagcccgttatttttcttcttcttctttaggctgtgtttgttttgaagaataagagtgatatacaagagaaattttatacttttttaatgtggaactcacatctcttacactttgctttaacttaaaaacttatcttttattttcatcctctcaaccaaacacacccttaataaaaaaaaaatactactagaaggaaatgaggttgatgggctcatcattgggcctaaagatagaacagtttttttttccttctttttaatgggttatcaaaataaaaggatgacaactataaaataacgaaacagaaatcagtgcatagccacaagaacatagccacaattaggggtgaaaataggccaggccaggtcaggctttgataggcctaagcctgacctgtttcactatcattaagcttaagcctggcttgttacctgttaaaaataagttattaaagcataagtttggcctgcataaaagtctggtctggcctgaaagcctgtatacaaaggctgattaaataaaaaaataattaaaaataaaaaattaacgtaatatcgatgcacaccgacagcccctacctcaaactgaagcccaaaatgcgatcctccaagtttaactactccatggtaaatgtccagaccattggagctgacttgtgttacacttggtttgatagagatttgagtgttgctagagtcattctatgaagtagtcataattcttatgtgtataagtttgtcaaaatcaaatagacctattttacttattcccacacttgccattcatcttcattagtatatatattatatagactttatgtcattcatcatacactatattattgttaataagaaaaaatatttttagaaaaataaatatattatttttaagttttaatatatatatatatatatattaaataggctagcctgataggtctaacaagttttttttaaagcttaagcctgacctttttatttaaacagacttttcaaaaagccttactatgacctttataataaacaagttaggtcaagtcagaccttaaataggccaaaccaaaagcacctgatagctaatctggcccattttcacccttagctacaatcaatatacattcaacattcatcatctggcccattttcacccttagctacaatcaatatacattcaacattcatcatcaccaaacagcacaaaaaagattattaacaataatgagtgcaaaggagaaggctggcggggccggtggggctggtggcggtgcggtggctgtgtggtgacggcgagacttggagttggaggcagtcaaaagactcaaaacgtaaataaaacttaaggaccctacagggtagtttggttgtgggggagaattttaaaaaatagtgagtcacgcgttactttttctctattttaatttaaatattcaatctcgtttctcttcgacaccaccaaacatatccgtaatagagcatgctcaggaaatgaagtgagtgggcctctctttgttttggcccaataatagaacttcctaagtctaagaattaaaggtccacagataagttgaatgtgtggagctaaaaagtttgaatcttaagtggcctagctattttaagacctgtatactatgtggtatgaaggttaaacggattgttcgtgtacccaaattcaaatgtataactccagtatatataaaggaaataaatgtgtttggtgtacatattttatatccatcttatctttgtaattacagtcatacattattatattttatcattataactattttcacatgtctaaaattagacactattttctattatcttttattattaagaaaaaaacatgaaaggacaattagacacgaagtgctgttttttcctataatgccatcatggaactcggccaaccttactattggacttatattgaaaatcacaactactttaattaattgttgtttaatatgtcacctagttacttagagttttttcattttattctatcaaaataatgtacttcataatatttttatttcaaataagatgtgataattcgaaaatgtcatgtaaacatttgtttttttgttttacgaatgtaaacatttagtttgagactactttatagaattaatattgtgattatatatgagtttatattaagtagaataattaagaaactcaatgtggtacttaagttgcaatgattggaatttgttaagaattggatcacaaaaaaacccacgtatgaagtgtataaagcaacagtatatcaaatacttaacaaatataagctcactttgacattagtcaagtgaaacttaactctaattttttaaacaatatcttgaatatgaacgttataaatgaaaaaaaaaataatcgagatgaaagattctattaaaaataactaggaagatttttaactaaaattaatcattaacatttaacaaaatcaataaatattttgcacctataacatagtataaaaatcacaaaaatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgaatatgaacattataaatgaaaaaaaaaataatcgagatggaagattctattaaaaataactaggaagatttttaactaaaattaatcattaatatttaacaaaatcaataaatattttgcacctataacatagtataaaaatcacaaaaatatataaacatatagggacataaataataattcaatttacaaattaaggaagtcagtttagctatatacaaacatatcgatgttggttgacatagttataactaatatgtttaaattttaattatgtgcttacttgttttggatatcatctgacaataatatgattttttttaaagttaatttacattaaaatatttgaatctaatttgaatgtattatgagtataaaattacttttatattattatttgatgatgtgctgttaggttaaataattatatatatgaatagaaaataaataattatatatatgaatagaaaacatcatctatttctcccgttaaaaaagaaaaatctacttctaatcctatgatatcaccattgttcttttattttttggacaaaatatcaccattgtttttgttctcgacgattccgaaccactgtctttcttttaatagattttgccttttaagttatagatgtaggccactgtttgtgcttcttctattgatagtgataattttagtttgactagcaaaatcttgtcgttatatgaattgaagaagcacttcaggacaacaccgaagctcctctttctctggtcacgaatgaagcaaataataggcggaatgagcacttgttgatatttttagaccctgaaaagtgattccaacatcaaaagattgcggctacgcctagcttagcttcactgtgagagaagatcatatccagagctaccaatatttattatcaagaatagatacggcgtttctttttgcacattagtgtctgccataacatgtttggtcaatcaataatcatcagcaaagtgaactattctgtgtttttttaccagacaattttcacatatacttttatctctttctttcttcactgttatgctgcattatgtatattgtttttcctcatttttttatcacaatttaggtttatatagtctatgacgtaaaattatggtttttaaacgagaattatgttttagttattggtttcgaggtagaatcttaataagtaattgtattaaatatttgaaaaaaatattatccaaaataattttgtctaatgtgaaaatatctaattgtatatttagagcttaaagtcaagattatatgtgagaataatccacatgcatgatgatatttttaagagtaattttacttttatagttaaaggcatatgtatatttattattgcctataaagaatattatatttattattgtacatgaatatattattatgtttcttttttagaagccacaagaatattttacatgagagataattatattcgaaataggtagagcattggggataaaaaaaatctctttaggtaaaagtttaatgcaattacatatccaaatttaatcattagttaaacaaaaataattttgcatcattgatccacaaattcgataattgttatgttactttagtacaaatgtataatatgttattaatattctaccttattatataataaaaaatatattttaaaaatatatttaattaggacggtcaaattacagatttataattaaagatcggttgaagtcatgttttcattgggttttcttttccggcaaaaaaaaaaaataaacatatatattatataaaaatagataatacaagggtaccaggggaaccaagatcaaatactacactgcaaaccccatctacccagctcatatatatgttttcattggtttaactactcctattttgtttctaaaaaaaaaaaaactactccaattttgtacgaaagtaaaacaaacgaactactccaatttgaaaagcattatatatttgactgaaatctaattaaaacccaggttggttcgtctcaaagcatagccctaatttattccctatggcctacactatctaattgattcctcagctagatcttaaagtgctttctaaattaaaacatcatattttgtagcattattaaatcccaacagttggtattccttggaccaaaagatattactagtagtattgtagtaataaactttattagttaaaaaaatattaaaaattattactagtataatatttgtatcaatatatattttaataataattctacacttttaatttcttaaccataaattctttttagaattaatggcatcattgttgtctaacattttccaaaactccactcatcatgcttggaagtaatcccaattaataatcatgtggattcgttcacaggattttcactttcaattttaaaacaaaggagtgtccttcactgtgataaatgagaaggacaattgtttatttattgaaccttctaaggaggaaaagattaaaaaggttgtgtgggattatgatgggaacaaaagtttggatggtttcaatttcaatttcatcaaatcttgttgggatgttgttgaaattcatatccataaggtcattcatgagtttcatgttaccaggagagaggttgtccaggggaataaatgcatcattgctcactcttattcctaagaaggatgaccctcttgcataagagattttaagtccatttttctcattaggtgtctttataaaatcatagtcaagtagcttgcctctagagagttggggaaggtggtggaccatagataattgacattcttggggggaagaaatattttagatgggatcttgatagctaatgaggttgtacatgggggttcgagaaagaagaaatcttgtattatttttaaagctgatttcaaaaaagcttatgatatgatggaatgggaattttttgcatacatgcttcaaagatcgggcttttgtagaaaatggattaagtgaaattggtgttgtttgcgatcattgtagcatcctgatttttcacttattgatgactttaataatacaacacttcactcaacatccttgttggtcagaacctttcataggtagtccttttcgagacctcgtaaatcagctctgcctactttcaagatcaatgactgatctcataaaccaacacaagatctttcagcatgctttatcttcactcacacgctttccaagaaactttccagaaggacatccatcccataactactccaagacaagcatgcttaactttggagttttaagtgacgggctaccaaaaagtagatacatcttgttggtataggtagtactaatcaattcctttaagttatcctcaaatgtgcaatctcacagaagtacagcctctggatccctgtcatctagtgtgatttggtcgaggtgttacatgcccaccaatttccgcctagttcgtcctcgaaccacaccgtactggggagagatttgctctgatatcattttgaaacatccctgattttttactttttggctactctcacactacgacacttcgcgggatgtcaattcactcaacattcttgttggtcagaaccctccatcgatcaaaatcctccatcggtagccatttccacaacttcaaaaatcagctctatctgcttccaagatcaatgactgacctcacaaaccaacacaagacttttcaacgtgttttgtccttattcgcatattttccgaaaaacttcccagaagattacccatcctataactactccaaggcaaacacacttaactatgaagttcttaagtgatggactaccgaaaagtagatgcatcttgttggtataggtaatatcaattaattcttttaagtcatcctcaactgcaaagtttcatacctatacaacctctagatctctttcattctggtataattcaatcagggtgttacaatcatatactacctttgtccttgttaatggtagccccacagaggagttcttggcacaaagagggcttagacaaagagatcttatggtgccattgctttttttggtgttgcccgggggggtgagcggatttgggaaggtagcgaaagcaaaacggctcactttcgggattggtgttggtaatagtagtttgaatgttacacttcttcaatttgttgatgacacacttttcttaatgaaggattcatatagggattctattactctgaagacaatccttaaatgcttcaaaatgactttcagtttgaaagtgagctttttcaaaagcaacttgcggagattcctgtgaaggatgaagatgttgctaggtaagaaagggtcttaaattgtgcaactatgtcaattccttttgtctagttgggattgcctattagagcggatgcccaaaagactagcacttgacaatcggtgattaacaagatgagaaggaagttgtcctcatgaagaagacgacacccatcttttggaaggcacatttgtttagtgaaatcgatactctcctctttatcgctttattatttatcttttctcaaagctccaaaatgtgctattagtatcttgaataggcttcaaaggaatttttttctttggggggtcaaaggagaggagcaaaaagtttattgggtgaggtgggatgtagtatgccaatcaaaagaaaaaaggaggattggggattgggaatctaggaatcttgaataaggtcttagtgggtaaatggttttggaggttgttgagtgaaaatgagtgcctttggagagatgtacttacacaaaaatatgaaattagggatttagataggcttgttgaaggatctttgaacacaagaggatctcaatggtggaatgatcttgtgaagctttgtgaaattaagggtagtgggatggttggttccaaaaagatgttaaaagaagagcaggggacgctaacgaggtgaggttttgagaatcaagatgggtaggaatgcacacctttgttcaaaattcaacaggttgtatctaaattcttaacaaaagttgctcatgattgcacaagttggccaatggtgcaatagtacatggacttggactttggcttagcgtcggccttggttcgtttgggaacaaaatatgcgacaacagttgtggaacttgattggtggtctgggaccgaaagttaatgttgtggatgggtcggattggtccccgagtttggagaaaaaaatcgttgttaaagaggtgtatgaggctaagatcaattcgtatgacccagataaggaggagttctacaacatcttgtgtaagctacctgtgccatcttagaccaagggccttgtgtggaagcttgctcatgatcgacttcaacccaaagataatttacataagagactaattcttccaccgggtttccaggttcaatgtgtcttatgtaacatgcatcatgagaatgttgaacaccttttctttagatgtaaacttgcatttgtggtgtggactcagtgctacgtatggatcggggacatcggggtgctgccaacaaattatctaatgcacttttggcaacatctaggaggaattgatggcaacaaagcaaaattggtttggggagcggtgtggacattgatcgtttggtctatttggaagctaaggaatcatatcatctttaataacgtcgcttgtaatcttcaaagtctgatagatgagtcaaggtacatggcttggttgtggtgtaaaacatatgttaaagacttcgattttacttgtacgtgtggtgcatgggttatcttgtttcttcaagtttgtagacaattaatgtgggatttgtgccgggacattgcagggttgataacgtgtacttatgatagaagaaatagtatcttgtttgggtaagtttctctagaaatatttctaaaagaagaaaataagaataaaaaatgaaattaattttttcataagtaaaaataagttcttcattaattaatcttgagaaactcatcaatacagcttctctaaaagatgagatgacatctataaataagctaatgaaaaacctattttagcttatggagaagctcatttcatttttttcttcttctagaagttcttctagaaaagtttatatccaaacaggttctaagtatttgtcgggcagaaaaataccttgcactagcttattggttagctgtcaagaattttttgtatttcctttgtggttggacatttcttatgccaatcactttttgtgtatatatatatattgaacgctccattagttttaaatgaaattcagttccatggagaatacctttatcctcaaatgaattactccaatgagaaaaagaaaagttgaccatcccatctctaggggaatattagtggtagtagtatatttttccttttccatgtgacgctaaatattttatatgcaactcaaagctgaaacattttagtttaggcgtttcaaaatttcccccactacatatttgactatgttaagggaacaacacatgcatgtttgacatctcttgcaccacgggtgacttatttgctgcatggtatagatacaaagtggtacatccaatgtaatcgtgccacatttccaagtgtataaaagagacaaaaattagtaacagtgatatataattagagcttaacaaattgaattattaatgcaaatgacaaggattagagatttgacatgcgtgaaagacagaatgtttagtgtaggggattgtaggtccattttcactaaaccaagtattatagaaatgactagcaagtaggctagctagggtgattagcaaacatgtattataaattgaaacaaaaaaatgatcctataatgagatatgtttttcctttttgatgcgttggaatctcttatgtcacccaaaacatggccaagaaaaaatccataggggctgctggcgtgctttcatgctgtgccccccttggttgccaatatatacctttggtcaaacatgtttcattctgtgttcacctctctctagcaatgttgtgctctaattctttgggggcttgtttggtttattttttgaaaaagagacatgcacacttaggataaaccctttttatatcttagcaataattgtgattagcgaccctttcaacttttctttgtcacaaattagtcattcagattacactccatcatgattaagatcatggggccccactcaaacattccgttagggtttgcctcttcatcattacctttctactgtattgctcttggcttgtaaattaaaaattaataatatatttaagctggcgctggtaatcacatcttagcttcaagttagccaattagccgtatgcatttattcaaacaggataataatgtttatttttacctcatttatttttctatcgtatcgtttcaattttaagtaatgcatagaaaaacacgccttgtaaatttccctttactttctttttctccagacaagcatagatagatgtaagaaaatgtgtaaaaacactatgcatacaaattattcccattaaatatcaatatacaggagtatagtatttttttaggaacttaataatcccttgaaaacgcattaagttgtccaattaatatgtgtatttgtatttgtccacacatatttccagaaatatataattaaatgatttcaatacgaaggtaaaaattactactttatgataaaatttattttacatgtttctaaaatgtataatcaaatcatttgccatattataaagcagttagcacaaaaatgacaatctaactaaaatatagtatttgtaaaatatttgagcatgatttttcgaaataaacttttgttcacttcatgccaagaagaagctttccatttaatgaaaacgctacctctcgttatttcatgaaataaaaaaatttaattacaaaagtatctaaagaaatcttcatttgataaaagataaaagcaaaattatgaagataaactatccaaacttagactagtagatacgtgaaatctcgggtgattagggtatgtttgacagggtttttatttggtttctcctctccttaaaagtaaaagtgttggattaaacattaaaaaaaaaaactgtccaacttggactaccgcatttagattacatgtcttggaagatagacacacatgaaagaaactattgcatgaactgcacagattttgatgaagaatggaaacattaatacttttgattggtaaggaatctattgaggggatgagttttatgcttgctactcaaaacctgattgttgctgctggaagaaaggaatccgtggtggtggatatgtattggcttacggcacttttatatttatattgggattgaagaatttattatatggtggaattaatgtagcatggtttttatctattatccgttttgacatgagaattaaaaagtgtagataaccgatatgtatagatggttgtaaatcattttgtatatgggttttaggtatctcttatgagtatttaatatatttattttgtcgatctataaaaaaaagaaagaaactattgtttacatatcatcacctttagccatttaactatagattctttaaatattaaactttctttatatttttcaaatatctccttaaattagctagcttgttctttctaatactgagctctttctctaaaataaaattagctatttcatttttcacttaatacacttttaaataggttggtaaactaagtcaaacttttatattatatttaattttgaggataaaaattaaaaaaaatgaaaataaaataaaatataaaagatgagttccacttaaaacacacaaaatttttcttttatttttctcttctgtttctaaatcaaactcagcctgatgtaacctagttttttttatttattattattatcgtttttcgataactgtttgagatctagtggacaaatttgaatcacaaattctgtaggatcctcaaaattattgcacagggaaaggtctctcaattataacatacccttttctacatttgtgtacaaatacagtaatctgtatcttcaaaacattataggcaccaggtaattatcatgggtttgacgttttataggatagtttccttacatgcactgtcatcatgccagctaccccgagtggcataatttttcccaaaatcagttgctcattaaattgttgcatccgtattttttggctttatttattgaatcctatttaagtgaatctgtacacttagaaccatctagctacaatttagagatgtgacttcttctgcctaagagcaaagaccttacgagatatacagattattgaaaggatctcaattttaactaacgcttttggacttacatgtatgtacagtttatatagcttggagatattattatagcattaacttatgaaatttattatgatattccaattggaaaggcaaagttaaaagtctttaatgtgacattacaatagattctatacgaatattgaaagatcgcaacctacttgcaacttatctctcctctaaaaatcacattgcgtagaataaaatggaggatagtaacggtggattttggttttttcaatttgtagtaaatggaattaagtttgagagaaatgtttttgttttaaaatactcgttgcaattactttggtatccctagcaattttgatctttttttaatgttaaattacaattttagtttctcttataaatttgtgattctcatctctcatgatctttagttgataattttgattctcctaatttttaaataagcaattttgattttccatccaattatcctgattgacctttagcatgttaatattgaccaattaatttgttagggtgacacaaaaccttgtttatcaactattaactgtgatttgtagctaaaatgggtcatctttgacctaaatctttctaacccatcttcaccaacacagtggcgctgcaacacccccacctacccttcttcatcttcttcgacaccacaaacactacaaccccatccaccattgccatcgtgcccccttctgaacccatccactagatccgccatcagaccactacgcaacccatgtcacaccaccaccaactccgacgtcaccataacaccaccaaaccaccgccaaccaccacaaacaccaatcatatcaccaaaccgcgaccaccaaccactatatccaccattaatgttgatgaccataaccagcaagggcgtcgacgtctgccagctcttgtgtgaccttcgcgtggcactaattctcgacgaggaagcgcgaggcgatgatgcacggagataatgtgctatgacgcactgatgcggatcttgtagagaagctcagttccatcggtcctgaaggtgcggtcggcgacgttgagggtgccgaattgcgatggggggccggggggcatcgaggaaagctagaagtgctggttattcttgctactgcggcggagctgggggcttcttaaaggaagaagggttgaggaatgcggaaagctgtaagctgtttgggttttttctttaatattttaattaatttgacattaacttaataaatctattaatcataattattcattaataactaaaagataaatgtgacatgtcataaattatttggtcaatgttaacagtttcacgctaaactgaagttagttaacaaaataattaaaataattaatttaagaaattagaagatcagacttgtctattaaaaattaaaaggacgaaaattacaaatttataaaattaaaaatcaaaattacaatttaatctttttaattacacaattattagtcctcaaaatgaaatttatgatttaaaaataataaaaaaaattaaagacaaatttaaatttgtaatcatctttttcttcttttatcatctaaatcacttagtcgtttaagaattattgagggtgattgtgaatttagtttttaaatataatttttgatatacattaaatttgacaaaaatggaactaaagtatttttaattcaattttttttattttttattttttacatttattttcaaaaccaaaaaaaaatatttttaatttaattttaaaaagtacaatcttcttatatttaattgagttttgtaggtgttactaccaataccaaaaccaatatcatcaccattattatattgtcattattattagcattgttatcattgaaagtatcatcatcatgataactaccaacactattactactaatattattgtcatcatcattactataaacatccattcactagtggagtcaacaaaaattttaacacatactaaattttaagtagtttcaaattttatttttaatcataattaattatataagtatatataattattaaaaaaattctttgtcacttaataactacaaattttttttagataatatcttaatcatttacttatcaaagagtgacttcgtcgttatcgtcattaatattattatgatcattattgatattattattgtcaccattcatctaacaatatttttgttgatttcttcatcaccaacaaatacactcttttaataagtttcaaaacttttcaaatgagtttatcttgaaaaaaaaaagagagagagaattaatattaatcaaattttagaaattggttttaaatttttttgggatatccgaccaagcccaatatccgcggctccacgtgtgtcacgactcactcgttcgtgaatcgtgagtgagtgagtggtctgacgctggagtcctactccgtaagtaaaggcgtcacgtaaaaaaaggaaaaactacggaatctatcaatctatctaacttagactaagagtctgagaaaattcaactcacaaggacccgcaaatcttagctacaagaatgacctgttccattttcttgatatctttcagccttttccactcacccctctctttcttacattgaaaaaataaccatgaaaatgaaaggctacctagatgtacatgattatccacccgacccgttcatctcttcctcaatatgacaaacattggttgaaaatgtagcgcagcataattcaaatatttttattccaagaatgttttcacttaattcgtgttctgactctgattcgatttgtggtatgaaacataaaaataaaagttcaatatagttttagtataatttgtgtttttcatatcattttatcaacataatgaacaaaaaaaaccgagtcaaggtttcaccggtaatgttaacgtttattcgtcttttccttgcttcttttgctcgagatagatagatagatcttcagctacctaagcagtaagcaagcacctcatcaaatacttttacaacaattttggctgaagctaaaatcacgtttttggcccacaaaatggggttacacggtatttaaaattattttacaacttttaagattctcaaaattaatttgttataaagaaaaaaaatattaagtttatgcttatagcccttttagtaattttagatataaatgttatatttttaaaaacacgttatattttagataatattttattatacaaattcgctattaacatattatattcaaaatacaaattaattattttaatgtcaacctttgtaacattatttttttaataatgtatttcgaaatgtaaaccagacggaaccttgtttaaattacaaaaattaatcttattttcgtacatattttaatgtaacatatacaagaatgattaatttaaacacacattttaattaaatgtaacagttaaaagttaattctatcaaactttaaaataaacatgcacagtgaaaattattgtgctattaaatctagcagaaacttgcaacaaaagagcaatacatttttatttgttaaaagggaaaaagtaattattccttctgttctagttttattgtttgattgaatatttaaagttaaacaaactttcatcaaaatggaactagaaagcatatataatgctatagacactttacctgaacagctattatatcataattctatactattatgcacgtgttagtgattcggtcagaagttcagaacatcctattcgtggtactctttaaactcctcattatattaaactattttttttaacagcgttatattaaacaggattgacgtgagtctttccatagctcaagtatattgatcaataggtatatatctaattaaagcaagaaaccaaattataaattcatattattaatgagattagatatttgatttcatatattataattaattattgattttgattctaaaaacattaaatatattttcattttttttataatatatatcattcatcttaaaataaatgtcatctttaatatttttacacaatcaagaaaatataataaatgaatgaagtaataaatttacaaaactttaatcttgacccacttgtccaactataaggtccctaattttttggctcgcctaatgagggttcaaaaaaccttcaaaccatttaataagtgacttggatcataacttaaggagttgtccacaaattgtgactattttaaaaatatttgtttttctcaaccatccacaaaaatattttcaacttgacctcaatcacaatatatggaaatcaccctcgaccaaaataatcttaattcaactttgactagagtacgtattttcaactgaatatcaaacaaattaattttaacttgattagtatctttatctaaatctcatttaggacatttttacctcgattatgaccccaaccaatacatttttaattaaacctcaattagagcactttgactcaacctcaatcaagatgtctttagcccaaccttttccaaggcaaagtgtggcattgtggccgaatggttgtagcaaaatggtccttatttgtagcaaaatcaactcgacctcaatcacaatatatggaaatcaccctcgaccaaaataatcttaattcaactttgactagagtacgtatcttcaactgaatctcaaacagattaattttaacttgattagtatctttatctaaacctcatgtaggacattttcaccttgatcatgaccccaaccaatacatttttaattgaaccccaattagaccactttgactcaacctcaatcaaggtgtctttagcccaaccttttccaaggcaaggtgtggtggcattgtggctgaatggttgtagcaaaatggtccttatttgagagccctaatttaagtttcctccctataatcatgaacttactatatctagttttcttttggtggttagtatttggtttggattaaaaaaaccacttagctaaattttggctctgaatttaaacttgtgtacttaccattgaatatgtgtatttagatatgtgtttggcctaaaaagaaagggataggaaaagaaagaggaggcaaatagaattgggaaaggcagggaaaaaaggagaaagaggttattggaaagtgaaagtggaagggaaaaaaaattagggattaaaataaaaactggaacatttagtaaaactataacttaaactgtgtaaaatgttgtgtcatgagtttgtggtcacatgatatgcaaagattgttaagttaattaatttatgacaagtatatcgaccatacaagtaatatattaacaagtacatatacatatagttctcacaaagactgttgcaatgtcttattctcaaaacatgtagatgtcccctatattgagcgttgagttcaacttatatagcagcgtaataaatttcaactccattaattaatgttaccaacacctactgcaacatattagaattttctcagcagtactctatgttgggatcaatgttttaagcattagccccaaagtatcaaatttgattatctaaccctaaaataatggtaaccctagctagttcctacatatcacaaaccctaggttagttgaccttacacacttgggttggctcaagcataaggcgatcgacaaaaaaaaaaaaagaagagttatttagaattaacatttatacaaaatttataattttataattagatggtctagtttaatggtaagttggtaattaaggtttgtttttcatcagtgaatgggctttgaacccgaaggaaatttacttttgttttttgtaacacctctattttttttaagacctctacattttttggccttcaaaattaattagtcatgaaattcaatttaattaataggctgtttattaatatatcaatcctcaccaaactacttcatcaattattgttattaattagtgtttttgttaaaaaaaatattattgttagttttaataaaacgccaccttaaatttgttttaagcctggaaatatattaggtcatccttagcttgttacacaattattagcacacttttccttttatcagtccattatgtagcacacttataaattggactttaacccaatatatattcatataacaatatagataataatatgaatgtctaaacaaaacatccatattatctatttaacctgctttataaaaataaatccaccagtcaaggacggattcaaattgagctttgtgaggatagctacaccgacaagtttttttatctgttttttttttaatataatgtatatgtataattacaaactatttctataatttaaaatgtaataaaagacaatgcataatataatttttttatattttattttatgtaactgagaggtatttgttatcggttgacactcagatcccataaaattcattcattttgggtaaagtaatatttgtagttatgagtgtttatgttcaagttataaatcaaactctaaaactcagttaattaaaagaccaaaatgtcaaactccttataccaataattttggtttttctcattcatttcaggagtgtactgaccatttgattgtaaaacagaactgtcaaggacttctgcgcgcagtaaatatgtttttgcaaaatatctacatttttttgccactaatgatgcatcagacaaaagcttaatttggcttttaacgtaaggatcgtgtggctctgttgctttgcgcagttaaaagtgaaacttaattaaaagcatccctagcttatctttctatgtgtgagtaaaagtcccaacaaaaatgtgacgaataagtaaacgctatcatacttgcatagttgcatagcagggatatgcagatggacgttgatgttattccacttaatataatgattggcttctcatactattgctattgaatatggaattcgcatgaacttaatctgtataaaaccaaaaaataaataaattacaaagactaggaatacttcacattttttactaaaagttttagtcactaaagacagtgtcgaatttttaaaaatttaagttgtagaagtaatatttgtacataaaaatatgtgaaatattataaactgatctatttaatggtatttgaaattatgagaagaatgtataataattttaaaatcttgtaggtatagatagctgcccaaaaagggacaacgtcgattcgtccctgctgagggcatgctgaagctaattaaggtcttgggttcattattcaatttttgttactgtaaccttattaattaatcttatactattaataagcatagtattatccaataatgtttactttcattaacaagaaacaaattcatatatcaaaaaaatgtgattatgtagatttaatttttacgcttaattcgatccccttgcattggtggtctctctcttccctcatcgcatgcgcttgacttcaaccagggtttaagcctttgatgttaaattttattaatgagtaatatgtaaatatttctgtaaacattttttaaactttaaggtctattttaatttcaataaactcttaggatataactcattttaaatatttgatatctttttctttaaatgagatctcaattttttataataattttattaaatatcttacaactataatgtttttttctatccaaattcatctaaacttttttttttctaaaaataaaacacatggtatgtttaaataatataaccacaaaaatgacacgtagaaagagataaaaaaaaaactagagtgttggaaagaaaccaattgcgtatctccaactttgtgtaagcagatgtcacaatcgactttgaggaatttacatggatgccaccaagggcaagaaactgttgagcgttctgggtcggagcaataaaacgttgggtatgcgtgtgtcgttttcctctgagagcgaccaatagaaaaagtgccgtcaagtcccatcaaggaactcttttctcttattggacctacctttttcttttcttttcctcgcccatcggatgccattcatccttcgttttcgtacactgaacactcgttttctgtccgtaggatcaacgtctttgcgtcactgcgtttatcttcctacttcaatttcaaaaaaaatatcattttggcttaagtttttcttttctctcagaagattttttttcttatatttcaaatcttatacaaatatatttcatctctgatttattagaagatatatttttatagtcattaattattaattactatcacttttgttttttttatatgatgatgcattacagaattatgttaggtcacgtgttgataattaatgtattatatcacatggaatttatgtgaggactgaaattaaaaaataataataaattaagaacgaaatgaaaaatatatatatatatatatatgagaatttatgaaattaattttttaagataaataagatatttaaactaattatatataggttgctctttgtttttaaatgtaaaataaaagaatttgagtatggaagtatttggtttaatttatttaaaaatatattttaatcaaatttttaaaagatttaaaaaagcaaatattttaagtcaattaacatatatttcattacatgttgatatgtcacaattaagaatagaatagaagtagacacaattttctaataatgacgtatgacttagccaacatcaaattattcaggcaaactcagactttttcaaaagtagattggacttcgacttcggtaaaaatctatttgattaaaaatgtcatccttttgagcctaataaatcggcctatttaaataaatataaattataataatttgtttagtattattattatattaaaattataatagatttatgctttatttagacaacttacaaaataggttttttaacaagttattttaaaggtgataaacttatattattgtggtagacttgtctcttataaaacttaattaacttatttttacctttatcttattgagtaacaacaactttgatttttgtataaattatagtttggttcacatcaaattttttttaataatttatgagtttgttgtctaatgtaaagagaagttagatatatataaaaatttgaatatgaaaaaagtcttttaagtaaattaacatgttaaattagacttttaaatagtccatattagacctaaaaataaatcatatatcaagtaataagtcatgttggatcaaatcttgagttttttaaatagacttaatttaatctatctaataaaaatcttattcgacctaacatattttcactcctagttataataagctaaaaattcatttaatatgaatttatgaaggtaatatgtaaaaaaaacatgagaatactttttaatcacatgttatattttaacttttttaaaaaagaagggcataaaatcaaaatataatttcaaaatatttatcaaaataaaataaaatcaaaatttattacatgattagatgtttttaatttttttaatcctttttagctgtgagtcttgttcgttgcaccttcgagcaagactagggccaaccctgttattaattataactcaaataatatacaaatatactaaataagaaatgtaaactaagaaacttaagaactaattaaattatactttaataaattgtgtcgttttatctttatttttttattgttatattgtcaataattataagaaatacgtgtnnnnnnnnnnataactcaaataatatacaaatatactaaataagaaatgtaaactaagaaacttgagaactaattaaattatgcttttaataatttgtgtcgttttatctttatttttttattgttatattgtcaataattataagaaatacgtgtgaaaataaaatcttgtttacacagggcagagagagattatataagtgtagattacactaagtcattgattattatgccnggaaaagtatttattaatctgtatatattctcaaagtatgtcttacatagggatgtttagttgaattagttaaataatgtgtataaattattataaacatcgagtaccttagtttaatttctacgataagaaaatgtcttacattaattttgatgtacatatattaatccacaaaaacaaatctattaattaaataattaatattaattcaaatgaggagtctctatgattatattagataattgatattaataaactaaaatttaatctaataactagataatattaatccaccaaatttcagcaaatcctacctaaattcaacgaagattagctcgtgtccaatagattgtgtatactagagagtagagaaggcaaaacacttagatttttttgttggttgggtaattttcagaattccaaaaatagacccaatacaattatttgttaataaactaattaatttatttgatttttcgttttaattagattgtttgaattttgaaccctcagtgatttaatttaagaataagtggaatgaaataaaatatatactcgagaaatcaccttaatatggttacatacatacgagactgctaaatttagaaatcacatgggttagttccatgccacattaggcttaagcctaataacttacaagtccacatctaattaaagataatttggttttgtaggtaaggtttagctagttattaattaattggagacaaatctggagaaaaaagaatttaatagtttggtaagagctaggatattgttgaatttgataaaactttcattggttatattttattctgtatggattggaattagtctttaacttcttcaatacttagctcaatagctggatttgtatgcgggttatacttcatgagttgatccatttaatccatagttcacgtgaatctgtccatttaaattcgactttataggattaagattttggtatgcagatgtgttaaacatttagagaaagaaccttgtcaactataatgatcttatctgattactttttatagataatacatattgtttagacaaaaataaataaattaataaacaaaaattaaaacttagttgaaagtgttttccaaacataaccttaatatctaaatatttttaaatagttaccaagaataattggctatataaagtacttacaaccaagtgctaatgcatattttgaaataataagagattaaaaaattatctacaaaataattacattgacatgcatttattttgagtgagcctcacagaatccctcgaagccaaacttaattacattaacatgcatctttttaccctaaagagtaaaataaggaaggctgttgttcttacaagtcatttggaatccctcacttagttctttttttaaggtgagctcctctgtttctatagtgtgtgaagatggtcctatcgtactacaaaggtcctatgtgtactaaggtggggaaggagtttttgcgatgccatgagaatcctttcgaagtaagggttgcgatccttgttgtaactgtcatattgggaatcttgtgtgtttatcgaattaccgagagtgatctaaggttattctttacggtgtgtgttcttaggattttgtttgcccttacactgaccaatcgaggttttgtccatcacaactatatatgttaggataaaagttgaaaaaaatacttttgtaaattctaatgcacaaatttgaatcataatatgcaaaatgaagaagaaagaatttgttgcttcatgagtaaaaatactttttgagttgtcaaactaaaattcaaacatgcacgaagtatttagatatgaataatcataccagaatgttatctaatatataaataaaaataatttttgagatgtccaactaaaatccaaatatgttcctatattgtattcacataatatattttttatgagtaagcacaccaggatgctattaacatatttttttattagttagttaaagttagttaaaaactataaaattacaaataaaaagtctaatctacacaaaatttaatttttttggtaaaatttaaaaaaataataaagtgttttttagaaaattttggttgagaattaatatatatttctccatactttgtatatcaaaggtgagcataagagttgttgaatcaagttatgtttgaccctaattcgtctttaaccctttgtttggatgccaaaaaataaggaaatcaaaggaaaaattttcaaaatttagtatagatcccacactctcattactctactttaagagaagaccaagttgacatgaactataagtaacacaagttcctgttattttaattggaatttcaagaataatttgtatctcatcattatacataatattatgtaaatttaatgatagttgcttataaaccatagaaaaaatgtttttggcatcagtatgaaaaaatatagacaaagtaaattaataggctagagtttttttttgtctagaaaaattctggggatggaatgataacttagtccaagataaagaaagtctctggattcagaaaacacttacagaattatttatatttattttatcccaaaaagataggtgagtatttgaatatatgatctgttagatgtgagactttgttttgcttcactctatcaaaccttgagattatagtttagaatttttcaacaaataaaaagaatagacggaaaaaatataataatgactaataaaattaggagttgagcaaataatagattaagccgagatatatttaattataactcgttcctaaagttttactggaccaatttttagattctaaccatttttaaacccgaataaattggataatctactattggattgtgttttgcacaatcctagtaaacattgctctttcggcttgatcgacataacggttaaaaagaagcagtaacattatagattatgtattcaatatttcccctatgttttttactttttactttttatcaccatatgttgcatgatattaatatattcatgggcagatctagcttatgatttcaggggacagggtctctccttaagtctttccaataaattttaatatacttttaacatttgtttctctttaaatctttccaataaattttaatatatttttaacatttatttgtaatatttgttaattatttttattgcttattatatagtttgcggtgttgttaattatttttatgcataattcataccttaacacttatttataagataattaaagtctttactcttctttgaaatgagaagtacagtttaatcatatgcattttataaaaatattttagcatatattacaataattaatgttgaaagatctcaaactcaatacttatatctaaactaattttcatattatcattataatcttttgaaatcttatcataaattacaataaatttctttaaatattctattcaatctaaaataataatttgatataattatttatttatttttttagattataatttataattatttattcttttaaattttctttataaaaaaaaatttcagaaatactagcccccaacccaccatcaaatcaaatgtacaaacaaataaattttcctaatcctatcaccaatgccccctgattatttttctaaatccgcgtgattatacttgagaaatgatcattttcatgaagcacagatgccttgacactttttgactttgttgcctattgcttattgggaatcgagagttcagtttgagtccccagttggaccagataattgtgcttgacagaaataaaaaaaaaataaaaccattacatctgcaaacatcccaattctacctttgcatgagtgcttctcgaacaagttgccttgcaatgatgctttaagatcctgaacatgctattgctagtttgctactacttccttatccttccatgcatgttaaatcacccccctagtggccagctacaagttttcttctcccttcataattaatactacattaatgccatcataaaaattaataatatcattcataatttcttttttgtttccatcggacctgaggccatattcatactgtgtttgatcttgactcaaaatgcttgattagtttgagttgcaagtattgaccaaaattcaataccttgatacatccattttaatatgtatttgtgtgattaataaattacatcttgattcagaattaaattacttttacttttggtgggagaattaaattactttattgttatacaaagataaaatatcactgttatttttggtgggggaattaagcaataccttcggtgtggcacataaaaacaattatttaattcattaacatcgataaaaataattatatttattgatttataataaattttaattttattttaagattatttatgatattaaataatttaaaataattttatgaaaaaaatataaatttataatttttttacattgtcatttactatgtatagtaacttatttgacaattatagtaataattatcttaacaattatacctaataatttatgtttagatgaaaatgacttaattattaatttgattctcaaattatttaaaaaaatacaatttgatttctaaattttaaaaaggtttaatttgatcatcaagttctcaaaaatgaattaatttgatctctgaattcgattattgaatttgaacaagattaaattgaatcattttaaataatatgaagatcaaattgatttatttttaaaaaaattgaagatcaaattgaaccttttaaaattttaaagactaaatttaacttttaaaaaattagagaacaaattgtcatttaaaataatttgagacaaacatgataattaaacatattataattttttttagaatgtcagtaaataattacttcattgttagcttaaacataaaaatatattttataattaaactcacttctcccaatgtctcaaccttgtgnttaatttatgacatcaatgaaaataccatgataaaagttgtttcgtaaagtcagtctataatagtttcttatactatgttttaagaccgataattataggaattagatgtacaaatcatttactccatttttgttttacacaacttaaacaatcttctgtaaagaaagtaacacacttataacctgagaaattaaagtgaaaatttactcttacagcattaatagtagtaatttttggttacattagaatcgattaattcagcaaatcagtaaccgtcattttcacattaaaaagggagaaaataattgcacgagggcagctgtagtaaaaatcactgatgtattttcacattaatttcttttccctcgttgattgtctgaaaccgtggacactcaaaaggtcatatcgcattcacatgatgtattaattaatatactaaattataaatactgtataaagcaaaaatgcgaaaaatagtgaaatgaaatgaaatcttctctctctctttctttctttctctccctagaaaagataaatcatcatctgacacagggacacactctctttctcctccttaaaaaacacccaaaaacaatggtggttctgtcttcattcgctcaagcatagaaagagaaaaagcaacagtagcacgaccatagtcgccgccgaaactgctacccattttccattattgttgcttagaaaaagaaaagaaaaaaaaacccgacccgttttcttttttttaaagaaaaaaaactctaaaggtgttgtatcacactgttttcttgtcccttccgtgaaaaaggaacacgtacctacgtttgtaaccgtggtcgttttccgttgcaacgtttgcttcggttttttgtgctgtggagtgagtgcttgtgctgattcccaagtccattttgcgcctttttcccggctttgcttgagatccggtaccctttgggatttgtagctcctttcgctgagatctgtttcgttttggagtttcttcgcttgtttgtcttttcacgttgttgccaaaatttgttggtgatatagaaaaagggtaaaaagaaggtgctggagcgtgttacttgctattggtggttcaagcgttgttgtatgatgaagtgttgggttgaagatttgaactctgggtggtgggggttgaggagggttagaagcgaatgaagggtaggagtagaacaattgtgttctgttgtgacactggtattggttgaggattgaaaagaaggtgggaattttctgagttccttagcttttctcgttgatggttgagggaatttggcatctggggtgtttgagttttgtttagaatcatttgggttttggttggtgaagggggggtaaaggtaaaagaagaatggtattgtggagtagggaggaagagaagaaagggattgttgtttggtttggggtggaagttgggggaattctgttgctgctaaattggtctacttaagagtttgcttgaatcattgattttggggctgggtttaaggtttgaaattgctgaaactttgcttagatgaaactttcttcagcgggttttagtcctccaccccaggaaggtatgtgtactcttgtttgcatattcttcttccatttcctctccctttttattctccatttctatttttggggaactagttatttcatcctcagtcctatgggatatgtactcccgtggttttttttttttgaggttgggatgtggaatttgacctcttgtggctacagtttctgttctctctcatgtagctcagagatcagaaaaggaatttggttaaatttgctgagcaccctcctctttcctttgttgttttgagatcttggctctgccataatcattttgtcctctgaggcatttaagggggcagttatgagctttctattgcatattcatgacattgggatggggttttgcaggagaaaagcgagtcctagattcagaactttggcatgcttgtgctggtcctcttgtttctttaccagctgttggaagccgagtggtatactttccacaaggtcacagtgaacaggtaagttagattatagcttccagagagaaatccttgtggtagctatctggattttcttttactatagtatgtgtaaattgtaaagtaataaaacgaatcttcaaatcctggacctgaagatgctgttttggttacttgccttctatattgtgacatgaattggttcttagccatgcctctttggtctctaatgtaagggtgggttacatctacactcttataacaaaaactggctttgttctttcactatgttgacccttgtgtatagcttacctcacttttaagcacaattcattagtcttaaactgttgcagtttaatgaatttgctcttagaagttagaaataaaatatctccacctaccaccctgaaaccagcacctgaactttttacattttataacatatattctttttctgcataagctacatgcatatgcataaggtaatcagcatttttcttcttaggttgctgtgtctaccaacagggaagtggatggccatatacctaactatccaagcttaccaccgcagcttatttgtcaacttcataatgtgactatgcatgtaaggctggtttatttatttattcttttttacaaaaataagcttgtttattttggtttccttctttcaaattctcgcatatgctgatttctgcactctctttttctttaactatttgttcatttcttttggattcaggcagatactgagacagatgaagtgtatgctcagatgaccttgcaacctcttaatcctgtatgattccctttcttaactgataactagttgtttgagttttatgtttatattctaatatcaacttttggctatgcctgtgttttcagcaagagcagaaggaggcataccttccagctgagttgggcaccccaagtaaacagccaacaaactacttctgcaaaattttgacagccagtgacactagcactcatgggggattctctgttcctcgcagggcagctgaaaaagtttttcctccattggtaaagtattgttatattgtcatgctctaaaattttttgacttgttttcattaaatttatgaatttctttaacttcatgattgtgacctacaggacttttcacaacagcctccttgtcaagagttaattgcaagggatttgcatggtaatgagtggaaatttagacatatcttccgtggtgagtcataaagctctttttaattgcaaatgtagtatttgttttttattttttagttaattaatttatttttacttcagtacatttctaactgggtgctgaaaataagttcactttccatttacaatgtttgagtttggtgttttttttctttttttttctgtaggccagcccaaaaggcatctacttacaacaggatggagtgtctttgtgagtgctaaaagacttgttgccggtgattcagtgctgtttatctggtaagtaattttctgctcctctctttccaagtttttcatcgtgtatattgaaattggcctttggcagttatgtgactaactgactgacttgtctccctaaatcaagccatgtgatttttatgtcttttggccattcagaagaatataggggaatgtttttattgacatgtttcatgtattgtaatatttttatcagtttatattttgaggcagggatccatattgggctgctattgaagtatggtcttcctgtttattgtgatttcttgatggttcaggcttcctgtttattttgatgtccagatggttcaggctttatgagagttgttgtttcttatttctcctagctacttgcttttccatatagactttgatgatattatgttgagcatagttactttcattattaattatctaataactggtctaataaaaatgtattttattcaacaggaatgaaaagaatcaattgcttcttggcattcggcgggctaatcgacctcaaccagtgatgccttcatcagtgttgtcaagtgatagcatgcacttggggcttcttgctgctgcagctcatgcagctgcaactaatagtcgttttaccatcttttataacccacggtacaactgcatacattagtatagtttcaagttatatgatatattgcttaaattgacaaccttttttttccaattcagtactagcccatcagaatttgtcataccttttgcaaagtatgttaaagctgtgtatcatactcgagtttcagttggtatgcgcttcagaatgctgtttgaaacagaggaatccagtgtgcgtcggtaggtttttgaaacttgttgaaaatgatagtggaaatgctttcctttatattctggacattttggtaaattgagtctatatgcaatatgattttaaaaaatcaaacatggcttaaatttcaaaattaatataggccatagcctacatctgtagaagaattctgggtttgtgtggaatatgagtgattgctgtgattttcttgtgaggtgcttttaatctcatgttgttatgcatggtatatttggggaccaaacatgctaggaggctaggagccgtggaaaacattaatctggtcattatgcacttgtgtgataaatattaaattaattaatttcattttgtgcttatcttgataaacaaatgcaactttattctaagtgttacaacatgtataatgtttgactctaaaaataagaggatattcatatcttgtgtcccgtggcatatcaaatataggtgcatggcatcataaagtacgattgtttatcagtacttaaattcaatgcaacatatacatttttaattaatttgtcttgacatgttacaaatcaattgcctgagtaccactttgccttttatttattttttaatgatggtctgtaatttgttgcaatgagatgaactggagacattaatttgaatgtattattattctgatcctcaataatgctgtagcatatcaactaatgctcagtcagtttgtagagttggtgatacatgtttgttctgctaatttgtttatgtatatactcatgcagatacatgggcacaataactggcattagtgacttggattctgtccggtggccaaattcacattggcactcagtcaaggtttgtttgtaaacatttatgatatctcattgatgttatataatttatattgaatgttaattgtatcttcagaagtaatattagtaatatctttcttgggaaacattttgtctcattaaggattgaggaaggattttaaaaatggcatttatttgagttgtaggttggctgggatgaatccacagcaggagagaggcaacctcgagtgtctttatgggaaattgagccattaacaacatttccaatgtatccatctccattcccccttaggcttaagagaccatggcctccaggactgtcttcattccatggtatgcttgttaccacacgtgagctgaaaatattcatgagaattcagttttacatttttaagtcaatttcatttatgcatcaatggaaactcattctcattgtctatcccctgtggattgtagcaggcttgaaggatgatgattttggtataaattcttcactaatgtggcttcgagacacagacagaggtcttccatctcttaattttcaggggattggtgctagtccttggatgcagccaaggcttgatccatcaatggtgaattatcaatcagatatgtaccaagctatggctgccgctgcacttcaggatatgtggacttcagatctttccaaacagcatcctacgtcctcgattcaatttcagcaaccgcagaacttccccaacaggacttctgccttaatgcaaactcaaatgttgcagcagtctcaacctcagcaggcttttccagatagtcaagaaaatccacatccatctccatctccatctcaatctcaggctcaaactcaaacaaactttcggcagcatctacagcatcagcacttattcaataatcagaatcagcatcatcttctgcagcggcagcaacaatcgcaattgcaacagcaacaagtggtagatcatcagcagatttcaagtgccgtctctacaatgtctcagtttgtttcagcacctcagtctcaatcactacccatgcaagctatctcttcacttggccatcagcaaagcttttctgattcaaatgggaaccctgtgactactgctattgtttctcccctgcatagtatattgggttcatttccccaggatgacacatctcaccttctcaacctttctagatccacctcttgggttcctgttcaacatttaactgcatggccgccctctaagcgtgttgcggtggaccctctcctttcttctggagcatctcaatgtgttcttcctcaagtggagcagttagggcagccacagagtaccatgggtcaaagtggcattgcattgccaccctttcctggtagggagtgtacaatagaaggaagcaatgatccacaaaatcatcttttgtttggtgtcaatatagagccctcatcactcctaatgcataatgggatgtcaagtcttaagggaattaatggcaacagtgactcacccaccataccttttcaatcgtctaattacctgaacaccacagtacctgattcttcattgaatcctggaatgacacacaatattggtgaatcgggcttcttgcaaactccagaaaatgggggacaaggaaacccatctaacaaaacctttgtgaaggtgagcttatccagtgggagtattctctttcaaattaagcatttttagttttttctcattactatgtcgtgattgattcacaataaaatttgacgtgttcaaaagtcttgcattttcatgtgatgtttttttttaacaggtttacaagtcagggtccttcggaagatccttggacatcactaaattcaccagctaccctgagctacgcagtgagcttgctcgaatgtttggcctggaaggtgagttggaggaccctgtgagatcaggctggcagcttgtattcgttgaccaagagaatgacgttcttctccttggtgatggcccatggccgtaagtattctttgttccttttctttctaaatgaaattccatgccacttcagaataactgggttacatattcttcgttgtgtaccgtgagttcttatccttatggttcacagcttgtatattctggatttcatttctgccaatagtttttgttagagcaaatgaccaattgatcaggcttcttttcttacgtctttcattccatatctttggtgtgacagggaatttgtaaatagtgtagggtgcatcaagatactttcccctcaggaagtgcagcaaatgggtaacaatggtcttgagcttcttaacttggtccccattcagaggctctctaacggcatctgtgacgactatgcaggtcgggaggacccaagaaatttaagcactgggataacaactgtggggtctttaaactactgaatgatgtaacaatcaatactatgaatctctctctctcttgtattattacttctacttctccaccctttgtcaatggtgggaagtattgcttagttgtagttaataggctacttattagccttttgttttttgtctgttttcctgttttttgctgcctaggaccattcataagataaacaatgtaaccatatggcatcttgtcaatgtgctatctacaatatattgattacttaatctgttaggagttcaatgcccgaagagtgaagatagctctctctccctatccatggttatattgttactttattttaagcttggccataagatcattgggggtatgtatttgaccaagagtatacttagcaattgaattcattggtagagtgtctttcatgcatggagataaagttgatgataaaatccaatgggtgttgttcagttaacaactcacaatctccacaacatacactctttggcattggtgagagttttaagtataattaagttgtgattgataattagttttatagtcagtctaaagactcaaagtttgtgaaaatattttgagaaattgttatggagtctaaagttctaattaccgtgttattaaaagaaaaataaagtggatgataatacaagaaaattgcattgtaggacttacttgagctttttgataactaagcattttgggaaagattgatgtgacacctagaacatgatgaggacaccaaaaccatgtgatgtgtctctcttaacataacaggacggtgaacagatcactttgtgcttccattaatgtgaaagtggcctgttttgtattcttcttggttttggccatgcaccttttcactttaacttgtgatggatttgcttcatgaatggcaaagatgaaagatgtacatttgtacatttggatcttgttcattccttcacattctaatactaagtatttggaatcttaaacctaaaagcatccgaattccgtgccacctctaaggtatcctttcttgggaggttgacaatttgtttcttaatgatggtagttggctcatggctggcttcaaaatcacttacgtaactttgagggacaggaacggtgctaattgaaacagctaaggtgaactcaataaaatcttcacctagaaagtatagttttggttatgataatatatcatgttcagattccccaacacaatagcttaactgatatgaggaggcagaagagaaaggtaatatgcacatattgacaccattttgagaaagttgtatgctagttattaaatagtattacatacataataataaatattaaatgtagtggttggttataaacaaacacctaatccctaataatttgttaaaagtgacttggcctgtaaaaaaaaaatgcattgtcgtttattatgcgaggagaaatattaaattcaccttaaaatttaagaagcaattttgtcatccttataatttattatcctttaataacatgtgagagtgttgtacacaaatttaggataaatatttattttcatccttgaatttattaggtgttgatagttaggtccatgaaagatgaaaatttaaaaggttaaatgatcattttcgtccttgaatgtatataacattgacaaatttgtttctaaaagatgaaaattcaaattttaatatccagaaagtaataaaagtgcgacaaatctattcatccgttaacttttatttgctaacgttaatgaaagagctacgtgacacattcaatgacgaatttgtcagcgttctacacatctagagacgaaaatgtctatttatccaaaatataatttaattttcatttttcccttttctaatcattgtaaacataacaaataacaataaacacttaaaaaaataggaaaacaaacataagttagaacaaacacaataataaacataatattgattaataagaattatgtgcctattgttctgaaattttatattgtgacaatattaagtagtgacaaaatcaaattgaatctcaatttaaaaaaaaattaataactatacatttttatttgaatctcaatcatttgtaccaaatattaagttcatcgtggcacacgatcttaaacaaattaaacggctctgaatacttaaaacattcggaataccatgaagacacatttttctcctttctcctgacttgtgtttgtggtaggaagcatataaaaataatccagacatgctgctattttttttttgataaaaaactcaattgcggcacatagaatcctctccgacagtactgtttggcaaacatctttggtttcgaatctcactcgaaaatcaattatggtaagtagacttcatttagagaaaagcgaaaatattacacatctatattcacactaaaaaataaaaactgattctactttattactaaaattaaccttttaactcgtttttaaaacgtcctttctgaagaatacaaaccatggccatttttataattttaattcttttaacattaattctttcatattctattgaattataaaacaagcgcactctaaacgaacgaactaattagtttaatttgtaaagttggaaaagttatagttggatcgcatggcaataatagttatcaggatggcgttagcaattattcctggggtcacatataaagaaaaaatatccgagtgaaacacaaaaaagaaataattatagataaataattaaattttaaaagatgatgtaagcaaaatgttgttttattaaaaaaaagaaaatcataataattttttcctacaagaatacttttttaggaggtacgaagataatgctatcccaatatttttgaatacaacgatctatcttttcgtttcttagaataagtcataataaaggaaaatgtttttcatacaatagaaatggaataactattgtattttttgttattttaaggaaatatttataaagcttgttgttgcgtcaaaaacttgacgtgtaactcacgataagtgtgtactaatgttcaagtagtaacatgataaatagagtatcgttttcacgatgattgagacactaattttattgtaattattatttttaaattggaaagaataaaaataaagtaatttgtgatttgtgttgtgaattgaaggaattaaaataatagaattaaattacaattaaaagtaaagataagattgatgatgatttcagaatttatgaagaagaattgtggtgaaagcgcaatcacctctattccctactcatgtaattgaatggataattaatcgctttcagaaactaaaaccccaatatctctattgtgaattctagccctgagaactcttaatagattgataagtctatcaatgacaatcagaattaaataacaagataaagtgaaacaattataaaaagcttcattaatatcaattcaatccacacaagagttcacattgacttatggcctcaccacaatcaaagaagaattagccagacatagttatgtctgactcaatacaatgatgataaagaagatgagaaaaaaatacaaagaaaaagagtaatcaaacccctcgatcctgaccttcttcttgatcttcctaatttcttgatttccttcaatgcctcctttttatgtttttgcctgtgtttctgtgtgtttcctattactttcctatttatagtcaagtttgtaaaatcctaatatcttttattcttatcctatctgtaagctgattttgaatttccagaattgcttggctctttattttgtttcttttcttctatttcctgctcttagacattaaaataacaataattaataataaaattaatgataaaacaatttatatctattttaagtctttatttgatattttatgtttaatttcttaattattttatcctaaaaactacatttgctagcatcatatcacttgtacattaaaaaaaaagaaaaaaaagtgaaaaaaaaacaataactatatacagtttaaaaacctaccaattactttatgtttaaaaaattataaaacgcatgtattcgatcttatgattcattttatcaatttaaactgttaatagtagttaacagtaatcagtcgtagaaagtaaattataattttagataaactttagttatgatattatgattcggttacggaaagtatgacgactctaaaacactcttatactaaaaatatagccagtcaaaaagctcaaatctaggatttttgtcctgcatgagaactagctaaggcaaacaaggtgtccttttaagctgtggcactatagctatcgatgcactgggattgggtggataaagttggacttgtgagtgttggtttaattgagcaatttttagatgcatgttgtggggttgcctaatttatgacctttttttttctgggtatggaatggtgacaaggtaagacactatccaccataataataccaatgagaataggtagggttggcaatccaacaaccctagcccacctttattgttgatcataacttacactctatcttaaatctcacgactttcttatctctctcttccatttttcttgagtactctagtttatggcatttctccatcacccacgacatgatcaaaaaggttgtagcaaactggcaaccttgtataagaagtgcatggatgtgtcgttagttgtttccaccataattgatttataataatatacagcgagggtacgtatcaaattactctcttggtaaaattattctctttcaaaactttagttacatatttaattttcttgatccaatgttaaatttatagttttggttaagtgatcaagtctaggaatttttatacatttttaaaattatttgatacttcgctaaataaatttaatttaacatgcaatatatttttaaaaaatatataagtaaatattgactataagattatgtaactataaaagtctgattatctaaataaaaattagttttcataaaatcacgatcattaaattatcaatatcaaaatatttaattaaaatttaatatattatataactgtacatgtttgatttatctaaaatttagtgtgtatgattgttgaattaatatcaaaatattcaatacttagattaataaattttaatgaatacaaagagtaattgaagtgagtaattttattaaaaaaatattcttagactaaattaaccccttctcatcatatatgtacatataaactttttttattatgagaaatgaaaactaaatatttgagtcatgtaattatatacaaataatgaagcttaaaacttaataaaagtcacatgaccactcttaaaaaaagtcatgtacattttttcttaatcttaatcattcaattataatctaatgatctgtatttgtagtactcatttctcacattaaaataaaataattttgatttgaaatttaaggattttgattattttacacacctttatctgagatggtcactactagaaaataagcttttaacatcgccctcttaacatcggttatgaagaaaaccgatgttacaaaatacgcgatggcatttttgtaaataaaatgccatcgttaacatcggttttttctaaaaccgatgttaacataacaattttaacatcggttattttaaaaccgatgttggctaagcaatcaagatgattataacatcggttatttaaaagaccgatgttgtctaaacacttacaacatcggttatttaaaaaccaaaataaccgatgttgtctaaatactcacaacaccggtttttaaaaagaaccgacgttgttgttattattcacgcgtgcgcttttagagtactgccctcaccttttgtcttcccgaacattcactcactttcttattgttaagtttttcctcctctctctctgctcccccatttctatttttccattcatcatcatgtatgttttctctcttggtttttctctttatttatttttccactttcatttttttattttccaattttgtggatttattannnnnnnnnnagtttgcgtcttttgctcttcgaatctggttttgccttttggaagtaaaggatgcatttttttccttttaaggttgagttgtttattagagtttggatatttgtatttggccttttggaagtaaaagatacatcttatttatttaggtttgttttaagtttcaatgtaggtctgtgcccacgtccaaactgaaggtgcaatggtgcttttagaagatcctaaaatttggtgggttcatgtgcgaggaagccatctatattctggtactgattgnnnnnnnnnncctccgtcagccacagaatcgccgcaaactctcttcgatctcttcaccttcctcttgaatccactgatgcccctctatgcgttgtcgctacttcctctcaccaaacccttcactctctcgccgtcaatcatagatctctctggtgttttgagttcgagaaggtgtgacttgataatttctactcgtgtttgttggtgacgtcgagcgtgtggagcatcattggaaacagcacagcctctgcgatgacaatctcgaagggctttcattggaacagaattctgtagtttgcgtcttttgctcttcgaatctggttttgccttttggaagtaaaggatgcatttttttccttttaaggttgagttgtttattagagtttggatatttgtatttggccttttggaagtaaaagatacatcttatttatttaggtttgttttaagtttcaatgtaggtctgtgcccacgtccaaactgaaggtgcaatggtgcttttagaagatcctaaaatttggtgggttcatgtgcgaggaagccatctatattctggtactgattgcgttattttaacttgttgtgctttgttcatttgctttcatctagatgaaggatggaaaggatggtgctagttcgatgggttcttgaaagacgttattcagatggtgaagcctgcgaagggtactaatactcttgcttttatatttaaggagggtgttatggtagctgctgattctcgagctagcatgggaggatacatatgtcagtgtttgttagattttaatttcatttttcattgttttttgttcctttggctgaggcagagtttttctttttttgtgctaattgctgcaaattaaatgatgggttttatctatttacattgtgtttgatcttgaattctgactgttggccttctccagcatcgcagtctgtgaagaaaattatcgaaatcaatccatatatgcttgggacaatggttggtggtgctgctgattgtcagttttggcacaggaatcttgggattaaggtaatatatgcaaccttgaacctacagtctcctgccaaattgctgcgatagtctcccacaccttgtcattccttgcaattattattattgaatattgatgttgttttagttgagttggtaagatttacctctttgaagtacatttatactcattgcctaaaaattatttgtccataggcaacatcttagcctgtgttttggaagcaaataaggagtgaaagagagtgaatggaatggaaattgaactatgggagagtagtctggtgtcttgtttggattgccatgtaaatggtgggaatgaaaatgataaggaaaataattatgttttgcttgggaaaaatgaaataagttgtgaagaagactatgataattaaaatccagatatatcctttatttaagatgaatttgttgagaaggatggttatgcaattcagaatttcagatataatctctttcccatgtataaagtgtggagaattttacatctaattttcatttacttagtattctttctacctatatccaattaattttttctaatttataatataaccttccattatttttccattgataacatctagattggtgctaggaatgccatttaattgccatttgttgttggataggttgcttttgaatgtactaggtttcattctgtcatttttattctacctggtataagcattccagattatggatacgtagtttgggtcatagtgtcgtttgcatgaattggcaaataaaaggagaatttcagttacaggagcctcaaagctacttgccaatattttatagtcttatcgtggaatggggttatctgttggtaccatgattgttggatgggatgaaacggtaattcacacgacaaagtgctaaacaactttttctcagctagtgcaattcttacttacaacatttaatctcttttttagggccctggtctatattatgttgatagtgaaggaggaagactcaaaggcactagattcttggttggatctggttcaccatatgcttatggtgtatgggacagcgggttagttaaactttttaaattgccacaatttcagtccactgttgtttggtttaaatattgaaagtggcttcttttgctaggtcttttgtcacttaaatcaatttatagccccatggttaggtgcctcataccttgtgttagtgctgcattgcttgatcaatattttcccttttattggctaaaccctgacgtgaaagttggttggcttagatgataatatactataaaatgtgctgcttaaaatagagtaatatatgcttacaataaattaattatttaatatgcttaaataatgaaataaatttattattattattcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattattattcggtaatatacattagtattccaaaatgtttccattcttttttctatattagataggtttcaatgtttataatgtcatttaaaaatttattcaataataattcttggtaattttttttttttacatttagattcatggtcaaatatttgttttgaacgaattcaattatatttaatttttgaagaaaaaaaatctgattattaagtgtatttgacatcaaatttatctttattaattggcaattataaaattaaaaatttaaaatttgttgtaataaattgaacttaataaattttcatattatctatacttagatattttttattgttatatataactgaaaccaaattaaatttttactttttctttaattctaatatgtactaattattagatttaaaatgaatttaaattttatattacacacacacgtttaaactttaaagtattattatgattttttaaaatatttttatgaaaatagactagtataaaaaagaatacaatttaaaatctaattggtttgaaataaaaaaagacaatttatgtctttgttgaatcaaacaatcgagtgagattataaaataaataaaattaaaattggtactttaggcctagtaaatatttggcttaagctttataggcagtattatggtcgtggagcttagcctccacacacacacacacaagtggataccaatccagctctacctatggaattatttgagcaatgtaagcctcttgacatagtttttcttaaactattgatgtagtgaaaaagtactatacagtgtacatttgatttagccatgagattcttgtgagacggttcagtagaaatggttaggttttaaatattatttacatgtaaaataaattttaaatttagaacagtggaagtgaaagatggaggaaaatggttaggttttttttttttcatttttaatactctatatttatacccttttcaatgctccataacgaagaaatggcttccattcattatcagtnnnnnnnnnnaatgaaattcacatgtcatttataaagtatattatatttattatgttctcatcttccacacattgaagttgtatacattgagatcatggggttatagagtatgactgggagtaataaagagaataggtctttttttttaaaaatgacattttaaatcggttatttaataaacaatgtagaaagggaaaatataacatcggtttctaggaaaaaatcgatgtaaaaaaggaactttctacatcggttcttccaagaaccgatgtaaaattacacacaacaacatcgatttttacaaaaaccgatgttgatatgtaaattcaacatcggtttttatgaaaaaccgatgttgttatgtaaatttaacatcggtttttataaaaaaccgatgttgaatttgcatagtttatatttttttcgttaatttcttattatttgacatcggttttttaagaaaaccgatgttgtatagttatgttaacatcggttttcaagaaccgatgttaacgttgatattttcaacatcgctggtttcaacatcggttaaaaaccgatgttaaatgtccaatataaccgatgtggaaagcgatttttctagtagtgggtggggaattatagcacaacattacttaaggacgcatagttaaactttttaccgggggttactggaacatggtcagggtcattaaaggtgttgaatgacattttggtatgcagttatttggtctatatggtcgggctataactgtttgatttttacaacaaatattacagatgaggaataacgtctaattgaaaacatcaaaatgtatttttttttttgaaatggaaccaggttaaaagagcttcacttttcctctttcgggttggatgatgaacgccgtgttgtgtttacagtaaggtcaactaaggtttttccttatgtctattaatagaaaattaattgatattaaatatatatatatatatatatatttagggacacataacagtcactaattgaataaattaaacggtaaggattgcatctatgaaattttaaaaattcatgtcacccaacaacccatgtattcttatatatgagtgtgcaataagttactaacagtaattataaaagaattagaaattaaaattttctcttaaaaaattctttactaattcattattaatgttttctctcttcttattctcttatttctcttattttttaagacttgaagtgaattgcataatggataacatatgatatatcaaattactcagtcgctttgttttcaaagttgataacatatttctttccttattccctttatctatcaacattaatttttcatttataacaagaaataattgctcagaatccctttgtttccattcttttatgttctttgcttttcattgactaaatgaattaaatgttataggtgacaataaaaaaggttagccgacatatttgaagagccttaagttgaaaagttaaaatggcttgagaagtgaagcgaaactgcaacaaataacatacaaatcatttgtcacagtttctattcgctttgcgtaagacatatgttaactttcaacttaacactcttcatatatgaattaaatgttaacttcctttgttggcttaccttttttgatgtattcaaaatttgccacttgaacgtttaattcatttattaaatgaaaagtaaagatcatgaaagaatcggaacaaagcgaatctaagcaattgtttattgttataaaagaaaaacttatgttgataaataaaaggaagaaggaagacaataacggagattgaattcacataactttttccttaagcccaaagtatgtaatagtgcaatcaagaacaatgttgcaccaagaaataatttcgatgtcataggaattcttcctccattgttgttcacaataaaccgaacaaacatgtgtcatgcaaatggtgaatagacgaaaaataaagaagaaaaggctgagcgaaaaaaaaaaaataggaagatggtgaacaaatgaaaaagaaagaagagaacatgagaaaaacatactgagaatttttttttcaaatgaaaaagaaagaggaaaagattgtgaggaaaaaaaaatgcagagcgatggtggacaaatgaaaaagaaagatgttgcgtgatcatgtgatgcacgtatagaggatggggctatttattttattgccaagacgtatcctctgaatgtgatggcggcgtcactttatttacacttttcaattgtaaccttacatttagggttttacatattaaattggtagggcctctaaggtcattttattttattttttattttgagctcctaagcttgttattgtaaccttgcaattccatgtttcacttgagaacattgaccatggtaatattagatgaaaaatgactttctatcactaattcatacctaatcattatgttaaaataaaatgttatatatatatatatatgatttttttataatattttgtttaagatttgtcagtttatatttatttttttaagaaaatgtataaacagattcatgtagtttaacttgtgatccatcatttactatcctaactcctaatggcatctttaatcggagatgcttcatggatttcttagcctaaggaacgattttttttagttcttcgacattggaataagtgatgtggtaaaactaatttcttcaacgaacgataaattccttatataaagaatcatttcttaccaataaaaaaatattattttcataaaatccgtactcctcaaccacaagaacaaaaaaagtgatgaaccaaagaaagaagatgaacaattttaacaaaacaaattaaacagatgaagcaaagaaagaagatgaacagttccaacaaatcaaattaaacaaatgaacaaatgcatagatgaagtttcacaataaaaaattacaatttttccaaacaaatcaaatcacccaatgcaatatcaactcagaataaaatacaaaccaaattaaagagtaccaacactgatcgtgaacagagtatgaatagtaaccgtgactccaacgacatcgttctgaccaacttcgaacatcgtgggttgcgtatgtcaggtcatgggttgggtggtgttgcacatgactagtgttagggtctaggttgggtggtggcgtgattaggggacgtgacagtgttggaggacgaggtggattggctcaataagaggtttgaggaaaatgaagagatgatagggtggggtgacactagaagtttgaggacagggtgggtagggatggttctggagcaaagagagaaagagacaaaaggtcgatgcatataggtgggaagggtttggagaaatagtttttctaagaaagaaaagagaacgagtagtggagaatgatataaaacatttatcacaattgtgattagagagagttggagatattaaagttgtgagacaatttgtttatcgttacatactattcactttaaattttggatcttgttgatgtagttttgcacataatatttctacttttattttttctcttatttttattaagtctcatttttttttattctctttaaaatggaccctagttagtatttttaattaatatttaaaattctcttcaattatttatatttattatttgcatacataaaaattgaaaaataaacaaattattttatttgaataataattaaattataataaaaatataaatgtgtgaattttttgaaatttcttctgatttcttaacattgaagtaaaattttgtatgaatttcttagtaggtatcacaaaaaatattacaaagatcataaaaacataattaaaaaatccatcaaggttagaaatactctaagttccaatcggactcgtcaaccaatctagttctaataatactggatcttcctattagtcctccattgacaaatagcaacgctgcgaggaacataattttattttttgtataaaaagaatacgtttaattcaaaaaagaaggaaatcagtttcacatttgggccattggaagagggccacgatattttgggctcaggggcccaacccaaaccgggtacccgattgatagactagggtttatgtcagagaaattgggacaccatcgtctacatattgaagaggcgcccaagcaagttagttctttagccgtcttcgctcacaactcgcaaaccacaatggtaactgctatttcgttttctacgtctttgatttgatttatacgatgtttatttgttcgtgtcgaatacgatgtttatttgttcgtgtcgaatacgatgaataatgttctgagttttgtgtgtttgtgcacgacacaatacagcctaagcagatccacgagattaaggatttccttctgacggcgcggaggaaggatgcgaggtcggtgaaaatcaagaggagcagggatgtcgttaagtttaaggttcgatgctccaagtacttgtacacgctttgtgtctttgaccctgagaaagccgataaattgaagcaatctcttcctcccggttagttattattactgttccttttaacactatcgtatctatatgtatctgggattatgaatttgtgttatgggatgcatgccatttgttgtttgcaggtttgagtgttcaagacctgtagaggtgctgagtgcggcagcgtgtgtttgtttatctttttgttacctgatgctctagattttgtggcttgcttttatattttggtaattgttatgaggctatgcttattttccatttgccatgaaaatgtgaaagttttattttgagcacaatttaattgaattacccataattttgtggtttattttatttattatgattgagtactgtggttagccctttgcctagaacaagaggatttcaaatcggcaatttggcttaaagagtcattcaattttattgttctagcgatactaactaggttcgactcgcatggaattgtataatgttgcgcataattttcagtctgtggccgagtgaatgcttctataaatccaattgtgcccgaaacggctatatgtttaactgctgaaattccactactgcacgaactcaatatcgcgtgttggggttagttttatggtaaaattttaatgttaaaggtatagccacaagtcgttctatattttcatggtatcaccatgatttcatggtacccataaactctttgcatcaaagaaatccagacttggtcatcactgctgtaaaaatgtaggcacagtcttctcgtaccttattctcatttaaacacgtgtagcataaattctcgtattataacaattgcgtagctaactcaatacctcagctcgatactttttcgctagtaagctactcaactcattggggaggtgtcgacatctaacaatcttttttacttaggtagagttgtttctgctagctgagtttgatattggtgatttggtaattttagtctttcttgagtttatgttaatttgattagctgccacaattcaaattgtgttatgtaattgggagcgatttcattactgttgttggttgatccgatttcattagataacaaaggaagctgcccttagatatgagagaatttaagagtaaatattctgctaagtcaagcaaccaaatgatatatctcgatgttagttttactagctcgatcaattcatggtcaagttagatcaataatagttctaaattgctcatcgtagtgtatgttaaattgatcctcattttgaaattttaacatgaccttgattcgtgaaacctattcctatctctctttttctaccgcttcgattaaactgtgtgaaccaaaccctccggtttctcttatcaattaagtcatgctggaaaaaaaattgaatatatggtgaatgtaagttgttaggatcataaataagttccagaaaaggaggggggatctaactcacttgttttttattcctacaaataaaaaaaaaggcttaattatatatttaatttattaattataatttaaagtttaatttagttcttgatttattaaaatgtttaattaggttccttaattatttaaaatacaataattaaccctttccatccaatgataattgatcatgttaagtggtgatttataacccctggtttaattattataattctaagataatcataaaattatccccaaatcaatttcaattataacaatatccaccccaaatcaacacaatcaaaatcctcccatcccaaattaacacaatcataacctaataacccccaaatcagcataattagaacacaattagaataaaaattgaaaaaaaaataaaatagatatagatttggcccatggtatgttcctcgttgatggatgctcgtcgttgtcatctctaacgttgaagctctgactctgagcgctgcctctcttgtcgatgttttcactatcagagccgctttcggatttgggtgcgaaggttgtggtgttgtgggggttgcaatgcacaggcaatgcttgtcatgggtggatgtggaggttagtgggtaacgtgggtggtggggtggaggttggtgatgtcgtaggtggcaatgtgcagttggtggtgggtgccgatcaatttgagttcatggaggttggtggtggcttgttgtgtggcatagttagaggaaggggttgcaggttggtgcaaatatgatgtttgagaaaggaaggattagaggaatagttagagaaagggaaggaagaggatgctagtcaatttcattagtcaatgtgataaaattgatggaaagggtataattgttgtgttttcaataattaagggacttgattgaacatttaataattgagagattaaattgaacttaaattataattaagagactaaatgtataattaaatcatgaactgcgttgattagaaaattattaaatgatgtgttgattgacaattattaactctacactttaccttaaagtgtaccttactctagaagagtcagtcctctcgtgaatctttgattaaatgtgcatatttggttttactttttttaagaaataattaaatttaatggattttaagagacttttaaaaataataatttctcaaccactttatcatgcactaaaattatacaatgcgatcatagtcattgttgtggttcaattgttcaaaccaaactcatggtagatccgaaatcatgccactttacgaaattgatctggtcaagtttatgaacttgataatttgacaatgatttttaaccactaaattggccctgaatcgatgaaactagaccgatttattacataaacggtttgggttaatttaagaaaaagaaaagtcccaatctagctgattggagactaaactaagtatcgaggattcaataaacatgcatcaagttatttgtttatttggaatggcgttaggaatatcttctatttgacaacaagaaactctaattctttttatacaaaagaatcaccaaaatagatagtctctctcccaataaaatattttcttataccaaaccgggatcaaatctcacttagcagcttaagaaacattcatataccaactatgggggatgagatctaaaccaattgagagtctcacctctcaatgttcaaggaatagttcaacatacatttggtttagaaagacatcaagtgcttacgaagaactgtctctagtaatagtataaggctctatatgttctattcgtaatttccactacaactatatgctccgcgaaaagatgctagaaatgcataaacaccgattcaattgcataagtatggtatgaattacccaccttgtgtgtttcaagtaggggcgtcaacatatgcttgctatgagctacaacattcatcatgttaaggtggattgtgaaggtgggggatttaattttgcggttttgtgtgttccaattatcgaatacactattctaaatcatttgcgagttattgttgtatctttggagcttatcttaattccattatatgctccttaacggcattgccccatttttctaccgtagcatcatttgttgttttaatcatatctagtgagaattggatttaccaagtttctcatagatgacgccaatgattagtataagatggacaaagttgatatattagagatggactgctactttgtccaagatagaattgaagggatttaactcagttggttaagtaaaatgattgataaaatatatttgtgtatagggtttagagatgagcttaattctctgacagtgtccaaggcttctcttggacaataacacccctatattggtgtagaaatagagcaactatacttctgagatgagatatgattcgccgttcattagtgcatgttaagattcttgtttttggattgagtctaagcccagtgcataacatgaacagtacatgtaccgtattaataggtttgacttttaaaaattgcccataattgttgaaagtgtttagaaccggaatgtaacttaaagaaagggactcgtttattgtaagagcaaattaagatgaaataaagtaaaattatataagttaacttataaaaattatgaaacaccttcagacgtgctatttctgttcactaggatccaaatgtgtttttgttttttctgttaatgtgaatccaaatatattttggagcattgcagatgttgctatgtagaactgaacccaatgccctacaccataggcgattccctgagtttttcatgcagttcttagccaattcaaagtccaaacctagtgagcatgtgattgtggtcccccaattctttctccacttgggcaagttataggaggcaacttcacttttacagccttgtggaaacttgtgtcatgctcaataccaaactcagcccaagacatgcaattggcccattacattcgtttcatgtggtggctagtgaaaggtcgaatcaataaaaggaaaaaaaatgagcatgtaacaaacttgtgtacatcttttttcaatccatgcctattttattcatggcttgttctttttaaatatttaaggtctccctctaaatgttgtcagagtcatgaaagtggagcgcaatggcaagttctttatgggattttaaagagccgaaagcaaaatggacgtacatatttgtatatgacaccaatgaatattaaacacaagtcggagattttggaagctttaaactagcagaaattggccagtacttatttattgcgtgttatcatttatgaaaagtagtttttgtttatttatttatgtatttattcatcttaatatatagtgtggtttgtacaaatttgacagctattgtgatagcctacttttattttattttcatatgagacatagcctactttattgcttgtagcatgttgcaagcaaccaattcacatttaaactcttagttgcatttcataataaagctcacaaaagggtcaaaacatgcttttgaatatcacagaaaaagaacgaacaagcttttactggtccaagtctaactttggtaaaagaatttttttgtaatggaacacaataaagtcactgaatcatttattgggcgctaaaaaaagcttattttctttacaatgctttaatagtcaaatttaatcctctagaaagcatgtcaataaatgaatgtttgttatgtttctcatagcaacaatattcaaagtatatggtgtgatagataccaaactctggatcttgttgagattttcatacaagtttgcaactctttaataaaggaatagaatttgtataaaaaaataagataaactgaaagcaagatcacaagaaaatttacattagagtaaaataaaaaaggccaggtacatcacaacaaacatttctctctcttttttttgttttttgaagaaaaaagacagttttgtgacatgtaaacattactcagcaatcaatttaatgtagcactcaggtgtttgaaaattacaaggtttcagtaaagtataagatgatataccagttttaatgacccatatcatccacggtaagaaagataagcaatcttgtagtaaggtgcattttcttctaaaagcagtgtttaaggtatatatcacagccaaccacagcaaatgtaattggaagagggcaatcgtcctgtttggcgaatgtattctgtttgagccgcagttctttctgcttctcgattttttctagcttccgctgctgcacgtttttcttctgatctttgcctcgccatagcaatctttttcaccatttttgcatgtgtctgagctctcatttgctcaactttggcctaaaatgcatatagtttcaatcaaaggcaaggtagtagtaaagactttaactaaagtatttctaaagttatattgcaattagataatggccaagcatttcatacaatatattcaagtggacacgagtaataatcataacaaaatttatcatgcctttctctccccttccctctccatacacttggtttaaaatcctttctaaattgtgatctcttcaaactacgtttaggtttcaacttttgaacatgcaataacttggtttccaatgaatacagctatgtaaacaaataactacctcaattcttctcatttctgcttctaattttgccttttgttgactttcccatgcttgaattttgatttcctcacgcttaaatctgcaaattttaacacaaacacattagcaagaatgaacaaattacatggtctataactactttccaaaaaaaaaaaaaaatcatgatttacattagtctagagaatgtgagtaaaaataaaaccttgcagtatgtttagatttctcagcttcctcccacagagccgcacgtttttcaaattcaattctctgctgttcatgcacattcgcctcctgaggagaagatttgttcttttcctgctcatctttgcttgcccaggcagcaatattcatcttaccaagctgcaccccaagggctgcaatctctctccttgtcttgatcttcatttcttcttcagacaaattcctttttccattttcaactggaaactgggaatccccatctgtcgtgttgtccaaaggtgtcggtgcaggtgcacctctcctaggagtcgacggcattgaggaaactgggctccgtagtggtgtcgcagatccaacaggagtagcagtccgcgaaggttcttgacttggcacaggggtcatttcagttcccatgtctctcatggcaacagatcttatcccaggcatcactgtatcatgaaaacaagctaatctacattgagcatgtcaccaatggatgtaataagaacatgcaccaggatattaactttcaatgttttagtgttccattcctttttttttatcaccatgtgtatattttttcaattaaaataagaaaatgcataaaagattaatttcaatagacaacaagtgtgtataaaaaatttcagctagcgataactggcttatattttctattctccagttatgcaatgaagtaaaggttgccttaaattagcacgaataataattatacaaatgctttgtatactttttaatcttcccaaaagaggatataaaaaaacctatatcatcaattttgagggttgaataacatacatgactgatcatctgtacttcttgagcaagataaacctaattcattgacttcctttagatctttgctttggggaagagactccactaccggatttcttccgtgtgcttgacctgaaaccgaatgagcatcggagggaacaaaagagaatttctcaaatcccatatgtgatgttggctgacagaaatcaactcgctttgtttctgtcactttgcctgttggttgtttatgatcataattaccagattctggagcaaccctccccatatttgttggcatgcgatttgcttggttatgtgcagtattcttttttgagtgattcgcctgtatgttttgcctattcattatccatttctcggcatcgttccacttagaaggaataggtctgaatagggatctagtagcaggattgttccctggtctctcccctttatcaaactcaaagctggacgagctagcattgctgtcataatcaagattttcatcttctattgcccttcccgcatgaattgcacttgaacttccggggtcaaccttcggaaaatggtgcatctttgcacgcctggtgtcgccattttccttaggcattgtctcctttggttcataagaaatctggtcattctgtttccggtccagcacggcattactagatggctttaatgacagaacatccaagctcggagatgtaactggaaggaacaagtttccaattagtcaacatatgaagcattttattcaatagaaaaataaatacacaaaagctgggataaatactgactaacacaataacaaatgtacatgaaaaattgataaattgcaattgcaaaccttcatcatcaaggttgtcatttttggagtcaagtaagctattcacaaattcagtatcctcaatccttgagggggaggttctggatgagttactgttggatccatctttcttcctatgatggtgaggtcctaataacttcatccttagtttactgggagaaattattccagcctgcagaaaaaatggcatacttaccctcatcaaaatcctagaagaactcaattagaaaatttctaacagaatccatgtagcagtacactgcataaacaattatacccaatacatgaccactttcttcttttccaccaaaaggcccaccccaccgtttcaacccacaccctttattcactcagaagaaaaataagggaaaatgaatcctaccctttttttttcctttcccttttcagcctttttttccctctcttcctcacccacccacccaccaaataataatgacaaaccccatccttccattcattacaaaagtagaaaaagcaaaagcatgatttttgaaaccatgtcaaaattcactcggaaagaatcaatgaaacaaagcccacaaagaaactgaagggatgatgactattctgaactccatgaacacaaagcttgaataatatggaccatttagccaccaacccagtttaagaaacaaaataaagatttaattttgatgaaaaaaaaaactatgaggttgaatggaagaggagaggagaaaagagatggcaacagtgggctaaatgccaaacctgaactttctctatcctctcgtactccatttgatctctgactctcttctttctctctaagttggaaggtagctgatgcagaagtggaaggaagaaaagttgaattttacagcttggcttggaagtagttatgactggtgagttgtgactgtgaatgagagatagtaacaataagacatgagagagaaagagtgagattatgaatgaatgtgatgcagcaaggacaagagcaggaacaggtgtttgcttgctcaagaaagtgttcaagttgggttcctctacagtacaggagatgctgtatctatctatcatctcgccacgccattgcaacatctcattatcaattttttttttttttttttggtacgcacctcgtgtatttttataggagcccatctgtccatgatcgtgaattcatgtcgtgggttataacttataatttttttttaaaaaaaataaatttatgtttcttttctaattcacatttgtttagaaagataattatgtttcaaataaatttttaaatcaaatataagaaaaggatatacgaaattcaaacctgtaatcttttaaatgtgagtctctattttactgtactcggtgaatccgaactattacactgttttctacttttacttttacttatgccttctccccttccacccaaggatnaaaaaaaaaaaaaaaagaagaagccatatttatttattttactttgcagtttacatggatgccctgaccctgaccttacagataaccaacatacgtaacgacgtcaattgaatttgatgagtttatatttatgcttcaatggagaatttaaaatattttaagagattaaaaatgtaagaaattaacttgttatgttcaattctttctatgttgtttttaattctaactgttattgaataattaaatttctaatataattttttgtgtgtacataaaaatatttatagtaaatagttaacaattagtaatatctgttgaaataaatagattatcaaaataaataccgtctcctcctccaaaatatttctcattttttttgtaaaacaaaaatataaaaaggataagaataggagcataacaaattgagtaaaactgactgataattaataagtattgcataatcatttaaccaatttttctatgaacattttttaaattttgaagaagaaaaaacctttatcttttccttcaattcttttgtctgcgtgtcaattagtaaagcttcatggatttatatttgttttttcattgtaacttttgttttaagacaaagagcagattactcagtaactttaggacagtcttcgagatcgaaacagtgggcatgatcagaattcagaagtttgcattatcaattttctctgtatagtaactgtttatgcttgtaggtcatagactcatagttcatcaaacgcgaaaaactactacataaggaaaagtaataaattagaaaggaatttatttttaatgaggtgtaagtatacggattcaagttgggatactaaaatgtgacgtgatagaatatatattattaaatgatagatttagatggtatatgtttttttctaagtaaaattttagatttaaatattgagtacataaaaagtttcattgagagaactaatctcaacatattaaaaatattttaaatttaaacaaaatagtgtcctttaaccaccaaacacttaattatttagtgcgaaatcattctaatttaaccaaaggccttagatgaaannnnnnnnnnnnnnnngtattgtgttaaatagtaatacttaaagaaaatttttattacccgtaatgaaaatgcatgtgttctaaaaaaaaatccagtactttgtagaaaatatatactaatgatctaaatataaaaaatgcacaaaatctgttgaagtttgtacatgaaatcataatttattagttctacccaaaatcataaatgattggataaaattctccaatacaaaaacaaacttaccccttaaccttgttgagttttttttatatatataagagacctgttgagcgtttatactggaatttacaaaaagaatcannnnnnnnnngtccatgaaatatttctctttcattttattataaaacgtaattttgtgtgtgttataaataaattatacgagcatgaatcaatttactccaaaagtaactttaaaatacataaatttctttatatttcttttttttaattataagtttttttatacaacaaactaagaaacatagaaaagagtaatggtgaaagttggagtaatttgcacaagatcttctattcaaacctagcttatcagtgtcattgtacacaaaaaaagaaaattaggaaatagaatatgcaaacatacttcgatggaggggaacaaaaaaaaaacaaaacttgtcttattgtcaaatctaaataaataacttaaaggacggattttaaaagaatgaaataaaaagnnnnnnnnnnatatccatctatataaaaattaacaatctctagaaattttgaattattgtaaaccaaactcaactaagtagaacgatatgtattatctaagtttcattgcccaaactaacgactttttttgtaagtatacttatatatattgtttttgtgtatcgtcaaggattacaattttgaagctttagtactccaaaattatttttttgcaggatatatatgggatatttatgtgttcaattcttcaaggacaaattttatatgcacttttcattacatttttaaaattgcatgctgataactatttacttctccagggacaactttttatatgtcctcttgatcagttattcgcctttaaattttcaatttgagttttatatttaatttttatgtgcatatgttcgttagtaatgttactttttattactggaagatgattaatacataccggaaaatttgatagattaaaattttaatttatttttcaacgatgatatataactatccatttattttaaacattttattaatatctttcatttttttttctttctcttcttnnnnnnnnnnatactggaatttacaaaaagaatcatataagggatatatatatatatatatatatatatatgagagatgcattttgttttttgaaagcgaagatatgcacattaagtatatgttttagataattattttattaaaaatagtcgttttaaatgtaaaataattctaagctcaaataatattagatgtatacatctggattttttttatagaaacggaaagttaatttcaatttatgcccaaattatatattttgcaagcaacattttttacgtaactaacataagttcacatgttataaaaaaaaattaagtccacaacaacactcaaaatgtaaaatgaagttatgaaatttagtattatggttctatatcaacaccttattattcatataaatcgaagcatatatcataatattttttttataagctaaagaattcattactaaaaacaattaaattgtgcacaagatatgtccaactcaaggtgccaaaatgatatagttagagaaaaaagaaacaagtactgggatagtgtcattgttttggacaaaaatccaaaagacccaccccaattgaaaactaaaattaacgaaaaatcatgcattggtagttactagttaacgtgaacttattgccaaaaggaatatatatttgcgagtctgcagtgaattacacacatttttctacttgtaagatctgagtttaattgttattgatactagtaataaatttagatttgggaattatttaaaaatttacatttgctaaaaaatattagtcggtgttcaaagttcaaatcaaacagaacaaaacacgtgaaataaagcctctcatcaaacccgtggatgcggacattggtagctaactaattattccgataatttcggctccgaatacctttcttattcttagttggaaaaaaaaaaattattaacaacttttgaaagaaaatacaataaagacaacgtggtttgaattgaattcctcgaggaggagctaacatatattgggacacttatgattggatagaaaatattactagtacctcgtttcttcttaagcattattttaagggtttcaactttttatgtataaattaaaaaatatactactttatgtccttactaaaggttcaatcaactaattaatcaaaattaaagaaattaataaatttaatttataatattaaatttatcttgaattgatacttttttcttcaaaactactcatattaataaaattaacaagcatccataaattataattttctcgctgtcacattattctatgattgactctaattaaatatgtttttattaaaactaactaatgcaaaatatattttagactgaattacacttttaatttgatccttataacaagaacaagaaagaataatatttatccttagtaaaatatagtagttaagaagttatttattttatcttttttttacatcacagtaaataaatatcatttgctttttttaatctcaattccataataaatgagtaaattaatcaaaattaattaaaaataattaatattatcttaaaaatgaaaataataaataaataaataaggagaaacaattattttcaatggtatattaaaagtttaaaaaataatgatataaataatgatattttttaaaataaaaaaaataatttaaatgtcattatttaatttaaaatttaaacaaatcatctgaattnnnnnnnnnnaatttaataaactaattttttgattttcaaatatcaacttctaatttttcaacttccaaataatttttcaagaaaggatgaaagaaaaaaaaaacactcatgtaatatgttggaattgattgtacaacatatttgattaaaacctctttcccaacttttgaaagattctcggaagaccaatgattaattcttctccaaaatctctctttggtgaaagtaaaaatctctttcttcctcctaccaatgataaaaggaagtttaaggtatttgcctttgtcaacggtttcagttacacccgaaattgaagagatgttgtatattcagatgggggtgtgtttttgctaaagaaaatcttcaaatttatggtaattgatgagttgaacatacatagcgtcatatgtatcaagaatcttcctaaggaaatttgtctcattattttatgtcttgcaaactaaaaaataatcattaccaaataaaatgtgtgagaattgaaattttcgtactcactatcacatcatagatctgtaacacttttttaaaaggaggtcctgtaatgtgtgaaatactaaaaacacattttctaatatattttttgattttttcttttattaattgaaatttattaaaaatgataaaaaaaattggtatcacattaattttttattctaattttataaatgtcaataaattttaatcaacaaaaaatatatttaataaatatattagaaagtatcttacgaatatttcctttgaactcatattaagaaaaaattattttatatcttaaacttaaatataataaatttaactaatttcattcttatttaatgatatcattattaaaatatcattcatttaattataactttattttatttatgatattaaattttaataaagaatattttcaaaataattttattgttaatcgatattaataaaattaaataatttcagtcaagagtatgaaaatatttttccttatatttttgttatatacgaatccattcatcttggaaaatactacaagtaaatgaatggtaatagtagtagatgacaaagaagccatgaatatattccttggtcggtcaaagatacttctgtgaacacatccacaaacgcaggctcatactttaagattttaattaatttatttgagagaggggaatatgaattaaattaattagggtgtcagaacacagaagccgaaggagatcagagttcggaattctataatgtaacttctcctatcactgtttctatttgaccacagtcgccactttccaccctatcaattccacacgcccacaccatttcaattttcaaaaactcacgtttttgctatgatgctaaatttctagaaattcatgctacttatcaaacaatacaaaataccaactaattactttagtttctatcttttattttctaagaattaaataaaatatataatttcatctttttaagaattattttaaaatgtctttgacattaatgcttttcttacaaaacatccttaattataagtcatccttttgggatcaataaattataagtaaaatatattattttaaactcttaaagaacattttgaaaacttaatttaattttcttctcccttttttgtgtgaatatttccctttccccgaatccattaatcatatattatgcttaaaacttgattttcaaatgcattttctcattaacattctaaaataactaagtgtcttgtgtaacaaatattgtttcaacactgttaaaacactatttgaatttttttatttaattagtttatatataaaacaagtattgaatgcatgagttaactaatataaaattaattgtttcatcttaatcaaatatcttaaatttgagtctttagaatgtaattacattaaacatttaaagagaatttttttcacccataataatcctatccaagttaaatatgattatttctaataaaaaatacttattctattaaaaaaaagtttttgtataaaacacttgaagaagttttggtataaaacactagttcaatataatatcatgtatcttgcatttgtttcacttacctgatcgaaactactgtgtactaaatcaaaaatttcatttaccgaactttgttgttccatctttactaaaactaatctctatttgatactactcttggaagctttggtcttttgagtctgccaaacactgttttaatcagcaaaaaatatatgtatatatagagaacacaaatgggtacccaaaccattttcaagattggtatgcacacagcatattgacttgccaaacactttctaaacaaccttccaagcaccgactcaattcttaactaaagaatcaactcaagggtttatagttttcaggttgaaaattttgtaaagattgcaattcaaatcatctctttgttttgttgtgtcattaatgtgacctacaactctatgaataattcaatccaaactaggctagtttaatttccatttaactcagcgtttattcacaagttggtgtgtatttttcaggagattctcctttctctttgaagattaaaaaagcagtagacagacgatatcacgatcataaaaaagttcaatatcaaagtggtaaaacatgtgaattaaagtggttgaaagattttatcttgttgatctattcaaatattcaaaagtcatacaattttattgtcataatgaaagcagtattgcaaatagcaaagaacatagtatttcatgagtggatgaaattaacataacgaacgacattcttcatgcaacttatattccttcgatctcatactcaattagttgatgtcttctgcaagaccttagacaaatagtttgactacttttttattttttgcaagttgggaattctaaattccagtacactactttgtatttagttgatgcagttttagaagtttgagactgatcgagcttttttatatatatccatctatataaaaattaacaatctctagaaattttgaattattgtaaaccaaactcaactaagtagaacgatatgtattatctaagtttcattgcccaaactaacgactttttttgtaagtatacttatatatattgtttttgtgtatcgtcaaggattacaattttgaagctttagtactccaaaattatttttttgcaggatatatatgggatatttatgtgttcaattcttcaaggacaaattttatatgcacttttcattacatttttaaaattgcatgctgataactatttacttnnnnnnnnnnnnnnnnnnnnnnnnnnnnnnnnaatttaataaactaattttttgattttcaaatatcaacttctaatttttcaacttccaaataatttttcaagaaaggatgaaagaaaaaaaaaacactcatgtaatatgttggaattgattgtacaacatatttgattaaaacctctttcccaacttttgaaagattctcggaagaccaatgattaattcttctccaaaatctctctttggtgaaagtaaaaatctctttcttcctcctaccaatgataaaaggaagtttaaggtatttgcctttgtcaacggtttcagttacacccgaaattgaagagatgttgtatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcaaatctaaataaataacttaaaggacggattttaaaagaatgaaataaaaagcaaattagaattttaaatgaatatatataaagaagcataaatataatttgagagtttttatggtattcttaattattttggaggttttgatactgttaattttttaatcaattaaattatatgtcatcttcttattaatgatttttttttgttttttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctctctttctacactatgttaatcataaataaaatggtttcaaagtcattgtcaggatgtttttttatatatcataacaaattagaaaaatagtgacttttgtcctccctattaatgtaattaacgcggagtcaattatgtataaattaataaaaacatctttaaggttaaagaaaagaataaagaagagtactcatctaaatattctggccttatattttacaaaaaaaaaagtttttttataataaaaaatattgaaagtaactaaagagattttaaagttcaaacttctaaaattatctttaatcatattttttaattttaaaagttacaatttaaaaattttaaaaagataataatcaaagattaatttgaaaaataaaaaataattaataaaaaaatgacatataattttattgattaaaaaattaacagtatcaaaatcctcaaaattattttcagcagcgtagaaactcatataattttatctttctaaaatgtctttgagatcttatttcaaattgtcgataagccgtaacttcctttgactaattaagtccttttatgacgtacatgcacgagaaacactttgtagtcaactaaggatgagaagtagatatataagtccttttatgacgtacatgcacgatccaaattaattttagctatcattaaatgaatttagaaaacggatcaagttagtaaatggcaggctttgttagaactaaaataatgatatattgcttgtatataggtagggaaaaaaaaggcccgaataaaaaaaagatagaagagtagatatgtaattgaaggaaatattaatattcctttatatcaatgaataactctaaaattatgttttgaaaaataattggtttgtataaatgcatcccaattatgataaatatatttcataaaatctgaaacacagtaataaattgtggttatgcactaaaagtaataacattaatttttttacaaatactctatctatatttttaaggttctgataacatttgattaagaaaaaactgattttgcctataaaaaaaactgattgatatggtgaagagtattaataatattaactagtacttttttcacaatttattattttaatttattgattaggaaaactgattacaccttttttatcccttaattccccacttctattcttcggctcattaattaagatgtcatttggaaacgtagccaatgaataattgaatagtactcctcgttcttttaactgtatttgcaaatataattaacttcccatatcgggctaagaaaacataattagcattccgggatcttaaataaaaattttaaaagctcaaaacccaatgggaaaagtagggaggtcgtactacactttttgtttgcttttcattatatggtcctataaaatccttctatttaagttacattacactttttattatttactcgtattaggagctcaagaaacattcttttattattgttaatttcatcaattcattaaccaaaagttgatgaaagattagggaattccggtcatagacgcctattacttcacacttcacatggtgtgttctcattttgtgtggggcccattctcctttgaagattttgggtatgacgtgtatgcccttcaaaggggctttgaccaatttgtcttattttcattcgttttggtatgtgaactcattgattcgcctacatgtttgaccactttccatttccacatatgcattcacgtattgatcgaaacgactccatactagtgttttatatatttttctgctcattttttgtgtgaaacatattgggaataacagaggtcgggatgaagtgaaaaacatctctttcaccttttttaaagaataattgttataacttgttgttaatattgacatttttccatcgtcgaaacaatgatctttttgaggaagtattgaaaaataatattttaatatattattttgattaagtgttaaaatatatttttttggttaattataaggtgacgcaagaaatgaagatttagaaaatatcaagatattaaaagatatcaatggttgagattaaatatataagttatctaggatgaagattgaagaccaaatcatccatagtaaaaagtgaagacaaaatcatcaattatgaagatcaaagaccaaaattattgacgatgaagatttagtgaaaatttataaaagttagagatagttataatttgtactttataaaagtataacttttatgttgtaataaaggagattgatacataatcacttaattcctcaaaatatcaacacatttaccatcgaaattggcaaaagttcaacaagttatcgtatatttattcaactctccacttttatgaatcttcacatttctaaatcttaactttttcaatctccatttattctcaaaactttatttttccaatccttatttcttcttattattgaaatttcttagaaactaagtactgaatcaaaaatacttttataaaaaattattctattatctgatgattacaactttattataactaaaatgaatatgtttatcaaaattattatcttaatttacattaaatattaaataattttttattaagttgaaaactatgaatttacttgttaacaaaaaagaactcataatcaaaaataaattttatgtttcacttttaagtatttatttgttaagagaattattcagtgagaatttctttactatcttaaaaaatattttccttttgaggaatagatataattttgacgattaacacttgtttaaaaaaagaattttagattgcaatatttttaaaaattgaaaaaatgtatgccacttgtttnnnnnnnnnnnnnnnnnnnnnnnnnnnnnnnnnnnnnnnnnnnnnnnnnnnnnnnnnnnntttatacttttatcgcataagtatatccttgtaaagttttgtaagctaatgcagttgacctttattgacttgttgaatggaataaaatacatagatgaaaaggatgatagatttttcaaaactagagaaatatgcagaaaaagaaaagaataaatgtaaaaaaaataacccacaatgaaaaataaaacaaccaatatattagatgtatcctttaaaatgtaaaatagaaaattaaaatttaaagataaaaaaatctcacaaattattatgaaaactttattttatgtttgactcatactgtataaaaagacaaaaaatattttatgaatttcaaaaaataaaaaaataactttaaatttagaaaaaaaaactaaactttaacaaattaaaaacatatttaaatctatttttatcatcatattatcctttgtctttctcattgaagaacacttcacttacaagtgacatcccaactacgaacattattgttttcgttgttttttttagaccaaattctttttttgaaagcacaaaggcttgacataaaactctagtcagagtgtgtgttgactaaattttgtaaaattaatttacttacatgattttataataatttatgttttaaaaacattaatatttttattaaaattacattggattggaaacaaattgaataaattttaatgcattccaccatgacatcaaacaacacttatattccaaactaagcgacaaaaagtacaattagtcatatttattccatctttaatgataactctatcttagagataaaagcaaacactacatattagcagactttttaatggctttatgaggacaatgaccaatgatagtatcaaagcaaaaattaaacaagagaggtaatgagtagaaaaaacacgagtgggtggcatctactgaaagttttatttgtgtggtggtcgccattctagcatgcagatagaaatggttccacttccagctcctagtagaaacaaaagtacccctttagttctagggtctcattatcccatccttaaggataggatacacatgcatttaattaatgctaaactaaatcacttatcttataattgacgatttatttaactactaaagaaaatagtttaattaattaagacttttactaataaaacgtgtaagacattcgataatcaggaaaaactaaagagtatttctttttatatatattaaatactttatttttgtttaatatttaatattttcaattgtttaacaagtttctttaattttaattttgatggcattgattaaaagtaccaaaattcttacaagtaggttagaatctcccgtacccagtattcagcttggactgtacttgctttgatgtgaattattgagtatctttccaaatactgtgtatcttatcgtgaagcaatgtaaacttgtcagcactatcatataaccaaggcaagtcgttttctcacattagattcaggcacatggtctgggcattgcgttgattgtggttagtttgcagaacgtaccaaaaccaaaactattgttttctctctctattttctaggttaatttataattactaactatatttaattctccaatctccatggcattattccatggcattattctaatggcacaagtaaatactcaatttgatctttattttttttatataaaaattcattaagtttctgataaaaaaaatcaccagacaatttcttaagattataaatgttaggcattctagccttctatttattagataaaagaactaaaatatataatgtttataattttgaaaaactaaatactcagttttcttagggatcaaaatattgtcattattattttaggaatcagtttgagtattcacctaaaattatataaacggaacttggatcagtttgaaaaaaaaaattaatctgagtattctcatgcttaaaaattattgactattacaaattataaatgagactcgtcaactaagaagtaacacctataaattaaatttgtgtgatgtccaataaatttaagtcaataatagcaagtgtgttcaaaatagattgttagaaaatatattcctaacatttattttacatttaattgtgataatatttaataataccaattcatctaattataaatttaaacaaatctaattaataaaataaaattttaaattaaaataaaattacaccttcataaactatgataatattaaatgtcttaattcatttattaataaagtctttaagatgttaacttcaagggtctagttgagtcaaacaaaacctcacttgtatctttgagatgatgtatatgtaagtatatataatacttttataagcactcaaaaattttcttgtgttcaactaatgcgttatcctcttccctgttcttagtgaaaaaaagatcttttatattgttgctttcaacttttccttgggatgaaattcgatattcaagaagtcacccctctagcttggaattatcaatattaagcaaaggaaataaatgaagaatatacaccatccactgtgtggtgcgaataaattggtgtgagaatattttaactcaaataattgtttcgaattcgagtctgaggtgttaaatattgaatgagaaaacttttccaccaatagttgtgctacattgctactcaatttaaacaggattagttcctcatccctacaaatgatatatatgatctataaaaaaaataagattggactgcatcatttgatggctagaatttacatttgtgtgtgattataagttgctttagtgtgtatttgtgtaactttagtatcagaagttgactttgattaactttcatagatgcatttgagcttaactaagatggatatatagtgaattgggctcacacccaatccgtaacaaatgtcatgcacacgagtcattgttataatatacaagcagtcaagcacaattatgaagtaaacctatgcaatgtgggtgcctacaattagtaaatatggcaaaaactcttgacatatattatatatgtggctatgcattgagaattatctagttcaagcagatgagtattgaacgttatagcgtctaggtggattgaaccttggatagtactcaacccaaagttgttgctaaccttgttgaatgttattgatatttgagctccttgaagattgagcttacattctttaactttaacatattcaattatcatagttaattaagttaaggtgaacaatggataaataacacgtctaaaaaacaaaaaaaaaagtaatttaaataaattatcattgtaaattttcttacaaaataaactaattagaatcaattttacatataactattaaaataattattataaaattaataattttaccatatataacattccataaatgaacggaaatcttacattgaatatgtaattctaatcaaattcaaaacgaaatatcatactatttgctgaacaaaaaaaataaaaaaaaatcatactatttgcttaagtagctggtggcatattgctgtcaaaattaatacccacaaaaagaaagaattcatgtgggatctctgcgggaataaatttcacaagacagaatactaagtttgttgggaccctaatgaactttgactgggaaaaagggattgcagctttctgattttgtgaccctttgattgctatctttgaaaaatctataaaatattcaaatataggtgtggaaagtcgcttcctcatgctttaactaatttcccttttgtcaagcaatgagaattttggcttggcttggctttaaagtcaatgatggtttacaacttttggaagcatttaacgctatggtaaatccaaacacttttccagagaaattttaaaaaagaatcatcataaggatatggcccgactatatttaatggaaataaagtttacttctaaagagaatgaagaccaacgctaccaactaaaaggtgcccttcaaagtgtggcatttgattataatgcttcaaggaatcaaagtagccatggctcaaaatgattgaaaagatcattgtttactttaaataatgtgttctataagcttcaaatgtgtatctaaaattagattttagtataaactcgataaaggctaaaatcttttcttttaatgggagatatacttcttttaactttatttatccgaaaagaaacttttcttaaaaaaaaaaagaatttcaatgaagcacaatgacgttcaacgcatttaatttaccctaagtttctaataacattaggcttgcttctgctgtttacttagattggacgtatgtgtagtgcttcctttgcaaatgttctttggggggccatgggtcgagatgtaacctgtaattaaagaagaatgtttcttgagcacaaatttaagacaacaatttctttaaatttggagtgtgtttttaaaatgcataaagtcaaagaaaataaaatccaagaggtagaaataattatgtatatagtcttatatatggtgtttacattttatgttttaataataaaattggtgattaaatttattaattgtcactgacccaacgacaacagaaaaaaacacaattttccattcaaatgtgtcacaatgttatatatactgtttaaggcagcccacgctaatatctagcccagcagtgtatgcgtagcccaaacgaccatcgcgaccacacacttgtgtcgttgtatattcatgatcgggattgctattctcaccttccatcatttcctcacaccgcctcccttggcaaagtgggacagcttaccaaaaacaagtcaggctggtcctagctcacaaaaaatggggtgggccaagctggttcactttgcaaaattggctagcaatgctatccgactccacttttttagtgagctatatgggttgacctgtcagaccatgctcattttgccattcctaatttaagttaggaatgacaaagtggaccagtccaccaaaaatagaccgaactggccttagcaaaagaaaatgagatgagtcaaacgagcacactttgtaacgtagtcattacaagcccgtcccacttttttcaatggactagcccgtcagaccaaacccatcttatcatcattactcctcgtccctctctttcctcaaccaccaaatgcttcatgtatttattttattttatttttttaatttaaattttattaaaattttgtgtatatatattttaatttaaattatttaaaatcatttgatatatatatatatatatatatatatatatattaatttatgtgtttcttatttaaattttgaagattttatatttgtcaattttttattaatatagattttttagttaattttattaaaaaataatattttcttaatttatatttcattaatttaaatttataatgttttatatatatgattttttattttttaatatgataatgaaatttaattttttaatgttcatatttattaaaaattcaaaaatctaaaaatgtaaattaatctactaaaaaaattcaaaatagaatattattaaaaaaatatagtagaaacagtgtacaaagtctaaaatggtacaagaaagttgaaaggcatgttgaatgttgagttatgacaatggatatttctaaaatgaaaatgtaattgtaccctttacaataaaaagacatctcttttctctgatatattgcataaatgaatctgtcattctttaagaaaataataagtaatatctgcatctactcattgtgttgttctatctgtattatgatcttttttcttcttctattgttcacatacgtagatagatagctaaaatcagaatagccaaatgatatgggcaatatagaccacctttgcctagtgagctaaactctactctattgaatttcaaaatctatgatttggtggtcctaggtttaaattcttcatgcttcttcaaacccaattgaaaaggtttttctggcttaagaaacaagattgaaccataatttcatgcaatatttttcttattagtttccaatacttatggttttgtttcaccaaaaagattttgcatcccttttgaggggttgttgggaatatttttaaaataaaatatagaaatagtaagaacttgcagaaaaaatagagattaataatgaagaaaaatagtcaataatattgataaggtaagattgtttatatatagcttacaaccaaaaattctaaacagcctagtttatcttctatcatatttatttttaactaattaactgaaacaaaatataaaagataagatctgcaataataacaaaatcaatacctaaaatttattctaaatttaaaataagttaggcaatatctcgtactctagcactcctccattagatttgtcatgaaaatcctaatttttaactccaaagcttcaaacttattttagaagtgcattaaatctatttaatttaattccttccggcttcaaagtcttcaaacaccgtataacaggatttgtcatctcaaattcatcttgcagaaacttttactacttcaaattaatttgactaaatctttcatgccaaacatcaatttcatcaattttgaccacaaaatcatgatcttcaattaaattaaattcccaataaaactatttatttccaatcatttcaatttttacaatctctgtgtggatttgaggcatatgatagttttaaaggtgaaccttcagctaaaggatgaggactttgtttaccccatggacacttccaaaagtccccctcagtgtgcttgtgcccaataatattgttaaaaatgattgaaaaattgcaactcataactcggatctacctaaactgggagatggaatgagtatgctagatcattccatagagaactgggacgcagaaagctggaatataatcccaacaaggactggtgcaagttacttaaatgatatacttgcttttcgggataagagtgaagaagagaagggtaaacctttatcagaacgtagcagttataaattttggcatggttggaacttgacgttaattccttggccgtacaaaatctaccacgaatgtacaaagtccatttgtcccttgctgcataagtaccattcagtgtagtgtgtctctatgtagttatgaaggttttgctatgacatttaataacattctacatgtttagatatagttataaaacaaattgatttgtgtctgtctcttgtagcttttgtgttttattgcttgctaagctaaatgattttctagtagttatttccataaaggaaatcattgtttattgatcttattgtgaacttatgtgcgtttttatttccgtgaagaatgaatgaacatttgtttcttttgacgagttctaatcaatttatgctgataggaaggatttgatgacactcacatttagcgattccaacggcgacggtagcctaacacgtcgcgctcgacattggtaaatgccagattcggttatccaaattaaacgttaagcaaatttgcttccttattttggttgcttgatacttggttattttgatgacttgtccttcgtctttgtctacaaaatttagaaatgatttggtgtctgtaagtatgtttaaattatgtgtcaaatcttataaaaaattcacacaaacacacatacacctaagtgttaaaaataattttaaattagcttaaaattatataaatatgatatatcttaataagaattctcaatttagcaataaattttgtaaaataattatcaaatgaaattttatcaatcagtgtagaaattcttgactgacagtggggtaagacaacttttctaattttttattagcttataatatataatactaaataaaatatttaataaaatgcacatataatcactactagcaaagatggtcatacacaccatggattaacacttttaccaatttaatgaccagtccaatttaaaaacattaacaccatcaattgttttaataaaaaaatacaactgaaatactcggaaaaactagtgataaacaataagacaaaacttaaaaaagaaagaaagaaaatggtaatgctttaatttaattactaaacaaactgcaaaaaaagaaatgcttttgttcccgcactttacacttaaaattgacttttcatggttcttttaatcctcacccttggcctgaccccatccactataaaatttcagtatttaggcgagccaaatagaaaaattcaagacatgtaacgagatttagagtagaagataacagaaaatgttagatgtaacaaaacagagttcactgtcagcttctgaattaggtcacatatttccagaaaaaaaaaattcattctagtatcttatcgcttgcaaacagaaggatcattatggcttgtctctgccctgcttttctgaaagagttaaatatggataaaatttggttttagtgcaatttaagttaccaatatgtatatttactactacacatttctcatgttcttgattttgggataaaataatccagattaaccaacgaaaaaaaaagatttaatattctagcaaaagttaaaaaaaggattagcagttatttttggttaagatttcaatatctttcaacttatttttacaaaaaaaaaaaatatcaatgtacaaatcttttgcaacacatgtttagttctcattagtgcataagttgtccttgttcatcttctaacatccgattaggagaaccatagggaagattcaccacactgtcaccactaacataaactactcgaaaaatatcatacttcatctcagtggagaatcgttcaagatatggcatcatccactttctatggtctgagttgagaatccatgagtaacaaaattgtagggactgccacacatgaatgcataccactcttggtaagcattggcctttcatgcaaaggcccgcagttatgccttctgttttgggaaaacgagacctaaatattgctaggactgcatagcacaagtcattaaggtccttagtagttgtgattactgagttcatggagattatgtcaccagtgctgaactttacatttaaagatccatctcttgattctccagcatatgcatcaaggaaattgtgttcaaccaagactgccattctagttacattattggttagcattgattgctgtaaaggaaaaattgcaaaattgaataaataaataaataaataaataaataatcagggcatagcatgttgttggagataccgcattaactagtatatagacaaaaaattaataagagacaattcctactccaggagctagtttttagagttgagttatgctcaaatctaaattctaagatatatgataaactaatcagattacagaaattaaactatggatctagtctgcccaagtactaatatatcttcatttttaaaataataattctcacgtgaatatttaaaggtgaagatcaatgcacattgcaatcatgaaacatttacttactccagctactttataagtttgagatattctgtcatatcaggaaagtagaaaactagagctggcttctaacatgaaatgttaaattatttttttatgaagagggttagtttttcttggcatgcctcttatgcatggcataatgtctataaagacatgccagtcaaattctagatttcttgtcccgcaaataatatttatttagttggaatttgaagacatggatgtgaatgagcctttggcgcttcatgatcatgcatagtaaaactttttcttcatctacattttattccagaattcttcctcatgaagagggtgtgtccatgttaattaacgggggtaatgtggaatttcatgtaataatactttcctaactactctttgaaaatgtccaggtttgggaaatcagtacataatgtgattaatatcatcaatttgctacaacagcataaaccacataaggctttctctccagatgttggtgtttgtgttatagtttagaagcagctagtcaacagatcgattttgcattatgctttgtgattctgctagacagctgcagatacagttttttagatgacttggtgagcattgttttgtatttcatttctcttctaataattccttcttttatcgaaacacacacacacacacacacaattgtagttcacatataatttttgctcacataaaggattcatcagaattgtcttgtttttgtatatagatgtctaaattttattaaattgctgtcctattgaagtacttcaaagtctatttcagtgcttcagaaaagagaaccaataaagcagtccaatagttagggatcaaacttacaagatttgctgtcagcttatctttttcatcattagatcgtttctgccatgctccataccatatgatctgattacaggacatgatttttttttttaacacaaagtgcaaaaaagaaaatagtgaagcaatatatgctcagtgggggaaaaagaactagcactaacacgtaccaacatatgttccatgtaacagagtaattttcagtgacacatttcattaaaaaaagaagagtagccagctcattaatgcacctgaactgaataatgttaatgatctgaaaaactcaagtgggttggtcgtcttggttccaagaaaaaatttcagctaaataatattaggaattagaatttgtgtttctaattttaggaaaatgctcactgtagattagccacatgataaactactttaacacattaactacgagttgatgacatatttaaccatcactgatgctagactatcacggaggtatgaaacaaagaaattctcatctacaaaatattagaaatattacaaaaggaaattatgtggaataggaaaaagaaagctaaaagcaacaattgatgctatatattttgtccttatgttgtgtctactttgaagccagtcatatctaaaaatcattactaattttggtgcaatcttcccgttatggctatcccagtcaaacaatacttgcattacaatttaacagaagaaaaaagggatttcataagtttatcagcaaaatttcaagcatctaaaaggaaaagaaagaacatactcttgagaattgagattagagataatttaagagaaaattttcaaaactaaatgacaaaatttaaaattagagaaaggaaagaagaacttaccatatttccatgtatgctcctaaatatagagctttgtacacaaccaagattctgagtgagtaaggaaaactgttgcagtccatgaacaagatggtcgacaattactacagttggcttgaaaacatagaagcttatttccaaatctttgttgttaaaatccagagagcatgtcatccttttctttatgactctaaattctcttctgcactacaaacactatttatgttttatttgaaaggctacaaatactgttctgtctgtgaaatttgtcaaacacgagtcgtgaagcacaacacacgcattctcaaaacttaatcaatgccaaggttgcttcctagaatttgttccaaatattgaatttcggtgtagagcagttcagttggctatttcgttttgctttgccagaaactaccaaatatatttaaatataaggtgacttggaacttggaattatacattcacatgtgtttgacttattcaagatgcttactttattgtaccaaaacacagatttttatctctaacttgtagaattttttaagattgtgtctttaatgagagtttaacttttatttaagaatggcttatgaaataaaagaataaaaaaattaattcaagttcgaatctttactgcacaattacgtcaaatatttgaaaaaataattttattatttaaattaaaatagtttgactaactcaaataagattatctctttcttagaaaatgtaccatttttttttattgtattaaatagaatttggttagtgtgcatcaatggtattcctcacttcacagtaaatactaattcctattgagttagagaaataattgaaatgaggaccatctttctcaataaataatgtataggttttattttttattctttaataagtggtccatttataataactaatgctaaacatatggcaatatataatttatagatagtaaaaaatattttaaaataccaacaaatttaaattatatctttctaactttcaacttgaaaaatgatcctttttaatatctgaaaagctcgagtcaagatgttaatcaagtgataaaattaataaatgaccaaaatttatatttatgacaaataattatttcgactcggtaactggtggtttttttttttttttnnnnnnnnnnaagaataaaaaaattaattcaagttcgaatctttactgcacaattacgtcaaatatttgaaaaaataattttattatttaaattaaaatagtttgactaactcaaataagattatctctttcttagaaaatgtaccatttttttttattgtattaaatagaatttggttagtgtgcatcaatggtattcctcacttcacagtaaatactaattcctattgagttagagaaataattgaaatgaggaccatctttctcaataaataatgtataggttttattttttattctttaataagtggtccatttataataactaatgctaaacatatggcaatatataatttatagatagtaaaaaatattttaaaataccaacaaatttaaattatatctttctaactttcaacttgaaaaatgatcctttttaatatctgaaaagctcgagtcaagatgttaatcaagtgataaaattaataaatgaccaaaatttatatttatgacaaataattatttcgactcggtaactggtggttttttttttttttttnatctgaaaagctcgagtcaagatgttaatcaagtcataaaattaataaatgaccaataatttatatttatgacaaataattatttcgactcggtaactggtggttttttattattttttggtagttgaaaataaaatatttagtcttttttttttttttttgaacgaatatgtaccttttgacacgttcaggtctacgtgaaatgttcatgctttaactataaacacatataaggcaaccacttaattaaatgctggtgtgggtcaaatcgaacttgaatgcgtattgtcttttcggttttgagtgagagcgagcgagacaaggtcacaaagaaaaacatattttaatatttcattaaaaaaacaaatttaatatttcataaaacttattaaataaaaaattaaatacatttacatttaaaaaaataacaatttaatattaccttaaattattgaaagggagacacaagccgaaattcgaagactacgttcacgagttgctgttcattgtagacccacaccagttcctcacgtgtaaacgttatggaggcgttaatacttaatataataggtcacacgcatgccatccaaaatcagtcaacacgcctaatagaccacaaatatcttggccactagattttaatgttgattaaattagtttttttcttttaattttttttagatttgatttattattctaatttttaaaattaattcaatatatattacagtctatattaaattaacatgtcaagaaaacgtattttgtaacaaattaaaattaaaactaccactaaatacttttaaattacctcaaaacatatatttcctaaaactgttaatttaatttagaaaataagagcaaattaaatcaatttttaaaattagaagactaaattgaatctaaaaacaaattaaaagaccaaattaaatataaacaataaattaaaggaaaaaaactaatttaatctttaatatttttagcctcataacttttccacctaggttatgtttaaacgttttacagaatggaatggacgaatgtaattaacaactaattgtctttctccatcttgattaagaacgggaaagaattttatacgtagatcttcaatataattttcaagaatttttattttatactatataacaaaattatagggtgaaataataattgaagtttttaaaatgaaatcaaaatcattcttcctcgttacacttattaaggcgaataaaattgcgagtttggcaaatagttatccacacagtaccttcacatgacattatgaccccattccaccacaaaaattaacaatgaaattgaaatacctccccaactagattggagttttttcctttctcctcaactatattaaattgctgtctaatttgttttcagcatcgggttgtagattacttcttcgtatacaacttcaaaaagtttaattagaaaaatagggaatccaccacaacaggaaatcatcctttctcttacatagaactaaaaatgtcttaatttttgggtaaaaatatggattcatcagattgttgtaggatcaaatgataatcttaaaaaattatttcagtgttctccaacctaaccaagatcaacagtatggtaatattctcacgctcattaccctgcaaggacacgagaatcaatttttcattgaaatacaaacatgatccacaggaaaaggtattgggggacgagacaaagtatcacatgtctatggccaagtatgacttaaggtgaccttgtttaaggagatcaggaaaatagtttgaagaaaaagaaaacaaaaatagaaggtaacaatattcagaaatgtgataatttaggaaatgcaccctcgaagaagggtgagacctcaaacgcaatgcatgatactgatcatagtgaagagttcatagtctgtatgtgctacttttgatgagactcagattcaggtccatgagtattaccttactataagtttatgggcactctcaaaccatcgtgagcaagctgcaccaatagtccttccctaagcacaattatagaagaataaactccgtaatttgctaaaatccataacataccactgagtacaagcaacaaaggtaaatacttgaacaacattcacatagtgtaccttctggaccagtccattaaaaactcattgtccttgtggtgatcaaactcgtgagtcattccaatcaatagggtttgctttggacataacctcttcacagtttcaagagcctaaattacaaccaatgagactttgccatcagagacataacaagcctgaacataattttgtaaaaagcagaactaacctgtggaagacaaaagtgaacattatgcgatccagtctgtggtaacataaagaggaatatcaagaacactactatctttgagaaaataaagaaataagaaaactaaaaaatggaattgagaaatatgtattagaaaaggcaagaggcagaatagtcaatcaaatatgaaccttaaaaaatgtcaaaatgaagtcaaccatatgcttttgagaaaatttcagaaaataagagctgactaagaaccactttcagtgactgccagccggcaatattctatgctaggagagagttagaggaactgataaattgataaccagactgaatgaaataatacaacatagtggagtcactttaaaaaaaataatctatctgagatatttctacgtgagtgtaagtgcattgtcctttacacatgagaatagccttattcacttagtggcatataccacgcagactgagtgaccaacaacagttgaaaatgaagcactgacctttttcagcgtatccaatataagaagatccaactgtccagccccacttttcgaaatgactgtagaaaataggacattttgcctgtcagaaagccattctctgtagggttttataatgatgtataaattcttcaaaaacttctcattatgcaaactgccttcctatgaggaagacaaggctattcaaggtattcagcagttcaatggctttgtttatggttaagtaaatagtgcttactgcttcttcttgatgacataacatccatgagacattgaggttactttttcaggtctgaaaactaaattttagctgatatttgccgagttgaataaatcaatatcaaaatactttctttacagtttacagagtaacttgttagttatttttttataaccttgtggttaacatcacactttctctcttaacttactagttggtagtcactagcatgagatgagagataattgaaaaacaaaaccctcccaattgtgactctctcacttaacacttgacataaaagagatggataacatattagcattgggtataaaaggtagaagtagttggtgatggtcttaactcttaactatagagaacaaagttccacaatgaaggatagctgaagcctcctcatcaaagaattgcagggtaatactcatcataagaaatttggaatctttatattaggacataagtatagttgcttgtgccataaactatgcagttatgtctatcttttatttacaaaaaagacataacaatgtgacatgctgcacacaacatcaaaagatagatagaaaagttttaaattctaatttcaaactaattaactaagacatatacttattgcacatgaataactttaaagtttggttaaagagaagaaaagaaataaatttttctctgtttttatagaaaaatgagaggaaagaaaatgctattgtataaaataacctatatacccttattataatataaaggaaaagaaatgtgtattaatactccttttgccaaattctctccaatcaaatgaagtttacgagttaccactgatgaagtaacacacatgtttaagtaggaagaaatgacttcaaaactcaccatactctgtactagctggaatccgtgaaacatcagatatataagccaccctatttttctcaccaaaaaggaaacccaaacagatataatcctctccatgcattacctacatacaaaaatgtagcgcttaattccttataatgtctaaaaggggtattgcattcctaccatcaatgacaaggtttgcggtgattaactggcaaaggaataaattttaagcctgacgcagaaaatggctgattacaatcatcagcaattatgttccagcaacactgagctacccttcgtatttcttgcccttctttgtgtttcttctgaaccaaataaggaaacaccttttccatgctgttgcaaatgtgtaaacaagaaatcaactatcttaagcaaactggatcaataaaatcaagtgaaaggggaataaagctgacataagatttgcactgtaatcagaaatatttttctaatcatacaagcacccaaatttgatggttggaatgtaggtcaatagagtaccttttaacttcctgaccaaaaagtgatacaaattttagcttattagtattaacaaattttgcatcaattcacttctatatagcaaaaaactctgtttatcaatgcttccttagagctcttactttaacaaagaaaagcaaaatataataagacaacacctatgctcccacttgggtgccaattttcccactaatctaggatatttgagcagctggcatcaaagaaaaagggaaagttagtagagtttacctatccattgaatgctgagttaagtaaatgggggtgggatcaatatcattagtgggactaaacggctgcacagctcgtatatcatccaatccaaggactgcatcagcatgttcatgagtcaaaagaatctgcaattcaaacaagaacaaactaacttaatacaccaggtaaactattaccaaatcaagctccatctgcaacaaaacaaggcacctgaacacatacaaagtttcactcatatcgaatctaagttttgaaaatctttgaccaaaataataaaataataaagaaggagatataaggttgggtgattgaaagaagggaaggagggaaaggtcccgggtttctttcttgctaacaaaaaaaaaaaataataataataaagaaagaagggaaggtgagtgggtgactaacagaatctattcttggaatgtgatggaaaacaaaccacctaagtacagtctccctgaaggtcttgccagcgtcgatcaatatatatttgtgagtggcgtcgctttgagagtaataatcgattaacagagaggtattgcacctgcaaagttaagtcaataatgaaagagctcaattcagtcactaatttgtaagtatggaggaatgggaaatgtgaagggaacctgtagttagggtttaggtgaggtgggagggagagagattgagtgcagacaggacatggagggtctgaagggtcgatgaggcacctcatcgagggaaccgttcctgaaactcccgttcccagaaatatcaatgccgactccatagccacaacacaacactaacggaaaatgtaacaaaaatgtttggacgaaccaacactagagatcaagtcatgtatctttcataaaaaataattctggtctttaatacaattttatactcaagattctaattcagacttgacattttttgattaagttaaaagaatcttatgtcacacactcgatgatattttcagtaacacagaaaattgaaaaggagaattgtaataaataaataatttatataaagtaattttaagattaattaaaaaatgaaaattttattattattattagtattttctaaatataaaattatttctaaatataaataaattattgttccagaaattaaaaaataacaaatcatacctcatgccaatttaaggggagggaggaagtattttttgacgaatctcacaaaaatactcacttctaagtagcagtagtcattgagattaaaaaaatgttaaataaattattaaaattggaatttgttagtcatattgttctgttagtaagttatacatgtcacatgccagaatgacaataattttaattttaagaatttatttgatattttcttgatttgaaggactattataatttataacaacacttcatagatttcggaattaaaatgatagttttttcaatttttttacttcaaaaacttttcctgccttaaacttgaatatcatcttcagtccctaaattttactcttaaaacaaaaaatagctccctttattattgtttttttttcaaacaaaatgtagaaacttgatatttttactatttgattgaaggtattgatcagtccacaatttatcaatgcaaactttacaacggaaaagtgttcatagacatccaatatgtcattatatacctaatgagaaatagagaaaaatataggtatcatagatattttaatgtgatatgatgaaagagataaagagaaactatggatattgattatgtatttaaaaagtacaagtgtgtgttacttttgatgagaaaaagggagattcatgtccacaagtattaccttactataagtttatgggaactctcaaaccatcgtgagcaagctgaactgatagtccttccctaagcacaatcatagaagaataaagtctgtaatattctaaaattcataacataacagagtacaaactacaaaggtagtaaatattttaaccaccttcacatagtactgttaatactggtgtcgtgattcaaatatattacctattgcatttttagcagttaaagttgacttccttgaaaaatgggaagtgtaccttttggaccaccccattaaaagctcattgtccttgtggtgatcaaacttgtaattcattccaatcaatagggtttactttggatgacctctttacagtttcgagagtctctgaaattacaaataatgctatttcaccatcagtttgaaaaatgcggaactaaacctgtggaagacaaaagtgaacgttaggtgatccagtctgtagtaatgcaaagacgaatatcaagaagtaaacaactatcttttgagaaaataagataagtataaaatagaattgacaaatatgtatcacaaaaggccagactgaggatgatcaatcaaataaggtgaagcttcacaatcatgggacaacaatgatgatgcatcttgcaaaaaacaagtgtagaaaaaatcaaacagaattgtttgttgacgattgagagaacaacaggaataacgagcagaattgtccattcagaaattgatgaaaacaagtttcaacttcaacttcaaaagctgataaagcaatgaattattggggagaaaacattgtttccaaatcattccgctacaaataatcgatttacatttattctgacatgtcttttttgctgaatctatctttacgcgtaacttaaagaacaaaaactggatactaaagtttaattgttacatccaatagattttatcttaataggagtagtgtttagtaatcgtattattggcctttcacgataaagtttgttgagatctcacgtcgacttgatatatcactaatgtagtctttatgtagggttgagttaggttttaagactaaattctaagatggtatttaaatctattgtagatttgttattaggacactcatatttgtctatgctgtcaatgtctattactactcatgtgcaggtattgttattgagccattcgcatttgacctcactctatatgtctcgccctaggtgtgaagggtatgttgagatcttacatcaattagaaataagaccagtgtaatccgtccttataaggcttgggcagttttcaccttacaagccgattttgtgaagtttagttaggctctaagtacaaattctaaaatagttatcttacttgtgaacaagatgttttgtttgtcttattaaaaaatcaatggggaaacttactataggagacagaacgcttaagtcattctgtaaaacaattgacaaaagaatgaatcatatcaagccatacaaatgaagatctgacgaagaaccactttaagtgactgctagtagcaaaatcctacgctaggaattgagaaattgaaaggaccagactgaaagatataatgcaacacagtgaagtcactttattaaaaaatttgtatgagattcttctacacgcgagtgcaagtggcaagtgcattcttatcctttgcaattcagtggcagaattcacacattcacctggaatacaatatccacactccataccccacacatccactgacaacaattgaaaatggaagcacttaacttttccaacgcatccaatataagaagatccaactgtccagtcccgcttcttgaaatgactgtagacaattttgctgttagatgttacaaagcacacttctgatagggttttataatgatgcattaatgcttcaaaacgactcattatgctagctacattcctattgtttcaatgaggaagacaaggctacaaattcaagctattcagcagctatggctttgtttacagttaagtaaataatgcttacttactgcttcttcatgatataacatccatgagaactgaattaatttttcaggtatgatactaaattatggttgatctttgatgagttgcataaacaaatattgaaataatttctttaaatgagtaatttgttagttattttcttataaccttgtggttaatatcacacttccctcttaacttactaatcagtagtcagtagtcactagcattagatgggagatagtttgaaaacaaaatctgctcaattgtgactctcttacttatcacttgactgaaaagaaatggataacattgggtatagtaggttgaactattgaagtagttcgctatgctcttaaatttagagaacattaagttccacaatgccttaaattataataccttagtattttctctgactattatagtcgtttgtggcatacactatgcagttatgtcgctcttttgtttacaaaaacacatgacaataatgtgcatttctgggtgtaattataatttcataacaccatctccccctccctccactttttttattttttattttttattttttttatgcaagttaaaaacacaaaaaaaagcccattttctcatctatattctttcttcacaatccaatccaataaagtttatgttatgagagataataacactaatgaagtaacacacatgtccaagtaggaagaaatgactttaaaacgcactatactctgtactatctggaattaatgaaacataagatatataagccaccctatttttctcaccaaaaagaaatcccaaacggatataatcctctccatgcattacctacaaccataaatgtatcacttaagtcatcataaagtaaaagggttattgcattcctaccaccaatgacaagttttgcagtgaataacgggcaaaggaatcaattttgagcctgatgcaaaaaatggctgattacaatcatcagcaattatgttccagcaaaactgagatacccttcgtatttcttgtgcttcttctttgtgttttttctgaaccaaataaggaaacctcttttcgatgcttttgcaaatgtgtaaacaagaaatcaattttctaaagcaaaatggatccataaaggcaagggaaagggaaataatgctgacataaaatttgcattgtaatcagaaatattgtctaagtatacaagcacccaacatttgatggttaagaagaacacataacacgtgttttcatcttaataactcatgcacccgcaactactctcattttagagtattttcagaaagtgtaatttaattgagttcttgtaaataactgcgatgtgataacaacatgagttaaatcatcaaatgctgaaacttaaaattgaagagctatgcagatcaatagagtaccttttaacttactgaccaaaaaagtgataccattttttgcttaatagaatcaatgagatgtattttgagtcaattgactgtatagcaaaaaaaaaaaaacgcgtttaacaatattctctaagttcatctagtgtatatgctttcttaaagctcttaatttcacaaaataaagcaaaatataattacacaacacatatgctcccactaggatatttgacctgctcactctgcatttgagcatgactctgttactttgggtcactgtagagcacatttaacttgtaaaacttttaagtgacatttctgtaggtctaaagaataaagaaagtagtgcatcagcatgaaatttcaactttatcagacaagttaaataaaataaaaaggtaagtttactagagtttacctatccattgaatggagacttaagtaaacgggggtgggatcaatatcattagtgggactaaacggctgcacaacaagcatatcatccaatccaaggaccgcatcagcatgttcatgagtcaatgcaacacaagcaagcactatctagtttattacactaaataactattaccaaatctaaatttgaaaaatttaaccaataaataaaaaataaaatagtaaagaaacaagggaagttgagtgactaacagaatctactctaggaatgcgatgaaaaacaaaccacctaagtacaatctccctgaaggtcttgccaacatcaattaatttatatttgtgagtggtcactttgatagttgtaatcgattaatagagagctattgcacctgtaaagttaagtccgtaatctataattattataagaggtataatcccatttcttttggacatttttactctcaactattatatattactataacattttattttaattttcaacaacaactgttatatctttcaaaacaagttacacccaatcttatatatgtaatttccaagtgcagacacgaaatactttttttgcactagtatatataatgtaagacttaattcaaaattagcacaaacgtataatgtgttgtcacgttaatccttgaaactaaagaaattccaaataattttctgaaatttctaattgtttcatctgagttcctcaacttaatcaattattattgttttagtccggaagcatatgtcaatattatcatccaagtcaaacataacattttgaattttggactaattgattgacggattgcaatccagtttgagggactaacgtgacagtactatacactacttaaacgttgtttacttgtttctgaaagcagtgtttgaaaaatgaaaattgtcacataattcattgaaaaatgtatttcatgggtgaaattagtatgcgtgtggctactgcgttcactcgtagtcgtagacgagctagatcgttaaaatgcatatttaagcgacttatgtgttaatttttatgctagagttgaggagaggactaatactaattttccgtgacactgagagtgaagaagaagcaagaacttgtagttaggattgaggtgaggtgggagggaaagagagtaagcgcatacaggacatggagtcatggaggatctgaagggtcaacgaggcacctcatgcaagaaaccgaacccgaacttcccgttcccagaaacatcaatgctgattccattgtcacaacacaatacaagcagttaagtgagtaacgtaggagggaaggaagagctcaagagaactcattttaatacatatatagcctttaatttgaatatctctctcttcacacgtagaatataggacacaaaacaattcatattttacgtgaaatcctgcattttattttattttatttatgaacaagttcaaacaaggactctgtttaaacatatctatatttgccattgtataaacgaactgtaatttaatttataagatatgtaaagaaaaatatattatgaagatggcgtacgtatgttatgggcggtccactgatcaaatcgccccacattttaggacaacaaaacataattaaaagtaacaaaagatgattattatatatatatttattgtagactaaaagtttaggtgaatttgcttctaggaatttattaggattaggataaggtttatcaaacttttgtataagtatttataaattatccattaataagttctttacatcaattgcgaaattcaaacttatatctctgtgggatgagtatgatgcttattattcattactaaggttataagcacaacttgattagcattagagccaagtcaaaaaaactgaaacaacacgttgattgttgagcaaatagaatcggaaccaatgagaagagcacattaaaaaccaaaaattgaacaaaacgtacggataaccgaggaggaggaagagaataataaaagataagcatatctggtagagatgagcccggggtaaaggaaacggtggcagtagattgcgacttggggggagttgcaaacaaaagaaaaaagtaaagattaatgtttgtgacgagattttaaatacgttttccagttaattcaaatgaaaaatttataattttatgtccttaaggtgaagtttgaaacacgttaaaataatatacgatgcaacataaaacaaattatattttatttttggcatatttgaaaacagaacaaaatatggcacgagattagaagttttcttggtacgatatatatatatttttttgtacaaggagacttagaagttaggtggatatatttgagttttacttaagaaaaggtaaaattaaaacaaaaaggaacaaaacacaacattcttattttgtgttgtgcatgtgtcaaatattaagtttgtagaacatgattcttaaaataacatgtttcaaatagcatacatttaaaatattatatcatatttaatattatttttagaaaaccaagagaccagctcatacaaatccgtatttaaaacattatatgatatttaatattacataatttcatcagccaactgaattaaattctttcaatatttttttaaattctaatatcagttagttaaacaactttcaattttgtgtcattttcttttacatttcattgacactcatgttttttttttgttagtcgtcctttttcataacatcacccattataccacttaagagatataagatttatttaatgacaaaagagaagacttaagaatattgttggtttgaatctttcacttatatttctaacaaactaacatataatataaaaaagtccatcatatcacttacttatttataaacaatcactccccaatataagattatctaatggtttgattttcatatgtacctagatttattggtccaacctaaccttactttgagtcggtcgaaggagcggtgctcaaactgtggctgtaaaatcaataccaaaacaattaatcatgatggtggtaaccagctaaaaaccatttatataaagcacatgcacttcatgccacgatgaagcaagaccacattctacttgcaagattaaccaataagcagttgtaagggaggtagtggcatggtaggatataggcataagatccctaaatggattagttttgaggaatcttgtagggcagatgctagtgcatgttcactttccagtgtcacatgagaagatggaaatggggccaggatctagcttttggtgattgaacaagaatggcatgcgcgaacctttgtatcaatatgcaacattgaatgttaggctggtggggatataatatatatatatatatatatatatatatatatatatatagttttgaagagataaattcacaatgtgcttcctaccccaaaattgtgtggtttgccattcagtagaatttaatttgattacatgcatgttacgtacgaccttgttgtaatttcaactaaaaagaagaaatgaaagaacggaaaggtgtgaaagactaatgatttaagagaaatgcatgcaagctttgacttgcttttgctattttgcacagaggacatgcatggtgaaggtggttttacttttcacatgcaaaggcaacaagaaacggtttgtgtttgcctaagggcagaactgccaatgattttgcttctttatttccccccctcatttgtttaatcatataaatttaggagaagtaagatgctctaccttgtttcatatatatcacttagggttaactagtaaaatgaattgaaaggaaatcatcactttcaaaaatctgtatatataatttcatccggccggtcatacacattgattgcttgttctcaaagcgctaaagggaaatattaacaactcgttatctaacacatttattcaaaattataaaattttatgagttgtatttcatttttaataaattatactaataattttataattttaatcaaaccatagagaatatgttaaaaggaatgtgtacgttgccacactcctcatatatagtgcatgttatactactttccagtttaggaaatcaagattatatgaaataaaaaaaaaagaagagaccctccattctatatccaagaggtcaaagtaaaacactacttcacgtgagtgactattaattctatggggaaacttttatgatcaatattgtcaaccgatatcatacctatctgaaaccactatacaaaataagaaatccaagtttcattatgaagtagcgaattactttaagattatcaaacatctatacggtacccaaaaaaaacatctcttataaaaataatttctaattttatatttttcaactgccagctgattggtgcttgaaaatcaattcacttcatgattgagaaatacgaggggacaaaacacataattagtgaactcaaggcattcaatccaaaaccttaatataattaagttaggtttgtgttttttttttatagttatatgttacttaacttgttaatttctattaaacgtaagataggtagataccttttgatggatcaaatcaaaccttactctcatggaaacccaagaaacaaaatatcttaagtatattattcgacagttattggttcttgaattgaaaagtacttgaaaatgaggcatcaacaacaaaattcatcctgaacagttctcgatctgtcgtacgtagaacgtacaccgatagatcagttttcttgttcctcatttaagtattcgactacaacgtctagatataatactatattcatatgttctaatcagttatctcttgaaatagttaaaggcataatgacactctcatttgatgttgaatacgaggaagacgttgcaatattacatagtagaacattgtgtttaaatcatagcaatactacagtgcttcctgtctatacttatcttgtcggaaatatcttttatatatatatatatatatatatatatatatataaagggatcaaattaaactggtttaattttaacaactattatatcatttttataatttaatatacaatatgacttttattgattttaagttaaattatatctatatattatcaagatttttttttgtgttaaattttatcaaaattaaatagtaataaaaaggtaattaaatgatctatattttaatatattttgaaatatttatattatatcaattttaatatatataaacgagataacaaataaatttagattaatatgaaattttacatatataatcaatgtgaaagaaactttcaattcaaatatgagttttaaaaaaatattatctaattaaaagttataaaaaaatataataattattagaattctataaatataaatatgataaagataaagttactgaattttagctaaatctactcttttctctttcctttgaaagttggcactatctatggatatatcagttaaatctacaattctacacttccttggaagtttggcacacgcctgattatatgtcctgtggatagtatggtaaaagaattgaatagatgtgattgacttagaaattctaaaatggaaaaactgagagaaggaaaaaagaaacactaattttaattaactgtaaaaatgtgttttttttttttgagaaaaaattgattggttaatacctaataggtacccagtcatatctcaaatcagaactaattttagtagcgtgataccaaatcgtgtatccttttttaaaaataattttaacaagtatctaagtgcatttacaggtaccaataagaattgagatcacctttttcgtgtctcactgcttgtctctctaattaaaacttgtcatttcaattaaaaattactacatgtaggatttggaatcttctcaatacttctttcgcactataaaagcgcacacacccaatacgttcttcgccatctactcctaggtcaaagcaccgtccaccacaacaaaacactgatttatagtagcgagccactaataattaatgatcatgagaccgtcataaaatgatattaaattgaaaagtaaaagagtgatttttgtagttttaaatttaaaatttagtattagtaactactctatcttttatttgttcaaatattacgcgatacgatcaaaatcataacttatcttcgaccaagaatcatggagatagaatgacattgaagactattataaaaacaaccctcaacctagagagcatatatacatgtcacacacatttgaatgctctggttaagtctcccaaaccttagaaaaacttatatgagaaaaatattgaagtatactttaatcattgaaaatattagcatcgtactcatcaacacattttttatttattaatgctgtttgaaagacaaagataacttgatagacgatcaaataaaagaaatactaaaaaatatagatacgtcagatatttttaaggtataacttttatcttacacttaatatatacactcaaattcgtaactcttgatatggaaacctattgataatcataaaattatatgaatattttccctattttaataagttttatttatattttctaattttaattatctataaagaatgtggtaaaagaatattttactgtcaacaaaaattaatccatttgaaaaagattagactcattccataaagatatagtttgaatccaattgtcaatataaaggtcatgttagaaatcaatctataagtattttttaaacctttaagatatgttttatttcttgtgagattctgaaattcaagtacctagaattttgtctacaaaaaaagtattttctaattcctctcactaaataatggaaactgagaagtcaagcttacgtatcactcttgcacgttgatattgcatttaaacgaccaattacaatataatggagaaagaaaaggacacaataaaaattgaacaccataatcatttaggccactcggttagttgttggtagtcttgcatcacctcagctaaaaatcaaaagtataatgattatgatctctaaatggaataagtaaagggtgaggctgatctcaaatcaacttaaggcatgcattgtccccttttgaggcatcaatcatccttccactcgtccactttttgtttacttttttcttcttcagctatatacataaatccacagttctgacattttcagccaatcccccaattaaaagcaataattagtgacaacaatgttctaagggtactagcttgtttacccatgcttctttttttcccttgaattatttttatccgcatattcttttccccaagttcaaaataatacactccaaaacaatggcttgacaaactcgatttggggcatgacgacaaccgaaagggtaacacagaatcgcatgtcccacagaaaaagaaattcaaaagcatggtgcgaaaaggaggaaaagaaaacacaaccctcattatgatgtctgtggggacttcaattccagcataagcatctttccaggaaaggaaagcaattctatcccaccatgcattttcccttcaattatcacacaccatttgagagaaagcaaaaacaatcgtaggatgtaaacaaaattaattttgagtattaattaacctttttttttacaaattatttctatccatcagttttcagtaagtaaattttgagcttatttttattgaatataaaatatttttacacattttgtatttttttaacatatttaattaattatagatcatattaaatgtttttaattcgcagaattgatacaataatacaagatcttattaccgtattaacagtctatctaatatgaaaattatgttcaatttcattcttatgtacacaccataatcatgattaatcttttgatcccaacaagttacacaacacacatagtgtttaaagacccaacacaaaaaaatattaaatgtcttttattgaaaaaataagactctactaaaaaataattaaccaaattcatcaacaaaacttaattattggcaaatttacatctataacatgataaaagcacacacaaacattttatataaacttgaatgaaaaagacttagtatgccatacaattaccttttaacatctctataaataatgtgaaaagtataaaagtgaaaaaaaaaaaaacgtcgtagtaggaaaaaaagagtgtaaaagtcaatcaatgtctttttcacaaatcactttatttcttcagactttctttttaaaaaatttgtgcgtgcattgctctttcaactatcactctatatattagcgtaagctccatacatcaaacaatcataataattaaaaacaaagcacacgctacacattgtgttttccggtgattattccggcaactgcatgcaccggtgaacgacgccggaaatggacgagtcacagagaattggcatcggcttaatgcgtagtttccctagccggagatcggtcgaggaccggtcatcatctcggcggcgacgctccatcttctccggcccgggcatttcggaatctgtggacgccgacgactttgccgacgtctttggtggcccacctcgaactctccttgcgcacaaactctctagctccgggtcgttttacgaggaagttttccggccgccggagttcacgtgtccggcgccgaagggtggccggagcttgccggtgttcaggattccggcgaggaatgagggattttacagcgacatattcgggtcggacgatgaccggagatcgagagagaggtcgaggtctctgtcgaaagagaattcgtcatcggcgatgagttcggaggagataagccctcgccggccggcgattggagatgacgtggcactgtctggttttgcttcaaagctaaggtacttttaacagttgagagaatgagagagtcacccactgagaactcaactgtttttttttaacaattttacatttatgtccttgattattagttatatttgcataactatctccttcttgatgcatgcagttcaaccaaccgtgttagccaaattaattttgatttaaattgatgtaatttatgtttaaatatttttattacaaaagtaagttaagtagtaaaattcagtctaactttttggatgcaatgcaaaagttattaaagttattttaacctgtaatcaactatgaattccgaatcaattgttttaacgataaactattgaaaattcacccagaatcatgttaataggtatttcaacgtcatttatggagaatcgaatgtgaaacaaaacactgcattgagtgcatgtttgtatatgatagagtctaaaagcttttttacttaaagtaatattttttcttttttcttttatatattgaaattaggaattgcatgttgaaattcataagaatagttttttaattttaatccaaacaggccaatcaatattccatggagatggaactcatccactgtgatgcctgaggctgaggaatacccaagtaaacttggggtgcctctttttgcatgcaaggatcagtcatttgaaattcagcatcaggacaatgaatacaaggaaaacttcagaagcccccatttaggatcctcaagaagagtgtcatccccagaaaccattagtctcgaatccaattcatatcaaagcatcaaagtgtccactgatgactgggagcttaattcctcattttctgttgtctcttcgctttatcaagaacctgatgcaaaattttcagtgcatgatcatgtgctttcagaacaaattatagaaggtgatgatgatgacgatgacaacgatgatgaaattatgaactcctatgtcattgaactcaaccccaacctcagaagggaagagtgtggagaatcagccattgatgaagcaattgcgtgggccaaagagaagtttcaatcacgaagctctgatgaagaatcaagcgtgagaaactatggcaaagagaaaactgttggaataggtgattgtcttggctaataaaaagttccatacaaagttaacatgttgtagtcttgaaacaggcaatagcagacacttatgtttgtatcgtatgttgcaggaagctctgatgcaagtgaataccatgatgatggaattggaatagttcaaactcaggaggtaatatattggataagcctaaataagtatcagcatatcatatcatataactgatacaagcttaatcagatcttttatgaaaataaatgtttgaaatatgatgttgtaaaattgtgtgattaaaattgtgtgagtaaaaatgagtaaatgaatttccaccaaaaattacatgtattttctgaagcagtcaatagttccataccttgtaaaggcagtggctcgtattagtgttttcctttgttattttatttctatttcctcagaataaaaagtttatcgatacctgtgctttttctacagaagcaacagacagaaacagagaagttagacagagatataagattgtggtcatctggcaaggaaacagatattaggttattactttcaacactacatcatgtaagattttctttgttgatgatttcttatgactgaatttctgaaatctaatgttttattcgccatttgagtatacagataacacaggagaattgacctggttatattttttttcatttccagattcttaggcctgagagtggctggtatgctattcctcttaagagtctattagaatgctcacaggtgaagaaggcttatcagaaagcaaggttatgcctgcatccagacaaactgcaacaaagaggagcaacactccttcagaagtatgtagcagagaaggctttctcgattcttcaggtgtgtgaaatttatagaccatttatggataaattctacttctattaccattaagtttttttgagacaataaagaatgcactgaggatcaacgctgattttcaagtttacaatgaaacaggatgcatgggctgcattcatttccatagacgtttccttctaaccagtagatgactctaatcttgataactcagttttgtcttgagatttgtggacaaacaccaagcttgacattcggaatgtcgggagtgttggttgacaagcagcagatatagctaaatacatgaaactttaaaccatcagctcttttgtacaaatagttttactgatggatctgctgttttatttatgtttgtaacataacttcataagctgtttgttgcatgggtaggtattatttctgatgtagttaacagaaggtaatttgactggtcttagtatttgatttgtatatgatatgacatggaagcaagagttagtttgtatatgattcatatggaaacctataaccctattgcaactccatctcattgactacatgtcatactcaagaggtttcaatctcctacattttattaggaaaagaaaaactattcaatacccaatattaacacatgtaaatgcaattaatagaaattatttttaaaaaaaaaattataactacaatgtctcaaattcaatgcaattataaaattataactatatgaaacacaaggtggatatccttacatctaattgagttttatttgaattatttcccaatcaacataaggcctcattagcctttcaactataaccataactagtttaaatagagaaaagagtcctgcaagagtttgtgcataagtgggtggctttcaagcagccttttgggcttatcagttggcattcacagggttgctgtgggttgttcggaattagaaggaagtgaaggataataggaatagaagacgaaagaaaagacagaaaagagtctaaaagcaacggctcgtgcaactggcgttgtagacggaaaataggagtgagactgtcatgccattgcgggatgacacgttcatgtttgtttttgaatttgacatatatgatcacctcagtaatgaaatgacgaaattcacatttatttagcagtaaaaaaatgtacaccatttgaaatttaaacagaagggaaattttttaagaaaattctaatttaacacattactaaagggccaaaggcctagacacaattccgccataaaaggaatttccagtatttacaatttttaatttaatgctcaaattacacgtctttgaagcaaataaatagtttgataaaaaaaaactattattgattggcaacacagaatgatgcaagatccccgttctgctgaacaaccggtttccattgtggcattagcatgtgaaaaagtcggggaaaagcaaacatgtctgctacaatctcactgaactttaagcaagggaaactgaaatatataagcataccacgtatagtttggttaaatacgcctctataatcctgcaaaagctaggacaacaaaaacagttagagaaagcagggcaaagcaaagtttgagttgaaaaaatagccatttaactcttctaaagtaaagaagggttcatccacctttgatttaaggtgagtaaagtttatgaaaaatgtcaagacttaattatcaatttgatctccaaatttttaaaagctctaatttggtccttcagatctaaaaacacacatcaatgggtgttgttgctgcatattccttctattctcattcctggcgctgttggtgctggtaacaaccctagcggtgaagccaaagaagctgcagtttgatctggagcaagttggggggggggggggggggggggggggggnnnnnnnnnnnnnncactgcttcaccctctctcatcattttcctcctcttcgccgccgccaaccccaacaaggtcgcgatcaggtatggccagtctagcttcaccatcatgtaccgcggcatcccattgggcaaagccaccatcctcggcttctgccaacaacttcacagcaccgacgggtcatcaccatcttgtttcccctcctcagatctgcacgtgttttcaaggctggtcgcatctccaatttggtcagagcagagagggatgcaattggagagtaaggagaggatggagacgttgacagcaagcatgtaggccatggtgaggaaagtggcagtgtcggcacggaggtcagtggtgaaggtggagttgcattggggaggaagagaagggaagaagataatgaaggaaaggaaaagaagaaaaaaaatatagtggtggtttttagtcgtcactatttgcaaattaaactgccaggatttgcatcctaactgtgtcagtgtcaatttgatggaaaggacctaactgaggcattttaaaaaaacttgagggtcaaattgaatcttttaaaaacttggggatcaaattgaatcttttaaaataatttagggaccaaattgataattaagccaaacattaaattaaatttatgagtggatacaaccttacttttctcatttcacatgcttattcatttcagaggagccaaatctatgatgtaaagtgacaacactttgtttatcatcaactttttaagatataagtctataacattagccacttacaaggaaatggaaacacacccaatactgaaacaaaatctcagagttgaccatggcttcggctcatagagtggttgcgaaagagtttttgaccaggtgcttgctggtcattctgctgcaagagattcaagccagagaaaatgaactcaaattattcaatgtagggtacacacatttatggattaatttaattacagaaacaaacaacatatgaagaattggatatttgtacacaatttctcctaaagttttctgtcttcctctaccacttttggttgggatgtcttccattttaccttctccaaaagactgatttgaacttatacctaaactaattttaacttataggagaagcttattcatttttttttctaattttcttcttttataagtgcttatggaaaagcttatccaaacaggatcctaatgcatattataagaataaaaaatgcatacacatggaagttggtaaagaaaatctcagtttgtcacctaaaggaacctaaagaaatcttcacacccatcaaacaaagtgagacagacaaaccttgtacaaggatgcagcagactcagacggtactgttggaattgcattgtgccccagcgacaaagcatccaaagcatctaatgtcagctgccaaccgcaaagggcaatttcatcactacttgtgcttggaacagaactagcacagccagcagcagcaacattgccattcacccaagggcaacattgattgtgatgcacaataggatcaaactctgcagcttcatagttactctctccttttggagggcctaaagaattgctcaatgtcagtagctatgctccaaaaatatgtacaactaatgaatgaagtgcaacaggagtacaggcattggaagaaatagatatccattttcaatttgatgctagatgaaaagtagcgacaagagtacatatatactcccatattagaatatatagttggagagtgatactctcactctcacttagacagtcaacattccccgctcttctctcttttggaggtgcatttcacatactacttttgcaactagccaaaaaaaattgtttctcaatgactcaactatctcaaactaccctccttttatcttatatatttgtttctcaatggcaatagtgaaattttaaaaagccacctaggtttcactttttcaaagatttgtaagggaaatggtggacaccaaaacggttgtgttcaccatttcctatacaaataaacaaaaataaagtggcattttagtaattgtttctgaaaacaaaatgttttctcaaataaacaaaccctaagtttcatggtaacatgtcaacaataacacaaaaaaactttgcccactaggtgaagcttgctacatggatcatgcaacacaattgtattctgtcatgaaccaagttttcaaaatctatttagacccaagtctttttatttgtctcacccagagttttttcttgatctttcctacctctcattattggactacctccataatccactctttattgggatttccattgattttcactcacatgaccaaaccactaaagggtgagaagtgagaaccatcttttcgtgctacccctactttctctaatgcatttattcttgatcgacttctgtagcactgacaaggcagggtaacaagaaaaaaagttaaagaccattaaaaatacagaggttacctatcccatttgcaatggcaaaatctgattcagggagagcacgattgttggcaaatgatgatttaccatccttcatgaccccttccttggtattttcacaaccagaataaacattagcattacaagaacgagatgggtgactactattagcaggtagaagattgcagttttgactaatcttttcaccactttcaacagattctgcctttgtagaacagccaatttttgacccactgtctgttcttcctgcagagtgagtcatcatctcctggctatcaccaataggatcttccctgttcatatcagggataatctcatccatgagacctggatctggaacagattcacctgtctgtccctgattttcagcatcttctactctctgttccatttcaccaacaacactatcagctctgtgcacagatatatcagccccatggatctcagcttcatgactagcacacattccaacactccctccactgatgcccaaactaattccatcacgagcctgagcagtcacagtttccgcattgaaaagttcttccccatagtttgtactactgacgcccacatcaccacgtgcaacttcagtagctgtttgtaagcaagtgctttgctgagcttgattgctgttattcagttcagatgtttcattcatgtccacattgccatatatgctagaggaggggaaatgaacatcatcaaggtctccagggtagttttcaacactttccatagaatcaccattcacactatgacatattgtgtccattgcaatgacagatgatgcacgggttgagtccctagctgattggatacccattgggcgttcactaccttgatggtatgaagaaactcgatttccagtaacgtaagcctctaaacccattgaatgacttggaccagcaccagatgaatctcttcgatgaggtgagcaatatgtgtcaaaaatatcagagtcacgtgcacgttttgaaggaccagctgaatattgtccaccatctgtaacttcatcaccatcacgatcaatgacaattccttcaagactatcagcctgctgctgcaacctaagaacaggcggattatctgagcttccacctttttcaagatttctcttacgagagcttggcccatgtgattcatatgaagcggcacgatcaccaatctcgctccctgaaggctgaccgatcattaaatcccttcccatatcatcatgagtatattcagatgtagctgtcctgcccaaaggagtaaaaggaaaacccgctgccatggtaagatttaaatctaaatccgtgttcgccaataatttcccctcatttgttgttgcaacttcgtcacggtcttcagtctgatctttctccgtatcgtcagctgcaatccaaccactgattccactagcagcactcgctccacgggtcaatcctatttttttaccagtatcaggaatatctatactgttagatgcaaaacgagcaggacgaggaactgtcagaaaatctgaaattctaactgtagcgccacacaagctacaatcaagcaaaggtgacctagagtcaagtctagactccttaagaggcgccttttcctttctggcatccaatttagtagaagcagaaactgcctttgacccaggatcttgagtaagatgaagttgagttttggttggcccaaaagaatatccatttctttcagattgggcagagtgttcttcacaatcttgaacatttaaaagccagcttgattcccacccacaaaggctaataagcttctgtgcctgccaaaaggaagatacattaatagaaaataagcatgtgacagagtagcaagcaaagtattaacaagacataaaaaagtaaaaaaagaaaagcttacacgagaatataaacagtatgcctcatcttgagagttttcaagctcagatataatgtctggtttgatatctacttctcctgacataaaattttgagactgtgatagaaagcgttcaatctgtgggccacaagaaacagacatcaactcaattgcagagatggctaccacaggaagacagtcaaattgtacgagtccatcacatctatccttgtagcccccaattaaggcagatggaggagttggagggaactgcactaagctttctggacagctgtttcctttccaagggcagttaactttatgatccaaatccaggtgcctggcaaaggattcactggcattttgagctttggcaatgacaataagaaaacaagttaaaaacaactgatgaatataatcagcaacagcagagaagtcctttagcctagctaccggatacagtttgcttgaaaacaagatcaaaataagattatatttgtctaactctttgaagaaaacatatataaaaagatctcaaatgatttgaacagaataagagtcgcttgaatataaagagtaataacttatcttgtatgcacaacttacatactactttatttttatttttggtaaagtcttgttatacaatacattataggaaccttgaaacaaagtggtacaagtaactaaattacatccattattattatacttacatgctaactggtcttaatgttaaaaacagcgcatccacccacacacacaccctccgcggcccggtaacagacatgagctgaacaccctaatgaaatgaaaaatataatcctttccccataaaatatttcagacgaattggcaaactaatatgtattaaatctcatttgatagacaactaattatacaacatttaggtacacatttttggacatataaaacttcatctaggcagcatcattgcttttaatgttctacttatacactaagtgaggaaggactatatttatgtttggggatttacaagttaacaatagacagtagttctctgaaagtaaagctacacttgtattttcatcctataattttctcaaaaattctccctacttctacatctgccctgtacataaggtacctcaacaaagtacgccttttaacatccacgatccacatgaaagcattggctgttcttataatttctacctccagttattaacatgccacattttagagaaaacataaagtagccaaaagtacttagattacaaatttgcaatcaccaaccttcagctgatgtacaagatggtaatgctgtaaaactcagacaagaaccacatgactcgcaagcaattttgtctacaccattattcatccagcctttctgagcacaagccaatgaactgatgatctggaagaaattaaagaggacatgtgatccctggagactgcatcatattatctacttagaagatttggagtggcaagtgccaattcctcggacaactacttcatgcgaatgtgacagatcccagattaaaattaatttcagtagacaaataagtagaaaattcacatcaccaaacacattcagctggatcacttagtgtcaaagcttagagtgttactatccacacaaatgtaccaaagacataaataactgcacaatgcaacccaaattcagctgtcactattagattacaggctgtaagtagaacctagttttctatttatggtaaaaaagtgatacatgataatgattttgtttacattgtataacaatttaggttcctatcataatctataagcataaacagaaactatcacaagggtaatcattacatgtttaaaacaagcatatgcagtgttgacttcagacatacaagatacaactctttgtcatctaggcttacagaattcattattaagatattgaagtataagtgaatcagtaacatactacccacaaggaaaagatggacaaaaatgtacatatgcacattgtgacagtaatataattacggaaaaccatggtcagttcaaacctgaggcttcacaagccaatttgaaggaataaatgtagccaaacgtcttaataaatctcccctttcccaaggtctacatgaagatcttgaagaaccaaaagcagaaccaccagcacttgtgctcaaggaagtccatggtggttgtgaaccaacacatgagagagaagccgctttagagacctgcccatgacttgacccatctatgctgccaacattcactggaacagctggggatgatgccccagcagaactgataaaattatgaacaatttgtcaattgagagggtcaaataaacaacataaagaatagagaaaacaattgaatgtcttataaaaatatcacaatttacaatcaccagccatacatcacatatgcattaagttcaaatccataaaaaattaaaaaaccatctgttttacatgaatcaaggaaggaggttaattctaaaattgagctttacaaacgcacaatggaaccgaagggtattcacttcagtaggattaagacatcggatatatctattgcaattttagcaagaaaggaacaaaaagaaaatgacttggaactaaagattggagatgtcattaagtatctggatcaatattacaacatgatagagtaattaatgaatttgtcaaacactggatacaagttgagtggttaaatggagaaaggaatgagattatttgtgaccacaaagcacttaccaatcttaaagggaagttttatcatactgctatacgaccagctacatattgtggtagtgaatgttaggctttaaatggccaacaagagaaaaaggtaggaatagcataaatgagtatattaagatggaagtgtggccacacaaaaaaggtcaggatgtggaatatttgtatagggggagatattagtgtgacagctatcaaggaaaaatgacaaaattggataaggtagcttaaacacatgcaaaggtcactagaggctccgaagaggagagtagatcgcagtttttgtccctctgaaaaggggtagagggggatcaaggacattggaaaaaaatattaaaaagaatcaggtagtgaacaatatcctcgaaaatttggtttttaactgagcccaaagacatcatataatccatgtagtgacctcacctagcgagataagactattgctgttgtatctgttttacacaaaggagatatactatggtgacgatttagccctcagtgtgggtatttagtagagaaaacacgcgaggcacccgaaagaaatatttggtaggatagcttatagcctacttacttgcttaggaggttaagctccaaagctttttatccatggaacagaaaatagcataaattatctcttgtgagtctctggttataatggaggcaatagagaagggtttcaggaaaaaggagaagtgtgagatagaaaaggcttgagcaaaatggtagcgacctaagtgatcaatgaatgacacaaataagtatggaagtgtcctttatcacatttgtaattacacgaatcacgtcaaacaaaacaaacacatgcatagtaagggcataagcacaacatttcaaaagcacacaattcgcaacaaaaacagcacgagacaggattttttttttttttttgttaattagatccaattctcgaggtctaggagcagcaacagcaatagtatagcgttttactgttcgattgaagttcaatcgcaagtacaccgcgaaaccgagcagattgaaaacagcggttacagaaatccatgcgaaacgaaaccctaatttgagaagcatgcaattaaacgcttgcgaggaagtgagagagagaaggaaggtgtagttaagttacctggcagcaggtgttggatcaacggtgcctcctgagctgataacctcttccctcatttctcgaattccgaagcatatgaaaatgaaattgaggagtaagtgaagaaacaaagagtggaaatggcagcttcgagcacaagtgtcagagcgcgtggacgccactgcgaatattattttacgatgccaatgcctgcgcctgcattattatttctatgaaaaccaatataataatgttaaatctttctctaacattttttactattaacttttttacttgttaaataaaaatattaaatatatttgtattttaaaattttaaataccactactatattgttttatttaatgtttttataatgtatattatatataatacatgaatatttttaaattaaaaatataaataaatataaaaataaaatatcatctttgttgaataatgttgaaattacatattttaagtataatataaaatgtattctttattaataataaaaatttatttatcacttgaaaataaattaaagaatatgttataaagatctttataaaatgagtgtatttttgttttgggtccctataaaaaaaattatttaatattcatcatcgaaaatttggagtattattatttttttccctaaaattcattttaaggtatataatataaatataagtaatattcagggtttagaataaaaaaatagagatatcttacgttgacatggttctattagttaagcttctattaaacacatgaacagttaacactaacatgtaacaataggaaacaaaaaataattatttcataattttgaggaatgaaaatcaaatatattttttataaggattaaaatcaaaatgtactctctctatacggtgaaagtgtgaaactataaagtaatttctttgaactaaaaatattgaaatttgtgttaatttgtatagagtattgggtttaaatcttattaccttaactctcatcattgtaacgagatcttgatatttaatttaaggtcacataatcttaatatttaattatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaatttgatgcacgggtaatattattaaagatttgatatttaaaagtcacataattatgattcaaatatacatatacatttaatacacatcgaccaaaaaataaaaaaattgtgagagctaaaacaaatataagatcctaccagcaaattgctttcctttttaatgtctaaaaatataatctttaactggaaattataaaaagaaaaaaggtatcaatatgcctccacaaattcaattatctacaaggaattctgatagtgtcaaaagaaatcaacctagtatatacttcgaaaaatggccatgaagcttataggccctccgtattacaaaaagtattaaaaaaaaaatagccatgacagagtgcttcaatccattgttcaatgaatcaaaaactgtccactctcagcaacatgaataggcgtatgcataaaggccaattatatgtgagaaacaaattattttgcacttgatgtactcgcacctgcatataaaattgagacatacagcatattagaagttttgttttgttttttttttttcaattatcacacacattcacactaaagttaaaatttatagcattatgcattcttctaaaacctcccatcactaagctgaccctagtccctaggatctagagcacattagaagtttaaatgaagagaaaagaatacttaccaaaaagacaaaaaccattacacagagaaaaaagtaagattcagaaaaacatattactaccaaaaggtccaaaaccatttcatttttgtgtcattatcaaaactgagtaacttaccatctttttctgcgttgacaggctcttctttccaaatgatatcttgcagcccagcagagagatccttacagaactgcaaacattaacaatccattccactcaagttaataaacaaggtaaattatttatcataagaaaaacacatggagagaaaatgattcaacatcaaaatacacccttgttcattaaggtttatagaacttacattttcaaatttcagagtatcccctccagtctttcgaatctcaaccgtgtgaaagggagggtctgcctcagagatctgaaaaacagaatttataaaagcattagaaagtaggaatctctctagaacttaaatcttcaacctgaaaaacatgaaccttagtggatattgatagacgacttttgcgtcgagctagttccccttcaatactcaactgagatgcacaataagaaatattatcataagtagaaacttgatagcaagttatgattattactgctacaaattagcactgacaaggattctggctaggttgcaagtaatattattattttgaaattcacatgcatgagtgtgttagagacaaaacttcttaccttatagtttctcttcttaatattaaaacccatagacgctgcactactttcaattcctgaaactatctcattcgcagaacatttggatatgaaacttgtttcccttttagcatgcgcctaggagtcaaaaaattgatcgagttatcttaattaaccaaatggtcaagaacaaattcagaaatagtgtcactgataaacaaagaatttttttttatgtgaattacttgaaacaaagtctcgtgaatttatagtacagttaaatccggtaattttagggattgatacggtaattttagggattgataaacaaaatacagtaaatatataatgttttgacagaaggtatcatctatttacaagaatatcaaaaggaaaatgaatatttaattaaaggggccgccatagttagagattaaatttagttttttgttcttcttagtccattctatatcaaattatccttctattataaatttaagtccttggtcttcacagaggtattctctatgtattcatcttatatagttacatatgattctcatcttgtgacatgtgttaaatgcacattttttcttgaattgttggttttaaatctttggaaaccagattaaaacttttgaaagacttataatataactaaattgaaggtttctctgtataccttcttgaaaagatttcgaacaaggctcaagtgattagaatttttgaatgcattcctagtcacagatgctgaaggccacgcctcttgcccctccccaacaacattttttgaatcctaagcacaatatcaagcacattgtcatcaaagatagaatccaaaaggtttttcagctgcttcactgaaaccagcacttacttgatcagaactaatattttcctggaaagatctaacaggttgatgctcattcttgaaccattcatcctccaagatctcatcaattgtaatccgctgttccatgccatcagaagaggtgatatatattaacatgttaatttcatgagataaaagggaattgaaataaagaatatttgctataaagtaaaaaccatattagtatatatcagggctagctcaaccaaattaaacaagaaacatgtcaagtacttactgtagcaggacttggatcaaggattctcttaattagtctcgttacacttggagaaaaaaatgaaggacaagtgaaatcagcctgccatttctgttaacagtaaatttgaaaacaggcagaattcaattaattataaatcacaagtcagcaaagaaagatacatggacaacaacttacatggcagctcttactgaaattatttgaattttatcttgagtttatgattggttgtattcacttgtactacataaagcactatattcaattgctcatgatagaattgctcagtgctcagatatcatgagttccagagtaacagataaatgtgttatgttatgcacttatgctaaccaacattagcttcagaaacatttagtgagaattaccttaaggtataaagtcttaatgtctttatcattgaagggtaaataaccggccaatagaacaaaaagaataacaccacatgaccatatatcagccggtgcaccctcatagccagtgatgattgccacctatatagtatatgataagagacagcagtaatattattaattagcaagagagagaaactgaatttgaagtttaagagatataatatatagtatacctctggggccatataatgaggggtactgcatggtgtgtgaagctaacagtaacaataggataatcaattagaaattggacataaatgccctttgaatttttgaaaaattagtcactaataactcactggaacatgttgagacagtggcgtcattccaaaatctgacactttaagcacccccttagcatccagcaacaaattctctggctgtaattaatagataattaataaaataaatgttaatgaacttgttctctcttttattttttaaaggatgggaaacaaagtaagggacaacatatatattaatgacataagccccagcacctcactactcacctttaagtttccgtgggaaatacctctactgtgacagaaagccacagcacatataagctgctgaaaatattttcttgcttccagttctgtcagtgacctgctgtttgtctggcacagcaaaataacaccaaaattgtaaagagtgaatacaaatattgtagaggatttttatcccaattgatgcgaaaaggtaaaagagtcttacgattttatcaaacagttttccaccagttacatgttccattacaataaacaactttatttcggaatgcatcacctacaccaggaataatgcatctatataagctacttgcaatgaagagagagaagtaaaaaaaaattatggcaagggaaatttgaagataagagaattaaatctcgccatacaaaggaagtaatttccctttccttctaacctcatacacatgcacgacattcgggtgtctaataattttcatgattgataaatttcgatttatctgcaaaacagtaaacataccagaaaatatcaggtgagagtacatggtatggtattcatgtcatggctaaataaaaaaaaatgcattatatatactttttttttaatgtgaatgaacgtgtgcatgtctcttgaacagttaacacattcattatatataaactctatgaaaatattaaacactttttcgtcatgatattgactttaatatttcatttaaattctttattttcttctttctcaaatttaaaagtcaacaagaatggagattaaattaggaatcacacggtttacaatcgtaacttgtaaacaaagataagatcaatcttaatttttcgtatctaatttttcggctcacctataatcttctctatcccttccatatcaacattactctacacatttatcacatttttacaaccaagatcgagagattagaagtattaattcctgatcctcataaagtacgtacgtccaaaacccgtcataattaaattaaatatatcatatcctctattgtaaaatatgccatgatatttgaaaaggatgaaaataataatgtaatttaaatctgaagtggcataaagttttgtattaataatataaaccaaaaaaaggtatagaatatagattaatgaaatgagaatagaaaagtgagcacacacaccacgcccatgatttggttgcagagaagtgtgtgtttgtggagcattttgatggctacagtgtatccgttgttaacgtcacgtgcaagcttgatcatgcagaagtttcccgcgctcagggtttgacccagttcatatcttcccaaagaaaatgaatccgtcatcttcttcaagtttctttattcggatctttcttcttgcaaccctagctagcctcgttgaaaacttaatttcttgcaaccctagcaaactttgcaggtcaagaattaaaataacaaaatcttgtttgatggaagaagcatcaaattaaaggacgctaaagttgaggtttgcactatatgcatgcagaaatgagagcacagcagaatacatatggacttgaatggttgttagctagttagttattacagactaattatcaaagaactagttattaattacgacacttcttttcttaataaagagctagagggtctttttttttgttgttgttgaagattagaatatgaagaggaaaattgaagacagagaaataaaaaaaaaatgttagtatttgtatgatacattttttagtgggggttgagacaatcaacagaagagatttatgtaatgttatgaattacaattaaggagaagtatttactttcaattattatgtattgaactgaatatattgtatttcaaggagaaaatatgtgagaataaaaaaataaaatataattttataaaaacttttacttaagagaaaaaagtgtataataaaatagtatatataataaaaataaatagaaataaatatataaaaattagtatataaattttaaaatatatatttattggtcgatgcagaaaagtgatattttgtaacagttataataagaaaaaaaaatagactctaaatcagtgacaaatccaaaaatatttcttaatggtgacaataaacagtttataatatttttataagagaaaaatatattatgaacttttatataatacatagtattatgataaaagaaattcaaaatatttaagttatgtgtggatgtccattaaagatgctagatcattaaaaaatttaaaataaaataataaaactagtatcaatttattctttcttatattttctacattcattttaacaataaaaaatatcttatgatgggaaaaaaatattatacaaatacaaataaaaaaaaaaaatctttgtgggacaattgccccacactccaatatgtggatctttcactgctcagaattgtgctaaagaaacgaatttcatgagaaattttaaaatataagttgaaaagtgtcttgaaatgtaacaatatatacgagtcttagaatttcacccatctttttgtcttattaatttacaaggactaaacaagttgtgctcaaaggagttgtgagaaaagatggtctctatcagttgccccaattgtttgcttctgtgccttagtccaagagttttacaaatgttttttttattatctttaattcttctaataaaaatgttgtaaaagttcagttgttaatacagtcacttgtaatcctatttattttgctacttggcattctaggtttggtcaccctagtgttgatgctatgaaaattgtatttcaactttgtaatattctaaatattaataaaattcctatagatttttgtagtcaatgttatattgggaagtctcatgcctctcttccttttcttctaacactgtctatgctaaaccttttgatctcgtttctacttatttgtggggccctacaccatttccttcaccacctagttacaagtattatgctacttttgtggatgctagtatcaaatttacttggttttatttgctcaataacaaatttgatactttagaaacttttaaactcttttaaactattgttttaaatcagtttaattcttctcttaatgttgtttagtttgattaggaaggaaatttcaaatcctttaccaagttcttgagtggtcatggaattcaacacaaacttatttgtctccatactcaccatcaaaatggtgtagtaaagtgcaagcacagacatatagttgaattgggtctcacattactttctcaagctgagccacctctccactattgggatcatgcctttgtttccaacatctatttaattaatagattgcctttccttagccattaatcatgaagtttcatatcaaaaattgtttaacaagtaaccatattactaatttctaagagtgtttcgttatttttgtttcccttttctcagaccttacaataagcacaaacttcaattcagaacttaggagtgtctttttgggctattctccttctctcaaaggctacaagctagtgtcttgctactgatggaagactatacatctccaaagatgtcataatatgatgagtgactcatttaatgattctatgataggttttgatatcatcttaaaatattggtttgggtctaacttaactcaaaaattagctcataggatgaaggttgcctccacttatatattttatctttatctcatgtctagtgaatgtgaaactttgattttttttctaatagtgaataatatttaatttttatataataatatttacacattagtggtttatgcttaacttgtggataacctagtaataattaaataataagattaatttgtctcctgtaatttgtaatatgtagttttggtttcttttattttattgcgctgatatagtcctttaaattttaaaattaagtcattaatttgtattgtcgttatattagttgaccctttattcatcattttttccttgatgttgattatgatttatgacattgcataattatggtgtcagggcaagtgacatgtgattttcattgtatagcttttaatgttgactatattaaagtcatttaatatatttatgttaaaaaaaataaaaaaaatgggacacattggagaatccctagtcgaagaacagaaaaacagttttctcctttatctttgagacacacaagtataggaaatgtatctaatttccaactacacttgtgtccactcccataggaaatgtatctaatgagagggttttttatgattaaaaagaaaatttgactattaaatcgaattatcaatattaaaatatataattgatgtgaatttttttatatcacataactttttttaaacaatctttttcataacattaaattttgattatttatatataattgtattttcaatatctattcatttcactcataaaaaaaatatcttgatatcttactagatatgtctcatgtaccaacaatgattattaaatgataacaacttatattattctttaattaaatggttcaaggatcaatttttagttagtcattagatatgaaattttgttaatagtaaaataactaccttatatctattcagagtttcgaacaaaaattagttattgttttcgatggagatacttcatatcaatattataattagaagaacaaaaatgtctagtggggtatacatgttacattaaactagtaattttagaatttaaaatattgatattataataagtaaaatttatttaaaatattataaattgagtgttatttataaataattaatatatggttggtaaaattataatttctgcggattcatttacacctctaaaatatggtatggtggataactctttttagagattatttttttaattttcggagattaattgagttggttataacttaataaagttatatttagacttatcatataaactaataattatttggttagacatttgctagttgatatnattcgtttactttacatctaaaatatatggtggacaactccttttagagaaattttttaattttcggagactaattgtgtagttataacttaattaagttattatataggcttatgatgtaaactaataatcatttggttagacatttgctagcaaccttaagcacgcccattgacatgttaccgatacctaatagtattggaagtacgtactcttcgttttactaatttaaaaaaaaaaacaaaatcataattattttaatagagacaaagtcatgctttttcaggataaggtaaaatcatggttgagttgtatttttaaggtaattttgagttccaaatcatgatttgaataataaaaaattactttcccttcaaatctcatgatttgttaattatgattctaatacacctttaatatgtcatccaaaaaatataagggagagctaaaacaaatataagatactaattaagcctggcaattttttttaacgtctaaaaaataaaatctttcagtaagggtatcaaatatgccctcagtaaactgcgttaggaacaggaacaggcgcaaatagtatgtgacaaacatgttatgttgcagttgatgttgatgtattagcacctgcacctaaaattgagacaaacaacacattagaattccaaataaagaaaaaaaaattgttgaatcaagtatataataggaaattaagtccttaaaaagaacttaaaagggacaccaggaaaacaaagaaacaaagctatcttaaccaaccaaaacaatttcatatgtcttctccactttctacactccatgcatatataaaggcagagtcactacattttttttttttatcaatggaaactcatctcatttcattattgataaattcaacaatacaattgggaatcatatgacagataaagggactagcattgtcaatagctactcttgccaatgtatgagcaactgtgctagcttgtcgtctaaccaactctactcggtaagatttagtatattttgagcacctaaatactgtctttaatggcaatactagtcattatcgacttacccgggcctgcaattaatgtactctcccctgcacctaaaattgagacaaacaagtgaaacaacacaatattagaattccaaatgaagaaaaaaaaaataattgttgaaatcaagtataggaaaagaacttaaaagggtcactaagaaaccaaagaaacaaagccatcttcatcttttaaccaaccaaaacaagttcacagattcagtacattttgagcacctaaaaactatctttaatggcaacacaagtcattattatattgacttaccctttataatcctccaaagtaattttgtattttgttcctttatatgattaaactttgagtatatacagtttttttattataatactaatcaaaagttttcatgcagctagctttagtaccaaagcaatttcattctaccccatctgagggcatcaacaaaggccagagtagcagaacaaaagtataagtgcatgtttatttgaacttattttgatgaaataattaccattttatataacctcaaaatacttaaatgtagaaacagttatttaactgaaaaaaataaggttcaaaacaacaaactaccacctaaaccatttcgttaaattgtaaatatcctctctgtgtcacctaaagcaccatgacttatataccaaattaagtaactaaccatctgtttctatgtccatagtttctgctctccctttccaaataaaatctggcaacgcactatatatatgcctgcagaactgtaaacataatttaaaaaaacattaattagaaaatagtttattataagaaaaatgtatccttgtccattaaggtttatatagaactcaccttatgaaattccagaacatctccttcaaccttccgaagctcaaccatgtgaaaaggttgtgctatctcataaatctgaaagacataatttaaaaatcattaattctagtaacatccctcactagtaacttaaatcttcaactgaaaaacatgtaccttagtggatattgatagatgacctttgcgtctagcatttgcccctccttcaatactcatctatgatgcaaaatataagaaattagtactggctaagttgcaagaatattattattttgaattttggatgcatgcgtgtgttagagacaagaataaacataattcttttacctgataattgcttctcttcttaacatcaaatcccataatcccagcaacacgctcaattccaacaattatctcacccacggggtttggggatatgaatcttgtttcccttttaacatgtacctaggtgtcaaaaaatcaactggtcttaagcaaatcgtcaagaacaaattcagtcacataaaatttgagagaagatttatttatgttcgatagtgtcactaataaacagagtctattacaataagatcaaaactcaaaaggaaaacttgaatgagtttttttccttttcatgcgaatgacttgaaatttattatagtatattacaacagttatatccatttcagggattgattaaactaaagatagtaaagtctataatctgttttcctgttctatttatatgaggtttaatctatttaatttaaaaagtctttaaaagatatttgaatttacttttttccattatccttaatccattcaatatcaatttatcatgctattacaaatttaagtccttgatcttactctctccattgtgattcttataatgtgacacgtgttaaattcatattttttccactctttatttagttattaatattaattaatcaaaggagatttttaatttaggttttcctttctctaatatttttagtcaatgcttaattgttttttaaaatttatattttaaaaactgtatttaactaaattgaaggtttctttgtgtaccagatggttgaaaagctttccaataataaggtagtagcccagaaatgtattcaaaatctcgaacgcgttcatgactggcactggtgctgaagaccatgcttcatccccctcatcaagaagcttttgtgaatcctgtgcaccaaataaggcacattgacatcaaggttagaatcattaatcatatccaaagctctgctaagcaatatttactcaagataaaaaattaaagcaaaagttcttacatcatcaaaactaatattttcctgggaaaatctaggaggctgataattcctcatgaaccattcattctcaaagatctcatttattgtaatccgctgtttcatgccataagaagaggcgatatagtaacatatgttaattttgtgagatgaattagggaaacaaagaatatttgctaaaagccatatattactaacatggctcaaccaaattaaaaaagaatataacatgttaagtacttactgtagcagaattgggatcaaggattcttgtaatcagtgttattaaacttctagagaaaaatgagggacagatgaagtcagcctggagaatctataagtcacagtaaatttaaaaacattatgaggaaggattcaattagttaaaaatgataagaagaattctcactgaaattgtttcaattttatcttgagtttttttatactgattgtacttgtaaatatataaattaagcactatacatgctcatggtagaattgcttagatatcaacagtagcataaaaaatatacgtgttatgccaaccaacagtagcatcaaaaatcatttattaagaatcaccttttgaattgtaacattgtggtcgttattttcatttttgaagggcaaacgtccagcaactaagaaaaaaagaataacaccacatgaccatatatcagcctttgcaccctcatagccctgattcgataacacctatatatatatatatatatatatatatatatatatatcacaagagaaattaatcagtaatcttattagagagaaactgattttgaagtttaagaaataaaaaaaagaagctaatatacatacctctggggctgtataatgtagcgtaccacatcctgtgtgaagcagcccatcttgctataatattaattaacaataagataattaattgccaacttaacatatataaacgccctttttaatttttttgaaaaattattcaccaatatgtaactcactctagcgtgttcgggcagtgtacttaatccaaaatctgccactttaagcactccattagcatccagcaacaaatttgacggctgtaatatatatagtaatcaataaaatgcatagtaaagttaataatgtcaattaacttgctgtctctagctttttgaatagtaagtggcaaacaaaggaaattaaggaacaacatatgaatgatgcacgatcactcacctttaagtctctatgagtaacacctctactatgacagtaatccacagcacatataagctgatgaaaatacctttttgcttggctttctgtcattcccgatcttccaggtaggcctgactggtcctgaaaatgttgggctgtaaagaggcaatactaatattgtagatgatattctgatattacaaattaaggtaacattaatgccttagcttacaattttatcaatcagtgttccaccaccaattacaagttccattacaatatatacccttgtcttggtagccatcacctacaacagcgaataatgcatgcatatataattaagggaaatttcgaagacagagaaattaataatcatgcaaaggtaattaacttatgcacgcaagcaatatatatataatcgatatcattccttctaacctcaattatacgcacgacattcgggtgtctaagtattgacattattgatatttctcgtcgaatctgcataacggtgaacaacagaaaatattagtatatggtattattttttttgtagtcaatattattatatggtatgtttcaaagactgaataaaaatgtattttacatggattagtttaatgtaaacgagaaatgaatgtgtctattcttctaattaatgactcttggtaccactaacaaattacatatatattatttaacagttgatacttatgatcaactttgtgaatacttggtcatatatattgacttaccatttattatactattttccaaatttcaaaagtaacaattaatatatagagacgaataaactatagagatcatacacagtttacaatcgtagtttgtaaaggaagagaaaactaatcttaatttatcatatcttccactcgttaattaattatattttttaacttaaatttctttttcttctaatcaatataatacatatatatcactttcttttcccttttttttatcatctttcccactcacttgcagtacattaattaaccttacattactggaagcatgatgaacgcacccaagatcgagaggtacgaaataggaaatagtctttatcaaaagaaaatacgtcgtcccacccgtaataatcatatacacaataacatttaaaaaatgatgaagatgaaactatgaaggtttttgtgtgtataaatgaaatgagagagaagagagaattgagaagagaccacggcttcctttcgtctcctgaaatatttgttcttctcggcgagaatggggttcttgtcgagaattttgatggccacttcgtgtccggtggcaatgtcacgtccaagactcacgatggaggtgcttccggcacccagggtccggaggattgcatattttcttcccggaataaccatagttctagcaggttgtctactactactactactcctgctaccatgctcatacactgatagaggttgctccatcttcttcttctttctctatactttctttctttcttgcagaaaacgcgcagtaaccgattttccttccaacaataacaccaagttaactcatcacaactaactaacaattaacgggctaacattaattaagattctatttttaggtgttcttttttattcttggtattaaattgtaatgaaaaataattttaaaaaaatatacttttaaatattaataaaattaatgatattaacaactttttttatgacatagagattagttaattttgtttatatttaaatccaaaatgagtattacttagcattggttaggcaagcgagcaaactctaaactacaattttctttctttatttatttattttatatttcaaaaatgcttcatttttctcttaccttcactctcattctccatttccttttatccatcacaccttttgaaaatcatttcctttctccttgtccgacatttttctactagtagtaatatatgaatatctctccattataaacactccaccaataattatttttctttatttcttttcttataacatcgtaatatttatcacttttctcttttcttagttttttttatctcttaaataacatatgagcgtccattaaatatataaagtcctgtgaatttaaaaagatcttgtaaaaacattatcacttttaagttcttttaaaaaactattatgattaagattttgtaatttaaattttgataaatttataacatataaattcataagatttagaaaaactttatacctttataaaatttgaaagaatttcataaatttacaagaatttgatgagaaagataatgaataaataataaagtttagtagaatcaatacaattttttaatataactattttatactagcttgtcttcttatgtctatgcattggaatatttttggaaaaaggtgggggagaatccacgcattagcagattgtataatgaaataatttttttaacaacttttatagtatctttaactgaaaataagagaaagaaagaagtggcaattttggatatagcttcctggctatcgcaacctaaatgaagttgcgagatgaaaacgatgacaaagtaacacaggtaaatcctattctttccgcactaataacaccaaatgagaaatatttgcctatgaaacaaatgcataaaacaacaatcttcgtataataccattatcttttttttttttttcaaaaaccaaaccaaatcaaaagaaaaggaaaattaaaaaaaatacaacgagcaatgggaaccttgaacctaaacgcagtcatgatcaaaacaccaatcagagatgaaaattgccatgctcaacctcaaattcacaatagaaaatcatataatgatatcaataattaacttaaccatagcaataatcccaaaaacaaagaaatatttttttattgtagaaaaagcttatagtgttactgccttcaagaaagagagaaataattatatgcgatatgagaaagaaaatattgggagagaatagataagtctaaggggaactctccaagcaattaagaagaacagcaacagaagcttcaagatgagcaacacactgtttgcactcactggaaagattgtaaaacaagcagaatgcaaaaaatgtggttaaagttcaggattataataaaaaggtagcagattgcacacagattccatagcaaatttgtcatctctagtcgaatataatacggcaagttgtactgtgttcagtgatttaaaagatagaaaaggaaacataccttggacgatgcaaaatagtggtacgtatacaatattttacaacacatttcaaataggctaactaagaactggtgatgtacgtgacagaaatttctgaaatcatcaatttctgaaatttcagatatgtatgcattgtcctattcaacattttgcatggatttgatcagacatgcaatatgttgatagaatagtagcaaacaatcaaatgtaatcagtctcaatttgatagaatagtctcaaattgagaatatttgaaattaaataactaaattcatatttatcaactttcattgtttaaaaaatgtaaaaatattttttttgattttttatattaaatattaaatgtgatatctaatcaaatttaacatatatgaacatgaatataatattataccgatttttaatcatttaagtaattttacctttttttcaattaattcacttaagtttattttcaatattatttaatttgaatataatgttaaattaagtttagtgttgtgaacatttgaattgattttagattttttttcaataatataaaattaaaaaataatataattttatatataattttaaaaaattctccctctaaaatcaactacaatccagactacaaaaaagatcgcatggatgaaacaggatcaacattatgattctttgctttctgctgatagctttttgcaccatctttgcaacgtatttcactgattgtaactcaatattcatttgcacaaatttgatatgtgattcctttcttaatattaataagctaagttggtgcttatatgaaacgaaaatttcattgaaaataaatattattcacacatatcaaaatctggttcatatagaataatccaacggtccgaattatctaaatgacacgttccatgttaacctaaagatatctaaatccattccatctcattcttatttggagtaaggattttgctaacttataagttactataacctatgacgccgcattcacatatatatacctcaattaaatatcactgtttattaatttaatcatttaaaaactgactaatttaatagattttctcttctactgtttcttctcacagctactcctagtcattcaataaatcaattagtgggaactgaaaaaaaaatatttatttaacttggcagtgggggtgggtgcatgtaaaatctgctattttcgacagaaatatatcaatttccatttttataatgcttgaaaatacttctagaaacaaaattgttaaacgttggtggctaaaaaaacagttgacgaaacatattgattattgaataactaattaaccacttattacaagacttgaatttcatcatttcatgaaattatacttcttgttcttaccaaagatacaacagacacaagtgaagtgaccatgaattaaaatttatcgtccatgtcttcacttttggcaacataacaaggcagttttttgagtttatttgatagaaaaatatgagcctgtacagcaaaattcaaattaagtgcaagctagaattcccaatccatgagtctctttacactcccaaactcccaagtcccaactattcatgttcatcaaacccattgaaaggatataaataattacctaaacaagaggggcaatacatgaacaaaaagatactagcttgcagctttacatgactcttaaaaaaaaaaaaacccaccaaggttgcatgttgtttcatttccctgcctcatgttctgccttcactgattcataatggagagggatctatgcacttccttcaggaagtaccttcccttaacgttggtaatagaagcagaagcagatgaagctgcaactgctactgctgatttgctttttttagggggtgacatgacagaatcattggtgctaatctccctctcatcttcagtaatagtgtccaacatctttgatgttctgtgcctcatcacagtaacatactgcggtggtgccacctccatgaagaacctagcaatgcgagaatttgccatttttgtgaaagtgctttttgtaaacaaagtaaaagctaatagagagaaaagtactaggatttcaagttgtgctgaaattggtttgattgttgatgatgggaatgaactacaaagggttcaatttataaggagggggactaagccaaagagttagtatttaactaggctaaaattgagtcaagggtcttaatccatgaaggttaaatcaagttttattggctagtgccgccacaagcttttgatattaattgcaatgcaatgctactttccttgtagataagcttctagtaggacaaactttggtatgtgtcaacacgtgggtggaaaatttgatatccatagagatatggtttttgtcgggaaccgtgcttccaaatatacactttttggggcttagtgaaggggcgtgtttgtctgccacgttgcttggacggggacattacttggacatgggtgtaattgaagaaattttaatcatacatttgtttactttagggtggttggttttgccttccatgttacagtgacactgattattgggtcttgagttgcattgatattggagaagtttggttgaacgtaaaaatggatgccaagtgtagcatcatggtgaaatggcggtgagattccagatgacaacaacattaatgggaggcaggggcaggaggaggagcaatgttcttaaaatgttgtatcagtctagatattgattcagtgttttagtttgaattttagggaacacctttagcagtatagtaagattatactagtaaaagtgttttaagagttacgttttaattaacattaatatatttttttaattctcaatattggtttttattttacaagttattaagacaatatcttaattttaattaaaaaatataattacaaatacttatttaagagtttggagtattttgtaataaagcctcttaaaagaatataaatttatccttcaatgtgaccttgttaaataggcttttaatagaaaagtcttcacttagttaattttttttttaagtgtatgtggaatgatctctcctattttgcatcttgtttttaatccacctatgtgagacttattctccaacacatattatactaacatatatgtaaatctcctttttattcaatttaagagttacttttaataatgttaaatatacatgacttttttttatactgaaaatagaacaaggctaaaaatatttctaaaaaaattaatttattctttttataagggtttgatatgacttaatataaactaagtcataagtctttgttgaatgatctctcctatttctgctcctattttgtatcttgtttctaattcatcatgagacttgttcaattttaaatatatgtgtaaatttaagttacttatagtaatgttttaaatatacatgatttttttttactaaaaacagagcaggctaaaaatatttctaaaagaaaaaaaaaaaaaaaaacttaaacgtgaccatttgtattaaacctaatagcagtgcattgagaatcttatcagaggcaatagaaaatatctcgcaaactgttcagattgtggctttaattagcacaagttttatgttgtgtatgcatagtccacgacttcaagggactaatgtcaaatataatggcaagtgaagataatggtggttcaacttgtggacacattttcttcattatacttgaacaaatacaaacgttctcaaccattttttttttcgtctctatatttgttatcctatatttatcaccgaaaaattgagtattccaaacaggtaatcttaataaagtgtttgtgtatgaatgtgtctaagtaggtgtcattaaaaagaagagataagagaagagacatatcaccaacttgtgaattgcatcttgttctgttcttttggttatatactgctgcgtaattctgatatagcatatattaacatatattttgttcagttcggatttgattatttttatccaaacctgaaaaccatgaacaagaaacaggaagcaaatctttgaaaaacaaaataagactttgtgttttatttcggtttttccttttcttatacaaatattagaaaatgtaacnnnnnnnnnnnnnnnnnnnnnnnnnnnnnnnnnnnnnnnnnnnnnnntttatttcggattctctttttttttttctatctcaaactttaagatttctagaatgcactatttaaaaataacttttaaatttaaagattatattacaaattacctttaacttaaatttaaaaatcttatttttttaatgtcaacttaagaaaattttttcaactaaaaaaataagtttttttacagaaaaaaatcaagttaaatactacttaaatcagcaaataacgaggatttgaaaatttaaattcaaataattttattgttacgcgaggtatcaattagatgagtcaactttcatttattttagactcgaacttagaaagaattttaagttttaacttttcttttgtgaacattttttttataagtttaccgttttttatacgtttttggtgaatattttatgtttagttaactaaagtattattaagtttcttttctctctctcaaattatgttaatttcaaaataaatattagcttattaattcttttttaagcctatcttaaaaaagtttatattaatcacactccttctaatatctctaattttttatttctcgacgattctcacactacgacacttcatatagtaacatttacacaatatttttgttggtcaaaaccctttactaatcagaatcctacgtaaatagtcattttcaagacctcgaaaatgagaatcgattatgtctatttctaagatcaatgattgatcccacaaatcaacatttcagtgtgttttgtgctcactcatgtttttcgaaaaactttctagaatctcacctattccataactactccaagcaaatacgtttaacaatagaattcttatgttatagactaccgaaaagtagatatatcttgttagtatagatagtaccaattaatttatttaagacattctcagttgtatagtctcatatatgcacaacctctgaatctctctcttttcggtgtgattcgtcgaggtgttatatgttcactagtttccatatggttcattctcgaaccataccctaataggagagaggtttgctttaataccacttgtaacattcttgattttcgatttttccacgactcttacattataacacttcacgctgtgacagttcactcaatatccttattgatcagaacctttcatcgatcatttgtaattcattaatataaacataatattcatatttatttgtttattttgggtaggggatgttgaatagttcctcgtgaaggacccaatatggcaatatgccacttgcatgcaagatgatgcgcaacatctaaatcactttcctcaccatcatagctaccgtccatggcttactttccgtatttattccaatggcgtgtcttccagggcagctacagttacagttactcaatcaccatcataatacattgtggtggatacacgttagtttttaaaactttttaatctaataatatatcaataataatccttcacaaaaaaatatttttatattattgtttatttattaatttatagtgaaccgcattaaaatattttgcaggatatataattttataatgtcatatcaatatattgttcctactaaaaattatacgtgcatatactatattcgagcaaactcgtaaacacttttatagaattaacctaataataatattataagaattcttcgatcccactagcttctcatatcacatggagacgaatactcagaaaaggatcgacgtgaacgtacgtggtggaccatatataactcttggttattttggaacggaagtggcactatattgtaagaaatataagtacgtccatattctggataaggatgcagaacagcccaacatgcttattctagataatattttcccgtgaacatgtgtgttttaattggctgccggcataatttcggttggaatatacatgcagtattgtatatgtaagaattgagagtgtgagatgagtgaatctctgttatataattcacatatatagatgattaattaatataaccaactgattcgacacaagttattaaaattattaatgaacttttgacgtcaattacctgtttgtcttaaaatatcttagcatttgaattcttgacttattacttataatatattcttttttactttctaaacaaataatctagctagggctttctctaacactccttaagtttaactaaaatggtgtaaatgtgatttatcttcaaacttttttcgtaaacttgtagttcaattttgggtcttagaagccataagtcatgttttgatcacatgatgttttcccaaagagttatgttatttcgtatgaatcatttttagtgcaaattatcagattaggccggaaggatttacaaaggagaaaatgcctaataagagtagctagaagcacgataattgatttatgataaaattatatgtatatatttatttataactcatgaagagtaggcaactcattcttatccaatttcgtaaataaaattttgacgagcatttcgctttctcaaatatatggtgtgcatgaatcgcgggtcttcgaagtttgaggaaaaattttatatttctttaaagtgaacaatgtcaaaagaagctttttctccataggctttcccataaatgtaaattgttcgtattcaattcagcggtgaattaaggagatgctatatgtagtcaaagtccaaagaaattcattaccacacaccatcattctacagtaccaaaacatcacatgtgccgtattaagcagggtatacaataagagagaaaaagacatcacaagttgcagaaaaattcgtattattgtaagcaatagttgcaatcagtcaggagtgtagatatggagtgatccccactaaatgtgaaatgtcgaataataagtagaaggggagaagcaaccctaggaatactgccaaacattattacatttaattcataaagcaagttcggctgtgtagccgctttatcctgtgtcatgtctccaacactgatccaatacaacaactatgcataggaaggacaaaagtctcatttatcttgcacatcaactatagtcatgcatatatataaagatataagtttgaatttgttttactagcgtttataattaaaaaaaacaaacaaactattttttgttgataaaaagaaatagtattcatgcatgtattctagttctaaatctagctaggacaaaatagtacctagaaaaaattatgaatgctttgccactttaagttgtatcattagtctttaatttgatatagtggaaaaatcccaagtttacgctgattataaataagattaaaatattatatatatatatatatataaggtgggtattatgatctattacatattcaagagttaattaggattttaactcattatatatataggatggttaactaactttatatatagctagtaattaaatagcgagtgaaattgtgtgcgaaagaatattaattcgattttattatatgaatgaaatttctaggtgttctcgagcgttcgttgtttgttttgaaagatacaagaatctctttagctcattctgtaacaatgccatcaaagtgtgagacagtgagagaaacaatttcattttattattcaaaagttaattacaacaataagtcaatgaccttttcttaacatcattcttacgtcattttttaaagaaaaacacacattctacacattcaattctgtcattatattttttttttatttccaataaaaatgttgtacgtaccaatattaatcagcatgcaaaaaatattaattgattaagatgagaattttctgtccgaattaaccttaatttgtttatacgtaggttggatatatacctctttcttgaaatttagttaaatcataatacattcatttattttgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaatttttaaaaattgacctgatgactgatttggttatgatattaaattattagatcagtgattgaatcggtgaatcattaattgatttgtattatcctgtttgtaataaaaaaatattaaaaattgtatctatcttaaaatcttttttataatacattgaaatttaaaaatcttaaaaacataaatgaaatataaagaacacaagttaaaaattattattatctttaacatttaatatcaaagggatcaatgaaaatatatatcaatattcacactaaagtgaaacaaccatatcatatcaatgtaaattaaaaaaataaaaaaccaatccaaagtttcaaagtccaaaccatatttttaaaaaatgattcgggatcacaatttcacatgcaattcaactataattgcagtcacttctaagttaatttaactcaacaaaaatgcaattgcaaccacaaaaaatatcaatacaatgaatgaaaagatcaatttaactcaaaattataaaaaaaaaattaaaataaaacaaaatgaaaaaaaactaaaataaaacaaaatgaaaaaaagatacataacccgattagagtcaattggtcaccgcggttcaaccacaaatctgatcgagttaattcggatcgctccaggtcaaaaaatttaatcaaatttatgattcgactcaatccaatcaccggattatgattcgaccattaggtcctagttttaaaactctctttataggtatccctagtatctattcttaattaaatgtttcttttgctgataaatttttttactgtgtcggaaaatattcctatatattagttgtggatgctctatttactaataagaactgaagaagatatatctgtttctctttctcgtgtcagatacacaatttagtcttaatttcctttttaattatatgaattaaggtatgttataataatataatctgtatatcagtaactacatataaacatttttatttaattaattaattaaaatgatctaatcatattattaatttaattttagttttttaacaaaataactggtattcatcttaatatttttttcaatttaatcctttaatttatttaaaatcgatattgttaatcatttataaaatatacattttcgcttcaatttttttcctttcacttcatttcctttttaattaaaaaaaattcttaaattattatcaacatcaatcttaaataaaatcaaaagattgaattaactaaacaaaataaacaaatcgtcaaaataaattttttaaaaaataaataacaaaattaaataaaaaataaacaaatgacaaaattaaaataaaaaataagataaatgataaaatacaccatttgtccctttacaccctgacgtgcaacttattcgaagtttagtctaaactatcgtaggatttacaccgcaaaagtacgtagggtcatccccttgaaataatagctaagaatcaacatcagtcggaaagttaaaagtggaaaaaggatgggagccggggactatcatcacatccactttttgggagaagtaaaacacaaaagcttatcacatgcattaacatcaacttcacaacaaaaaatcatattaaaattaacaaaattatcttcacaaacattgatttataattgatcccagattattggtgttacatgataggctaaaatggcattattgaagttaatttgaaaagaagggccattttgattatgccactgatatataaataccatgtacatatatcacctagctagggtgacccgtgaccatataatcatatatccttctctaaaagcaagagtgtgtcagctagcaatagcatggcagctgaagctgatatcaatgttctgccacccatgtgtccatcaaacacagaaacttcaccactaaaaccattttctgcagttgctccgaattgtttggtcccattttccaagatacaaatcaaaataacattggaaaccatctacgaagaaggagaagaagaagaagaagatgaggaggaggagagtgaaatggagaaaagttctgagacgcatgcgtcctcttcacccccaatattcttcccaattattcaagctgctgcagcgacatgttcgtttgaaatcacagggtattttcactttttggtgtcgttcggtcataactaccagcatgcatagataatagtacgtggtagctagtccatatatatatagattctaatgtgatccatcatgaataatatttttgaaatttcatggttcatgtagaactttaagtgtgacttccaaggtaatcaactgtacattaatttgtcttctttttggcatatggttttggtagttaggttgcattcaaagttttaaaaataaaaataagtgggaataatgtacggtcaattgtcaacgttttaaattttgacggaaaaataaatattaataaaataattaattaaaaataataataaataaaataaccaattattttaaaatttaaaatagtaacataacattaatatttttattgaaaaataaaataaattatcaaaataaaacttttaaaaatataaaaaataaaaataaaaattttaaatttagtgtatcaaaataaaattttaaaaaataaaatagaacaaaagagacatttagttataagagaaaatgaacaacaaaagactttgagtttaataactacgcaatgactgtaaaatatttttatattattatctaattataaataattacttaaattattttaagataattatttaaaatttaataaatttataatatgagttgtgatttgataaatacgtaaaactttttaacttttttctcaaaagaattttattcctttaaacaaagttactttaagtttaacttacctcggattaattgaaacgaacgagatatataagagtcaaaagtaaaaacacgtaggttttattcttctttctttttatcagatgtacacatctatgacccaataatattaaacccggattgcaagtcacagctgtaaaatcaacaaattgtacactaataatctccaattctagaacgcggttgtgtgcacgccattttgctatttttaatacagcttctagaatggaaaaaaacgcttcgctgtgaaatctattgtctatcccattattccaagcaaagactttttcaagcatgagttgtcactagttaatttccaccaataattctaacaccttggccatctcccacctccttcgttagttgactcccccaacgtatatatggtagcactacccccttcttccaaccccaaccccaaccgattttcatcattttctaaaggttgagtttctttgatcaaagaaaaaggtcaaggaaatcaaagggttaatttggttataacaattattattattattattattactgtttctcaaatttctcaaattaaagtgttgatttgaaaaaggatatggtgaaggaagtgagaggcatccaaaagtactatggagaagttgcaccggccctcctcataactcctcataaaaaatgttcccttcgttttccaaggttggagccaatcattgaagaagggtctgatattcagggcctccagatcatgcctaaaaggattctttttcttgttcctgcattgatttcttttggcacatactacttcttgttgtacagcaacgttaattaattagtgcctgaaaaaaagaaaaaacaacaaaagttgatgaaacatatgttaattaattttagtgatttgcacaccgggaggggatgtgtgtaaataatattcattttatattattatcagtttctgctaggcatcatgcaccaatattaataacaagtggttcttttatttgtattttttgtttgagattattaatccattgtcaatattccccctggcctcccccatataaaaaaggaaaattcaaggagaacaaattaattaaccctgacaataatgcaaactttatttacaaatcctctctctctctctgatcgactgtatgtttatcatcatatatatggaatattctttggagatgaattaaactttaattatgtggatccagatactcaattgaattgctaggacctaggagtcgttagtacgcctcaagtttaccaagtcaggtctcaagaagtttccaaactagagttgcaaacataagtttgtttctatcgcttcattatgcatgcacacgcattagcaacggaatttctacctttcaaaaagtaattaagtatagttttttttttttaaataatgcacactactacaaaaaaagcctttcacgacgcacatacgacgacggttatatggaaaccgtcttagtatgctacgtgtaacgacccgtatgcatccgattcattaacattatcttatggtggttaagcgcagcaattatcatagataattaaaatggaagcagtaaacaaaaatgacgtcatcatacgtcattaacaatacccactgtacatcatatatggtgaatctcataatatacaaagtatatgtctcaaaattgtatatatccctcaagtctctaaaacaaaacataggcatgaaaatcaaaagatagagctaacatgctcttcactctatgcctaaggttctctcagaaccatatccctctactcaggcctcttgccctggaatctatcagctgttccctaagcttcacctacaaaaacataatccccaaccggggtgagataacaatctcagtaaactcagggttcttggaggtctttcctccccctggttcactttcatgcatataatatcaaaattggcattacaaactagccttcacagctatcagtcatattatcacatgtacataacatacatacacaaatatcaatgcctgaggaggcttcatccatttatatgggcacatctcacatcagggcttactaatcatgcctgaggaggcttcatccatttatatgggcacatctcacatcaggactttctttctttgcctgaggaggcttcatccagctatgtgggcacatctcacatcaggacttatatatatagactattaaattcaattctactggtcagagaatctaatcaagcacataaccacactatcacagtgttcagctcatcacatacatgtttccataaacagtaacacacaatttcaatatacatgcatcaagatatacactaaccataactccctaggagtatggtggaacacaacagtgggaaacactcccaagaacaaagagcttacctgctctcaacgctataccggctctctcggcttcgtggtcacaaccaccagtaatgtcactctcacgccctacataaggcatacaaacaatcaatcaataacggtcctcaaccgttagaatgaaaggaaaccctattcttttctattaaaatctctatgttctctatcttagggttatcagagctaaccaccttataggcgattcacagaccctcaacaggatctatcttggtccaaccaagaccttagagtctccctagactctgcataagttcaattcaatgatctcctaggtcatatatcaacaatttctcaacatgactaaaacagatatatcaacacattttcaccgtttatttgtccttctgaataacttttgtaaatgcacttaggctcataaatatcataacaccgtccatttcatcaacattcttcctactcatacatatctcagggtcaaaatcaaacttcatcaaaaatcatgtttcaaagtttaatattcatcagaacaacctcctgagcatacttttctaaaagaacccaagcctaattccatccctatcacaaagtgatcactattcatcccaagaacaatttcacaaatcaaacggtaaaacttgagtttcttacctctaaatcgacaagagagactaaagaacagcttttccaagcttaacgttcttaaaacgccttcttttctcctcagaatcaaactttgtggatttcccctagagaactggatctctttgtttgatggttttcagagaaaagtgatgatggaatctagctcattgagtagttcctttcaactttcatgttgggtgtgaagggttttggtcaacggttgagtgtttaagaagctcctctagttcatcaatggcagaagcagaaaaaaaagaaaaaggatcgagagagagaaagagacactactacaaaaagcgccaacgacgacggttattttggccctacgatgacggttgttgaaccgtcatcgttgtacgtgttgttaaaaaggggcactttcgaccacggttccaaaaaccgtcatcgtttctaattttttatttattttttatttaaattaataggaaacaatgacggttatttaggaaaaccgtcatcgtatgctgtcatacgatgacggttttctcctcataaccgtcttcgtttctatttaatttaaattttaatttttttaaaaaataaaaaacctacgaagacggttatttaggaaaaccgtcatcgtaagctgccataccatgacggttttcctagataaccgtcttcgtaggtttttaatttttaaaaaaattaaaattgaaattaaaaacgtacaaagacggttattacgaaaaccgtcatcgtatggtatcatacaatgacggttttcctaaataaccgtcttcgtaggtttttaatttttaaaaaaatttaaatttaaattaaatagaaacgaagacggttattaagagaaaaccgtcatcgtatgacagcatacgatgacggttttcctaaataaccgtcttcgtaggtttttaatttttaaaaaaattaaatttgaaattaaatagaaacgaagacggttatgaggagaaaaccgtcatcgtatggcagctaacgatgacggttttcttaaataaccgtcttcgtaggttttttatttttaaaaaaattaaaattgaaattaaaaacatacgaagacggttattacgaaaatcgtcattgtatggcggcatacgatgacggttttcctaaataaccgtctttgtaggtttttaattttaattttaatttttttgtaaacgcatctcccaactttttttttctaaattggtttctatactaccacataaattttaaaaatacaccacattgaagttattttattgtataaaataaataaaaaaactaaattgttagtacactaaaatttaaaattgagcttaacgctataaatttaatttaacacaaaattaaataaaataccatgcaacaatgacatactaaagggtcaatacttaatatgcttactttagaacctttttcactggagttgagttcatcaattacaattttcacataatcccttgtgacaatatgaagcattaatgaatgattaagtaacttctcaccaaatatctacgacaacaacaacaataattggaacaagaattgctaacattcaatgtgtgcaattgtaacaagttaagaggggagataaacaaggctaaacaaaacaagttattatatgaattaaaaaaacaccccaacatgtgaataaggaatagaatatacttaaaaagttaaaatatgtcccaacattgacagcatcaacatgaagagtttaaaataatttaatccagaaactaaaatccaattgtttactaactaaaatccacattctatgagttctctctatcttagcaacttttgtttggacacacaaataaggcttgggctttatatattccacacagagaaccataagaagtaccaatctatgccagccctgtgtataaaaaatccttgaaagaaaaaccaacaaagaaaatttcataatagaaagtttgaaagaacaatcagttcaataggaagggaagttcacagaagcatagctacatggcgtgtgaaacatgccagaagagagagtgattttggaaacagaacagtttcatattttgttcattttcttcccatgctcaaaaaggacaaagaatttggtgaattatatgtatctacttgattaaattttctttctccattgaccctttattttcacttattcatccaaaccacagaaattcctctattcattaattttctcaccccctatttatttcctccctcttttctccttaaccaaattaccatatcagtctagttcagttccacaaacatcctatagattaatcatgttccatttaataacagagagcacaggaaaattcattcactaaatgcatatctcagatggtttcaattgtatgtaacagtaacaaagtttacctttggagatgcaccaaaaggaatgtgttgtaagccaacagtgaagtacaattctttccccaactaaatgtgtcatgctacataagctaaaagcccacaaccccaactgatatagggtttaaagaactcaaaccttcatacggacctcttccatgtaaatgctgccagtaggtaatggaggagcagaagctttgtccattaaggccccacaccaaccttcttaccagaggagctatcatatatagaaacatggcatgtaactggcgtggtcccatcaggaaactccaatggcaactccactgtcatagttaaaagagaaaatgttttttcatctcttgttcagaatgacagagttaaaattctaaattgacaacattgtcaaataacatcaaatcatgaaaaacaagataggtgtgcttattaccgaaggaaattactaagcatatggagttattctcctgttattctttatgataacacaagtacagtggctttggctaataaccctgttctccattcttgaactaaacatatagagttggatctgttttttgttagagagaaggtgctcactaatctgattcaagtagttcactaatctgttagttctattatgtttgttaagctgtatcccggtgcattagttcccgacattgcaactatcttaatggcccacgaggctaagactaagggtggtgaaaaataaaatgggactattacagttgttaagagaacattttgtcattagtaatagggaaagcacaaacaaaagatatgccacaataaacttaccttggacactggtgatgcatctcctgccatgataccatcaactccaatgatggagaagaaagcaaggaaaccatttctctgccccgtcgctgctgtaaatccaatgaagccattcgccgttattaccataaacctaatatagccaatcttttttgctgctacacaaattgtaacactcccatgtccaaccgtaaattttgtgatgcaatttcataacctgttgggataataaatttgaatcatttgtttcaagttagtaagtcaaaatactgattaaatcaactgctaaaaataatgtttttttttctaattcatcatctagaagaatttaaattcttctgatttacttatacaacaaattggaatcatttaatttctgcaggcctagttaaaaaattaatgatgcaccacaagagtactctagcactgctacttgttttactggaaaagagaaattagtaatagtaaaagcacataaagaaagaaattccataaacgaatccaataccctggacactagaagtgctacttattccagttgaatttgaataccaatgtatattatttttgtatgcttgaggtggaagcaatgaaaatactctctgccctgtctcacatgtggttttaatgaaaccaaagtggtttgctgctacataaattgtctatgacaatcaactatgtctaccaatctttgcttctctttaaaggatggtttcttataaggattggtgaattgaatattattcatgctattttctggtttgattacatggagtccagtttgcttgacaatcacatccttaggggttgcttcaataccaatggaaaccaccacatgattccattaattttttgtgagaggtttatctagacactcttcaaacttcatgtattttgtagaacatgattgattgttgataaatcctttgttttactaaagatggccatataaactgtaaagtatgatgtttctctctcccgccgatgaaactaaataaagacaacaggtggtacttacatatccaacccgccatcccatcattccatatgcttttgagaatgagaaaacattaacaatatgatttccctcaacacaagagtgtttcaggccatcatacataaaatacctgcagacaaaattaatttgtttaaaagcaatttttgaaatatgaaaaacttgcagctcagacaacatgattccgagatgattgtagatttgttaataggtagtcttagtgaagactacaagtaggatctcatatggatattttacaccagtggctaaccacaatataagtgaaacagattaaaaaattatctaaaatgacaaagaagggaaaaacttgtcaataaaataattaggaattttctggaacacaagctatgtaaccaatttatcaaatggtcctaagaagaatagagaaactttgtttttgtttactttaataattaaagaaataatatgattttttttcttctattagcactgcaagttaaaaggcttactcgtatgtattatcaacaacaagccaagagccagcattcttgcagagatctgaaatcctctgatcaaataagagaaaatactcagaaattttataaatatttttataacaaaaaaaaggtactgttactgttatggtcgatcagcatattcttggggaatattatccggtggccacacaagaagattaaaaaaggatcacttctaaaatcatactagctgttgataaattcagagggagagagagacctttagaagcttctctggaatgtaagttccagatggattgcctggatttacaacagtaacaagctttgcaacttacaacttaatccaatatcataaaacactcaactggttggacatgcataaatttatagcagcccaatataccttctgaaaagaggaaaggtttacatgtatacagacccaatccatccaacatttaaccaatatgtgaaccccctggatggaggaaaaaagatgctcttagcaaccaaagattgcctttgcttcccaagtccatgccagtaaaaaatggattatagtaaccagatcatgtagcttcttacctgcatcaggatggagtgtgtctgagctaccaggaccaactagaatattggtaatgccagtcatctggaaggacatgtacacattgaagtagtatggagcaaacataaccacagaatcacccggatcacagagagtgagaattagattcacaaatgcctatgtttgtaggaatacaacaagttaccacagatgattagagatgagcacaataatactgttgaaacttgaaagttcaaacttggaaagacatcaaagtaacataaaattaacagaccacaagtgatagaagctataaatgttgagctaattcagtcaattctgaaagttacagtttccacagttacaaaaaccccatgctatttgtatcagatacatgttctttcaaatgctttttgagttataggaagaagaagtgcaagactatgatggttatagataagatttcacacaagcaagcacgaaaggctataattttaaatgggcaaacataaagaaatcaaacggaagctgaaatgctgatacacttcaccatgttatctttttgagggtataacaaggcaatgaacataaaacaaaaattacatggtcaattagtattgttaacctcacctgattggcacctgatgtaaccattactgaagatttgtgcaaattattttcatcacgcaactacatgaagatgataaaagcaaataagttaattcattggtcaccaagatccaaatttcatatagcaaaataatttatcacagagcaataagatacaaaaggcttaataataaaagcaattaatttctagattcagacgtttggtattttaatcataacctctatatgcttatggtgtttattcataagattcagacgtgcaaggttatcaaatctgagatcctaagacacataaaatgcgtgataataacaacttaaaataccaaactatcttcaaacaaatatatctgcatataaaataacataaataagcaaaatagcataaaaatcagaactccatgaaattttcacaccaacaacagctccaccagatgacattttaataacagtaaaacttgagaacaattacatccaaccaaaagggtaaaaaacaccaaaacagagcacaattatatggactaaccagcaagtactgaagcaaaaacaaaccagtaagcacccaccacacagacacagaaacagattgaagaaaaaagaaaatgggagtggttgcgcgacggagcatcgcgagattaggatctgatcgctcggtctcgctaggtccgagagagagagagagagagagagagagagagagagagagaatgggagtgtttgtttgtgtgtgatgcgagtgagagactgtgaaaagggcaaaaattttgaagagaggagtggggaaggagattatttcttcttgtagtgaaggtgtggaaggtgtcaactagggcacagagaggaaaacgcaaaaagcttttgttggagctgattgtggagcttttaatttcaattttaaattgatatgcataaaacaaagacgtctttgaaatagagcaagtccacgacggttgtttatacccgtctttgttcccccctgtcaagcatggtaaacttcaaaagaattgcaaaattgccaccggctatgatacaaagacggttacgaaataaccgtcattgttgctatgtcgtaaaaagctctatttctagtagtgagaggctattatactacgcggtggcattgtcgtaaatatgaggttaaaaacgacgacgggtattacggtaaccgtcttagtatgctacgcggtggcatttttgtgattttgctataactaaacaaagtcagttattattaaaaccgtccttgtttgtaacagtagatttaaaattaaattaaggaaaatgagcgtgccctacactacaaaatagggaactcgtgggacctcgcttcctccttcctcatcttttcctgcctcttcctttccctcttcgttttcttctttgcttttctcagacacctttgagggcctcgtctccccagcaaccaccgtggtgggcccaatcggcacatccacagcggagagactcgcgggaactgacggcggaggcgaggaagagaccctcatcctgttgctgcttctgccccacaccaacccccatctgcgcgaactgctcctcaacccccaacaccttctaatcctccacgacaagaaccctaatcggtggcaagtttgtgagcaaatgcgacaataaattttgttttggatttggtttttgaaatgtatgttttgttgctgcagcgactgagaatcctttcaatagcattttgaggacgctcgagaagcccgacggcgctgactagtttggaaagtactttagcttgcccgctctcaacgatcccataatcggtgagtcactgattttcattttctgacaagagaaaatgttgaaggaagcgttgttcaatattgtcttatttgtgtgtgtgtgtgtgtgtgtgtgtgttattggttggttttaattgaatggttctatttttcaattgcatttttctatgatgctactgcttgtgtctagtgagatttgttgctgtttttgggggaatgtaatgttgcaatttcagtgatgattcgatgagctgaatttgaatctggagaggttgagaattgatggtgacatttatatatttccctcttattcgtgcagtgcaaggtggtgaagtagagacaccagagagcaagaagagtgaagggtcctctatttcttttgtgatattagtgttgttatatatcactttttagttttttaaaataatataaacttcaaacattgttctcgctgctgacatgactcctgttttaattttgtttcttttgttctgttaacaatacatttctgttggttgaagtgttgcattgctttcataggccctttctttgtttttaaattaatcatgcatgcatgcatttgcaattttgcataaccatatcttcaaactacactctaaataagctattatattatgctatatattatatatattagaaactctagttgttgtgtattatctgtctttatgatagaacaaaagaaaataccagttataacttataagctacttagaaacttgtttaagctaggccttatttatgatggaacaaaagtcttatgatttttgtttcttagatctttgtcttaatacttagaaacttgtttaatctgccaaactaggccttattggtgtgtttctcttgttaactatgtctttacttagattggtggctgaagttcatatggaaaaaaaggtgaagaaccagaaagcaaagtcaaaatcttctgaagcacggaagcaggtcagtagtgtgcgagtaattcaacggaatctagtttacatagtgggattgcctctcaatctggcagatgaagatgtaaattttttgcctcatatgctttcaaattcaatagttgtcgtcttctgtatctgttttgttttcaggccaccatccccttccttgtcttctcattttttcttattctcggtgtaaatttactaatatttattttatctctgtgcagttcctccagtgtcgagaatattttggtcaatgtgggaaggtcttaaaagtgtcaatgtctcggactacagctggtgttgttcagcagtttccaaacaatacatgtagtgtgtaagtttatgttgtctttaatgcaacttggctttttttcttagtggtattgtgtagggtgattagcctgtggtaatccaattctagcttatcagttctcattgtttttggttgatgcatttgcagggcttgttttggaaccactaaatattgtcatgcatggctcagagaaacatggtttgaaaattactaattccttatgaattataacttgttctttcactagttaaagcttgattggggatagatcttgatgaccagccttgcagcaatccagattgtctatatctgcatgagattggctctcaagaggatagtttcacaaaagatgaaaaaatttcagcatacactaggtatttttctaatcttaaatgaactttcatgcaaggcttgttatggttctgttgaaagatagaatctattgtttatatgatccagccatgattggataaagtaaagaagattacttgacctttatcttgttaagaagaatgtttcttgtcctggtcatgttagcattacatattagctttcagttttaaattaacattgatggatctatcatctgttatgatactaagctatatgagttgcagagctgaaacttttatttgcttaatcatgttgactctgttaaatatttataagaacatgaaaccttatgcctcaacgctcttagaaaatcgaggaagtaataaatgataaaaccattccttgaaataattgaaactccccaagcattatctttttcaagggcaattgacaaacttttttttttcctgcaattagttaaaggctggatgtattttttaaattgattcagatgggttttgcttggcagttgatacatgattggaccattcattcccccccccccatattatatattgtttttatttgatcttttgttatcaaaatcaaatgatggtgtttaaagggatgaatccgttcataggaatcattaaannnnnnnnnntaagcttatggtagacggtagaatgcttaaaatataatgatgttgaacaaatttcaaattaaatatgaattgttttggtgtagttttttattttatttttcattcctctaaaatatatttgtctattttcgtattatttattttctactaaattcgctcttgcagaactgtttgagtcgcaaacccattcgaacttgaagtctgcaacgcccggacaccatcgacgaccatcggatgtcgacatcgtcgcggtcctgtgtttgagcattcaattccacaccgttttttcttggtatctcctccctcatccaaactgttttttttttttttttttgcttctctcacaattcaatttcagatttcttgtttccccatgcattcatatgaattgtgttgtgcttctgtcatttactttatgttggtgtgcgtatgccagtgcaatttacttcaattatttatcacatttcaagctatgctgcgtagatttttttgctatcgtgcaaaaatcagccctgttgtcaaataaatctggcacatcatatctgaatttctaactcatctataagattttactaactttatgagtattttaacattaaaaaaatgtaaaatcagtccttagatttttagtgccacctgcaaacccaaaaagttatatcgtgagaaaattatgatgttttagaatttttttttttttatgttcacgatttatttctcttttatattttacattgcagaaacaatttttcatgcttattatataaaattttattacttagtttaaaaattacgtgagttcaatttgtccaagatcnnnnnnnnnntttgtgcaggatatttatttgtttttatataattataattcataattgaatggttctatttttaattgcatccttctcttaggttgggattttaaggaaagctgagtaaacaactggaaggctcttttttctctgaaagcatatatatatatatatatatatatatatatatatatatatatatatatatatatatatatatatatatatatatatatatatatatatatacgatgacgtgtttcatattgcatcacattgcaatgtcaaaaggtaaccaatttctattaagctatgaacctatcatcactgctacaattcaaagtataattgaaccaagtaaaatgctattagattttttttactgctttatcacttaaattgtttttattttactgcttcccaccacctctcagtcccttgtgtgtctgtcccctagtaaacaaaggtacttttctgaaaactgctatttttctttcctttttttatctgtatcaatatcttaagcaaaatctatttactagaccaattattgtttaggattttctgtaggatgacgggtgtctctgaagtctaattattgttgcttatgtttcaggaagttcctttgtgtttcatgaaagcacaaaatgatacttgttaagaaattcttttatattgtataaattctttttcaggaagttctaggtttccagcattacacccgtcaatatgaacctgtgtacctcctaatggtcttctggcgcctacacccgtcaaccttccaattgctgcagttgcaaaagtctgctacttatactccatctctgattcatggtgtatgataccttgcatttcaaacaactggttactttgatttttaattgattgataatatatataatgctgcctatttttttcaatggaatttacatgccaggcgcactctacatttttacactcatttaaaaaggcttattatcattagtgtcttcatagttgcaattgtgtttactagcctaagtgaacaggaaaatatcttgtttgatgaaatttatttatataatttaaggaaaatatcttgtctctaataaaatttctagttctatatgaaaatttaatgggttatatgccttgcagagttaaatttgtaacctcctttatttttcaggtcttaagcaaggacaatcctccttagaaaacatatatctataaactggatgttccagttgttgcaaggtggataactttggctgttgccccatttgaaattcttcctgatcaccaatttagccttatatcacatatgtgttcgctgcctaatctatcaaagatgcggaatacagtggattccattaaatccttcaggtttgacatgtgatagctgtaatttaactagcttgaaactggtagtttttttcagcataaaattgtataatgattaaatagttggatttttattggtgagcagctgctataaggattatctttctgtagacttcccatttgactcttatacaaaagtttgcatagagccaaagatggcagtgtcatcattgagtttaagagcctctatgagtgtatttagttctcaagttttgtttgatgagaaggttattgaccaggtcagttcactacttgaattcttttatttgatttttgattttttctaattaatctttttctgaatgaatataattaatcttccagcaattttctagtaaaatatgtcaacttccagccacatcaaatctccggctaatgtgaagagtgttccacgaatggtataatttttgccttataatataagtttttccttttcatctgagtttattcgatttaatatttaaaaattgggtttatttatgacaagcttgaagcttaattagtaatgtgtagttcatgtatcttgtgcgaaatgttttcatgcctcacatggttaacactgttagttttgtaggcattagtatttacaaagtagcaccctgtactcatttttattctatgcgcaagaaatagtcatccactcagggctttgaggaatgggagcagctagtccaacttcggtgaactacttattgaccaaaaggtcagccagccccgccagaatcaatccattccatcctatctcttcctctctctatttctctgtcaccctctaacttaagcaggtctgatccaatcaactagtataaaagagctcatagcccatcctttgccaatttctctcagccttcatcttaagacccatttatttgcctcacctcattgggtcccattagtgttggtggaaggtaagtgtaaatacactgaattactttgtaaaatcagttttaggctattgatttatgactatttatgatgataaaaacataatccattttcctttaaatgatatgaaagtacttacagtttggtgtttataccagtatgaaatgggttggaggagaggttctgcaagcactgccttatgatgtgccaattccaggttacctacccatgaacaccatcattccttatttgtttttgatatatatatatatatatatatatatatatatatatatatatatatatatatatatatatatttgtgataactactgcatatttagtatgattgtactagtctttcttgtgcagtgcccactggcaggtaaatcattagagcctttggtgttaatcttgaagaatctatttatgtcttataaattgaaaaaaaatgtgatnnnnnnnnnngaaataaaaacaaacaatgacggttatttaggaagaccgtcatcgtaggtggacatacgatgatgattttcgtaaatagccatcttcgtaggtttttaatttcaattttattttttttaaaaaaattaaaaacctacgaagacggttattaaggaaaaccgtcatcgtaggtcagtatacgatgacggctttctcttaataaccgtcttcgtttctatttaattttagttttaattttttttgaaattaaaaacctacgacgacggttattaaggaaaaccgtcatcgtatgttcacctacgatgacggtttttgtaaataaccgtcttcataggtttttaatttcaattttatttttttaaaaaaattaagaacctaccaagacgattattaaggaaaaccgtaatcgtaggtggacatacgatgacgnnnnnnnnnnaaacataatccattttcctttaaatgatatgaaagtacttacagtttggtgtttataccagtatgaaatgggttggaggagaggttctgcaagcactgccttatgatgtgccaattccaggttacctacccatgaacaccatcattccttatttgtttttgatatatatatatatatatatatatatatatatatatatatatatatatatatatatatttgtgataactactgcatatttagtatgattgtactagtctttcttgtgcagtgcccactggcaggtaaatcattagagcctttggtgttaatcttgaagaatctatttatgtcttataaattgaaaaaaaatgtgattacgataaaagattccatataaattgtaaataaattcctcgataaaaattactttaatggtattttaacctataaatatattatttttcacttttagtgttattatataattttattattttgttgtcccgtttgttcactattttatcaagagttcaatctgcttagttacttaagttgaagggccgaaaacttgaaacatgattgtttaacagttgtctcatataataatctttgcagcttctttatatgaagatttttttcttaaaaaagtggaagtacataaagatgcctgatcttccattccaagttggggatttggcagagcaacctcttttcatagttgaaaaggtgacaaattaaagcattatcactttaacctttttcgttttgttttattttcattatatatgtggaaagagaaattgcagtgaagttatctagaaatgataaaatttttttactgtaaatttacttttatgactgatttttattacttagctaacatttgaatgagttttatcaaagaaatattgaattatatgatcttgtaaacaaaccatccaaaattataagttgttagcaaaatatacataaatgatttttatattatatttcttacatcacccctcatgcaacaatccgttgtgcttgaagtatggacaatgcactggcctgtcaagcaacagtgatgattttttgggaacttttgggataaaaactgaaaccacactgttttctttatttatagcagggatatgcctatttttctccttataatttgggaaagaaaaactcattggtgaatctaaatcctgttacaagatgaaaaagttctgaacacatccatgatattatgttatactttcagaattgtttttctgaacatctggttagggaggttataaacatagcagtcaccttaaatactttgcagttatagttttccaagtattggcaccactcaatgttaaaatggctctagatttctatatatctttacagttaaatagaaggtataaacaaggattaccttcagaaggccaagcaactgtgagatcttcggctattgaaatagaacaagaaaaggtacaattaagatcaatttataacatggcacacacaactttatagatgttattgatcattgagtacctatctactttagaatttcattgagctcattgataacttttagtgttcaatctttggttcacctgttcaatcttgtattttggtaaaatatatacttaacttttagtgttcactctttggttcacctgttcatcacaacatcatgaatcctttgctcttgttcttctctaacaaaacataactattgcatacattcttttgctcttgttcttctctaacactctttctttataaactaattgctgttgtatcgattcatcgatatgttgcttcatagacaatgttttagcttatgttttctcccatccttcaaaggaatctttagtgagaaattggtaaaattattcttaagaaaaataaataattgatgattattattgtccaaactcacgaactgaagggaaatgagaaacaaacacacagagcaatgcatgaataattgaatattacctgccactgcttcttgtccagcggattctgaagtagccatattaaatattgacccattagtatgtcatattgttgcatggtattttatttaattttgtattaaattaaatttacagtgttaagctgaattttaaattttagtatactaacaatttagttttttttttattttatagaataaaatcccttcaatgtggtgtatttttttaattcatttggtagtatagaaaccaatttcgaaaaaaaagttaggtgatgcgtttacaaaaaaaaagtaattaacaaattgaaataaaaacaaacaatgacggttatttaggaagaccgtcatcgtaggtggacatacgatgatgattttcgtaaatagccatcttcgtaggtttttaatttcaattttattttttttaaaaaaattaaaaacctacgaagacggttattaaggaaaaccgtcatcgtaggtcagtatacgatgacggctttctcttaataaccgtcttcgtttctatttaattttagttttaattttttttgaaattaaaaacctacgacgacggttattaaggaaaaccgtcatcgtatgttcacctacgatgacggtttttgtaaataaccgtcttcataggtttttaatttcaattttatttttttaaaaaaattaagaacctaccaagacgattattaaggaaaaccgtaatcgtaggtggacatacgatgacggttttctcttaataaccgtcttcgtaggtttttagtttcaattttaatttttttaaaaaattaaaaacccacgaagacggttattaaggaaaatcgtcgtcgtaggtggacatacgatgacgggtttttgtaaataaccgtcttcgtaggtttttaatttcaaaaaaaattaaaattaaaattaaatagaaacgaagacggttattaagagaaaaccgtcatcgtatactgacctacgatgacgattttcctaaataaccgtcgtcgtttccatttaattttaaaagttaaataaaaaaaattagaaacgatgacggtttttcgaaccgtcgtcgaaagtgtccctttttaacgacacgcgcaacaatgacggttcaacaaccatcgtcgtagggataaaataaccgtcgttaaaagtctcctgtgtagtagtggcaactgcatagattaagcgaaaaatgtaaattaaaatcttaatatatatatatatatatatacatatatttgagttattttatatataacttaagtcattaaactttactcataaaatgtgacacaagtgacaaataacatgaatcatttaagcatatgttagagattcaatatctgattatgtgaatagagcaacacatgtgagtgcatcagccgtgcgagtgtttacatgaattgcttgtttctgatttgtttgttcgatatcaggtttaggagtcaatgaaattgctagtattttccattggctatgttgtgtgaattttttttttattagatttttgttcttctcggtcgatattgttgaactaggttttatgcttcccttttgattaggggtgtaaatgaatcgtgttagaatataagtgtgaaataaagtcgtatattagataaaaatagaaaagttgaacataagacttatatgcatgagtcttaagattttggttaaagtgtggtgtctagattaaatttgattttaatttaataaaattgattatagttggtattttgaattgtaaaacaatgttatgtttatgatttttgattatatatatacttctgaagattatgtatgttaattttgggaaaagaagtgtttggtgggcacattaacaaaccgaaagtgagaggagaagaagtgatggaggatggaaagatattgtaatcgtaacggtactagttaactatttcatccctgatctattgttgcgttggaaattttcaatcatcttttccctatgttcatcatgctagatttgggttctattatgtaatgttaactattatgttacgtgcttggtttggaagtttggctaggggggctggtatatggatgttaaataattctgtgtttggcgagggggttgaaattgtatggagattggtggccgaagattcgtttaagacagattttttacatatataagtggggtaaaaattcattgttacgtttgagtatgtttttttgtggctggaaatgatttgtctcctattgcagtgttttagtttgtgattgatttttttcttcttctttatgaagtaatttttcacggctaaaatcgtgagaaaatgatttaatacctgcttaatatttttatcaaataatttttgacggttttaactttcagagaaaaaaattatcaaaaaatgactgtcatatcaaaatataacggaggtatttaacgttataatctaaaaataaaaaaaaaattattaagagattcaaaattggtcaaatattaaaaaatatttaaaacaaaattataaaaatttaggaattaaaaatattttttatctttaaaatgaggatgtttttaattttagcattttaacataactcatttgttaattttctcattaaatatcgacaaaaattatcatgatcaattgacattgcaacttatcttataaaattatcctattactcacacattccctcctttctcgatcgttcagttttcatcaccaatccctacttatcttagtaaacctattaatactaatctcctgatacttcattatcgtcttcattaatttttcacttaatcctaaatgagtaaatgttggcagccttgagcctacagcaaacactgcgcattttgcagaaatgtcaccattgtcaacaaacacttaagcttcagagtgctaatctataactttaatttctaccaatatcgtttaagtattttaaatttgcacgttttcataataaactaaactaatgtaaaatgtttgagttaatactttattatagatatccacttgtcatttgtttagttttgaaaatttattatctctatatttacactagatttattgtccatattatttatatttatattttacttaatactttatccttatttattgacttagtgcatatgtataatttctaattacatactttatttttatattcaataaatgaattagaaaatgtcaagacgtttatctgaaatttaaagagaatatataactacatggagtatttataacatgtttggtatcacatcatttaactcaagacacacatccaattctcatgtaaacataaaagtttttatttttattcacaatgttaatttttttgttagtagaagagaataaatttatgatattttcctttttcttctctttcttctctttcttacttatttaatcaattttgtatatttatataaaagctactttgcatagctttcggttttcacgttttctatccagggttttcttctttctataactgaactaaacacatttaatcgattgatgtgtggaaattttcatgtgttgaattggttcaagtttgcaggctaggattgaacatggacactgatagttcttattatgagtttcccctctgttgttcattacaacttttagctaatgtctcaagggtttatttcccccgttgtcatgcttaggactatgttttgttttggccattaattcataataaaaagaaatagttcaggttcagggtatttcacccctaaaatgtaatcaatgaaaaacatatttaattgtgacgaagtatttttgtctatgaatcttagttgatgtaccgtgcacgtgtctctcttaaatacattctgagagaagacaaaccaatgtgctaattagaccaagttaggagtaaatgaagtaatgtaatgaacactggttctaactccttgaccaccccttcgcagagcctgccccccccttgatgacagatgatgctggaactttataaaaaaatcgattatcataattttttattccattttaaagaattaaaaaaaaaaaacgatttcaaatttccacttaaagtaatttcaagttttcacttttctaattctaaaagttttaagtaaaaaagtaaaattgtttctggttatcttaatagaaaaagcaagacgaattaataaaagtattattaaaaggattctagttctaatgaaaataaaataatttttcaattttttatttattaaatttaaattcaaaaaatagaagagttgagtgaaacaaaaaaaaatacaacaatttataagaataatccaataatttttgaaagaatcatttcggttcaagagtttaaaagtgcttcttatttttggttttatttttgtccaactataattttattaaatatttaaaaataagttttttttcaatatgtatatttaatattttactttttaatatattatgttttcaattccttagcaagtaagttcaatataaagaccattattttggaaaatgatctatgaaatttactagttatatttaaaatattttttatttatacctaataacccttttttgttatttaacaatatgcgaaaaattatacgttccttaaccaatattttgcttggctctaagtggaattttaacaatttcctcttattgatgtgttattaaatattaattatatatttaaataatattgggcttttacatataaataacttgcaacgtaaaagggcagagtagagtgatgacaaccagatcaatactaaaacgggaccccttcccatttctaaaaagaatactagttaatatttgtatgaaatattttgttttggttgaagtaatgaagttcactgacatatacgcttgagaaaggaaatttaattattgtacgtacacataaagtaagcaaaatttccacataacttgccaaatcaaaataatcctctgtacaagaagccagaaagtaacaaagggaaagaaacaacacccttgttgtacaataataacttggacccttgtggctcttcttcgatgatagtttctaatctgaatgaatttgaggatcttcgactccgagaatgagaaatgaggagggctggtgcaacttcaccacaattgtggacagatttcatttctctcaccatttgaaaataatgaaactcaagcaagcaaaccctttgttttttggcagaatgagaaaacttgaatcatttatagattgttacaaagaatttaacgaggtttcaaacccgaaataggacaggacagaaagtccaacaatgttagttaggaaccttgataatctaatctagtttgcatatattttcctcgacaactagaatttggtggcaattttgtttttggtacatatttggtggcaatttttttttccttttacttatttgggattcctttttacacattggtgaataaattctgttatagttgctatatttttttctggttgaattactctatataggtttttatattttttagaaaacttattgagtttatctcttttaacatggagaaacatgtaaagtaagaaagtaaaaagtatatcgagcattcgttatagttaattaagcttatgaaatactttattaaaataattaataaatattctttatgcatttccacaattgaaaagactaaaatgcaaaattcttacaatatgctcttttgtctatatatttaaatatcaatttagatattaactaaattcaagtcttaggcaaacacttaaaagaaaaaagtttccaaaacacttttttttttatagttacttaatgataaaataatttttatgtattgttagtataaaaaaatttcatactattatttaattacaattcattatgaatgacagtgtaaaattaatgataatactttaagaaaaacttaaaatatacaaatttataattaagtctctaatttaataataatttttaaattatgtttcaataagcttatggtagacggtagaatgcttaaaatataatgatgttgaacaaatttcaaattaaatatgaattgttttggtgtagttttttattttatttttcattcctctaaaatatatttgtctattttcgtattatttattttctactaaattcgctcttgcagaactgtttgagtcgcaaacccattcgaacttgaagtctgcaacgcccggacaccatcgacgaccatcggatgtcgacatcgtcgcggtcctgtgtttgagcattcaattccacaccgttttttcttggtatctcctccctcatccaaactgttttttttttttttttttgcttctctcacaattcaatttcagatttcttgtttccccatgcattcatatgaattgtgttgtgcttctgtcatttactttatgttggtgtgcgtatgccagtgcaatttacttcaattatttatcacatttcaagctatgctgcgtagatttttttgctatcgtgcaaaaatcagccctgttgtcaaataaatctggcacatcatatctgaatttctaactcatctataagattttactaactttatgagtattttaacattaaaaaaatgtaaaatcagtccttagatttttagtgccacctgcaaacccaaaaagttatatcgtgagaaaattatgatgttttagaatttttttttttttatgttcacgatttatttctcttttatattttacattgcagaaacaatttttcatgcttattatataaaattttattacttagtttaaaaattacgtgagttcaatttgtccaagatccgcaagcccaaacatcagtcatctccttcacatgaaccctaaatctgaactaccttgattccgctctgcaacggctgagaaaatagcgacgccgaaacacgctcgtcttcacgatcctgcgatccagcgcggcatttccagcgattccgctctccgaccagtctgcgcagggtgaagaattgcgcgattcgtctggaaatcgcgattcaagcacgtttcatccccgatacagagattcaaccacgattcaggaacaaaaacgagacaacctccgattcgtatcggtagcagctgtaatcgtatcgaatcgtgcgatacgtatcgtgaatcgtacgatactaactaccattgatgacaattatccaagtttcatatgatttaaggatggagacactgcttctaggtttttgcattgagtaacaataggtaggagcctaggaggtataaaaatcttttgaaagagtttgtgtcggaatgcttcctgccacgtcttcccatgggctctggtatgtgctatgcgtggagctagttcagaaatagttgccaatttactttttatgctttcatacacttacttatggaataatttgtttgctagtcttggtgaactttgggtggttgtgccactttgtaacagtttcttttaacttggttcttttaaggataaggaagctaaaattacatatttcaagttttacagttctatggtgaatttggtttgaccggattccctcactttcaagggagcctctttgccccttagtctactgttggacaggattattttatttgcttctatttggtgccttgctcatggatttttgtggagatgtcttcacctccaatatgcggagagctacgtatttaacagccttgctgcactcttgagtcttgaactttattgttatttcagtttttaaatttgtttttcctgttctggaggatttcttatccttcctactaattctttatcttaatagttcttattttacgaaagaatcaaaacttgtcatggattgcatatttgttaccattccttcttcaaatgttttatcttccataaatgctacaaacctaatcatcagtctgtattctgtacctgttactagaagatatgtgcatgaagttgactatagattcctaactgttttatgcaaataatccatttgcagctttcacatattggctgtcaaggatactcagataaactttcttggtaactatgctgacttttatgcaggaagttcaaaagggcatgatttccatcaatacagcctccatattggttgaaaattgagcaaattctgtttgagtatacaaaaacagccttgttgggtttcagcattaaatacaacatctccattccttttatttcttctatcactcccaacttctgtcatgggaaaagagaaacaaagcttcaaagaagttcaccattctcataatcctaaaacaactctccagtggttctttcttgtagctacctgcataaaagttcttcttttcccatcctaccgtagtacagattttgaggtgcaccgcaactggctagctttgactcactccctccctctttcccagtggtactttgatgagacaagtccatggactcttgattacccaccattctttgcttattttgaacgatttctatccagttttgctcacttcattgatccccaaatagtgcatctccaggatggcctgaattatagctccaacaaggtggtttattttcaaagagttactgtaattctttcagatttgtctcttctttatggggtttacagacttactcggaatctggattcaagaaagcagcagttgatctggtcattggttatttggtcaccgatgcttttcatagtggaccatgtgcattttcagtacaatggatttctcatcgggattttgttgatctcactttcatatttggaggaaggaagggatttgttaggtggttttgtctttgctgttctcttgtgctttaagcatttatttgctgtggcagcacccgtatattttgtttatttgttgagacactattgttggggtggaatagtaagaggcttcagtcgacttttgattatgggaggagtggttacagcagtgtttgcatctgcatttggaccatttttccacctagggcaggtaaatattatttttgtatcttgaattcatatttggtcatcatttttcccatatgtcttgctgttttcccctttttctgataaatcattgcattaaccaatttgaaattgattactatttgttgaaaagattaggaatttcaggtgtcttgttgattttcagaaatgtggaatgataaagtgatatgttttgtttccaacttattgaataatggagaatacaattggatgcttggtataaccatgaaaattgtatgagaaggagagttcttttatatgtcaaggttgtgccctgcatagtttctaatctaatgtcgatgtccagatgtactgagttttgatcaggttttataagaaaacaatttattttttatttattataatccttccacagaactaaaacaagaaagaagcaataaattaaatccaaagtaagtaaccacctgaactatctagtatccaaatgaggctaccgcaggaatagagcaatgctaccaaattacaaatgatcaactttgcatgctcaagtgaaagggaacaacttaaatcaccctttactaaattcttgtattcattttcctgtgtaaaagtgaagatatttcatatgcactctttgcattattgatttgcttattgattattcaaattataaattgcagatacaacaagtcattcaacggttgtttccatttggcagggggctttgccatgcatactgggccccaaatttttgggtattctatatcatgtcagacaaagtgcttgctttcatattcagaaaacttgggtttaatgtccagacaccaacaggttcattcaccgctggtctagtaggggattcctcaccattttctgtactacctcaggtaagatttacttttgtatttttattctctgaataacttgtttgttgttaaaccaaaaaaaacaaagtggatgttatgaccctggttaagctgatcacatgcttttgtgattatgtcaaaacagatgactgaagtaccttattttgctgtatacatttcattagtatgaggagatggaggaggatgttatattatttcttcaaactagttgtcatgcaccatgacctagccactgatagattggaaatttacttttaatcttgctgaaaatatatagctgattcactggatgatccttatcccattttctaagaataaaaatatagattataaatgtaatgttcacatggaaaccacaacttggtaactcaaaatcagcacctgtttgacatcaagaaatgatacttgtgaaactctataattggtgagagaatcataatattagcttttacatttcacacctcaggctagctatttcaacttcgaaggtgctacttttcaattgacatctacaattgagcttgataactagttatttgaaatctatgactacgatataacatcaacattagttatacaactttactttttattattcaaaagtttcatcaaagcattcatttttctatgtactaataatatgcagatcacaccatttgtgaccttcataatggttcttatacaactttacttttcactattcaaaagtttcatcaaagcattcatttttctatttactaatatgcagatcacaccatttgtgaccttcataatggttcttcttgccttatctccttgccttttcaaggcttggaagaatccacaaccacagatgattagtagatggatagcctatgcttatacatgtggctttctttttgggtggcatgtacatgagaaggcatcactccattttgtaataccacttgctattgtcgcaccacaaactctggaggatgcaaggcattactttttgctgtcaataggtatgcatttaatgctaattcatttgtttgcgagcttctaatgctttttttttcctttcatttttctaatgatataaaagttgaaggaaaaaaaacttgatatataagtaaaatgaaataaaatattatgaaaaatgtgtgcatgcttaattacatgtgatctttatataactagtggaaaacacacgtgatgcatatacccctttgaagacaatattttactaaatgtgataatgatttttttcaataatagtttgtcaattgctagtagtcttgcaaatatggtccttcctatcctattgttataggtttctgtgaataatgctccggctattgtaatctatgccctagatgtatatagatttgtcagatgtaggttcgtatattttatttccctttaaactgagtgaagccttttccattccgttatgtgtaagactgaacgaacacatgaagttacttgagcatacttaaggtttttggttagttttcaagacaaaggggggaaatgtaaagataagcagatttttcgttcatatcatagaaccttgtataatattcctctcccttaccttcgcatagcgaggaacctcttgataatggaatacgtagtttttttattttatttttatcatagaaccttgaacaatattatataaattaggatatatgagtatgtgatatttaagaaagtgagagaacgttatagaaaatacagagtgaaaaaagagtagtttctctgaaaatgacattctaaccggtaatcaaacttgtgatgggctctggtgcatataggatatgtgacaaatagggtatgatacaatacaagtttacatgaattttgcacaacggaataaaccatgaaaaaattctacatcagctttgtctttttctggtaatattgcttttttgtatatcatctacaatccaccaaacaaaactttgttttgaaacctttgtaagctggtaattaacgcataaatcttcaaacaccctttgtaagctggtaattcttcaccttgcttctgtttgttagtgtgtgttttggtgccttctattatttgagtaccctctgttactacagctgggttgcagctgtcagtttgttagttttggtgctgctggggttacaaggttgtgttaactcttgtctgtgtatataaagaactcggggttctctctttgcaagtaataataatagttcgcattcagtttctctcaggtttctttctctactctgtgctacagttttctttatactgtttttatattttcatagcccaactacagctaatattaagtatacttgtgagacaagcaactattccaatgttgcacaacattaatcaagcagcaaaaaagacaagcaaatctatagcaacagttattctatccagttcctcctttaacttggctatatgtttggattaaaaaatttgcttttaatgacctagaatacttttggatgccaaagaaacaagtttcaggtctcaccattttggtatcagtgctattcttttcatatttttgtttctttgaatttacccacgttacttgtgtgtgcagtatcttgctattctatttttccgctactatttgaggcacaagagtatttgatcaaagtattgttgctgcttctgcactccattttgatgtggtcaggattttcagcacaattttatgatggtgctgaagctacaagagcgccaactgctaattcaaagaaaaaaaatgatctatttggatctgaaggtaattcgggtgcaactgtgaagaaaggttttgctattggctggatggagaggatttatctgacaggtctcgtagttgtagagatatggggccaaattttacaccctttacttttgggtgataaatttgcatttgcacccctcatgttgatctccatatactgtgcttttgggatcatgtactcttggatttggcagttgatatccatagttaaatctcgttaaattttggactgtgcagttgatattggattttctttttgtgaattttatatgcgaaatttcaagagttaacatttgatttaacttttttaatcaaagcaagtcactgttttacatgagtattattaaaccatagttaaacaattatttgatcttgcctttgctgccccagattcatcttttccttttgtagggtggcttaactggctagagggatcagataaggctttgcatgcgggtgaatcctctagtgacgtgtcactagttttgtttgggagatccccctgcaagattgtggattatatatatatatatatatatatatatatatatatagccttatataagtagtttctgtgaagaaaaatatcttaaaaagtgacccttttactagattgtggattacatagccttggaataacttattcatactattgtatttttcttttaaaaaaaacataattggataaggatcgaagaataaagattgagaagggggtgtgtcccaagaaactgtgccaagagtgaagataaacagaatgaaactccaagataaagtcaatagcagtgacactagattaggatcatgcatgtacgttaacaacaaatgtgacagcttctattacacactttagaggcactgggctttgtgaggtgaaacaagaaaaaatgggaatattttaccattgcattattattgcgcaacctggacatctagtaaccctactttttgctttgctttagctatagctataactagtttttctggtgatgtatagtataactagtttaaatttatggcgcaaacttgttatctagtaaccctactttttgctacaactataactaggttagtccttatttttttgtggaactaggttagttgaatttggcggatctacggattatactattgttctctttacaaatatgaaaaaaaaaagattttattgtactaagtttagggataagatgacagtgatattttgtgcccaagacaaaattcaactaagttgtgctacatcccttttccattttcttttttgttatctataatctaaacatataaaaaatattaataacattccagtaacactgtcatgtagaacgaaacgatcacaatttttaataaagaaaagattgtgaaaaagaaaatttataaatataaatgatgatgtggccattgcttgtggaataataaatgctggatagtaacattttattcaatatacttttattgagtaaaatttatgtgagttctactaaatatgtcagttccgtttttcttttggtgatcagttcattcctaaagtagtgaggcttacatcaatttcaaccaataaaaaaatgtgttgctaacccccaccccaatctcgtgtaatatgatggaaatttaatgagggcaatcagcagtgtttgttcaaatcaagtcacatgagagaagagcttatgtgaaaatttagcttatacaaagggtattaagcaaatttaaatggtgaacaggactagttgtagttatatatgataatatagactattgaacattttttttattttggtaaaaaaaaaaggaatatttttatcctaattgtaacatttcccattataccgttctctctaatttcaaaaactatccaattagcttacatcatagaggatatatgcatttatcaccaaaaaaaaaaatagtggatatatgcatgaatgtagtgaaagaagaatgaaataactttttttatcaacgcgaaataattgtagttattaggtaagtttttgcaaactatttttaatgatcttaattttataacattgattttgtttagaattaaattcaaatgattttttttcaagaacaaatttaaagtaaaattgagtcgaaaattgccctctaaatgcataaaaacttagcataaagttatcatataaatgctgaaatatcacttctaaaaaaaatgaaaatgtggaaaattgaaataaatgttttagctgaaaatgtaaccatgcgtgactgtatttctagattaagaattcttcagaaaaaaattggcgaaacaagactatggtacaaaaagacaacagacaactaattggaatggggcaaattaaactgcagaagaaaattgttgggacttgagttgtgtagagtaaagtgaggactagaaaatggtcaaatggaaagagaaaatgtcttcaaatggcgatgctttaatttgaagggcagtcagttgttcacgtcacatgcatgtctttggttgtgtttccttccatttcctgaaaaagaaaacaagagtcaccagtcaaatttcatatcccactcatggctcatgatttaccaccaaaaaatagaataaaaaaatacaatattatttgaattgataatttcgtcatgggtaaataataaacaacgggaaatgaagttagtaacgattttctctcactgtcctggtgagtgtatgattatgtaactcctacatgcataacatgttatatccctctcatcaatagaaaaataatatttcttttttctaaattttaatttatcatttttaatttctttaggacttaatcactttttattcataaaaatacaatatttttttatgaggaacaaatatttttaatttatataattaagtaaatatataaaaatgatatttactccatatatttataggaattgaaataacaataaaaaaaaggaataaaggtggcattagaattaggaggaataactaagtaggtagccaaacaatttactgtacagtgaaacatataacaatttgtattgttttttgtcaagaaattgtattatgtataaacattttttgtatttttaaattaaataataaagagtttaaatttcatatattattagacagatacaaattatctcaaatatgattattataaaaaatatttatattcttattatatatgataatcaatgattaacttatgatgtatgattaaattaaaatgataattgtataattctgtagataatgatgattttaggtaataactgtcagctagtcatgattctgttttgccatcaacaggcaatgcgatcaatcctggtagtcttccaacagattttatctttccaaagtttactggtcaaacttatcagaatcaatctctacccgatcgattttcatttaatttattcacggtttgtttaaaacattgtcaataattttcttaaggcaaatttgttggtacttattttaaaataagtttctctaaattctctgtatggtaaataatagtaaagaaacgaagttttaccactataatatacgaaggtagttaaacattgagtatatatattatagggagattataatatttgcctattttcaattttaactatgaagttagaaacgttttacttttttgttgttttgaatagacgatgaggtcatttgcagtatgcaacagataacagagactgaagaacaaacaagatacccccaaacaaacacagtcgcggagcttgaattaaaatttagggggactcgataaattttaatgcatatctttaatctataatatcatattaaattgtaatataaatttaaaagttgagaaaaaaataatcaattacataaaaaatgataatttgtttacataattattacaaataaaaattgataaattttataatgagtgttaagataggaaaaaacattatatgtcaagcattacatattttagaaggaaattaaatgattattttatgaaaacataggttgcaaaactataacatcaaaatggaaaatgggagtaataacagtgcttaaaaaagtaaatggatcactgcatttatatcaaaacagaaaaataagtcaataatacaattgagataattatatattcaaaaaataactaaagttttaaaaagaaaacaaatatatacttatgaagataaatcatataaatatgaaaaacaaatctattaatattgttgaaactaagctacactttacatgttcagaagtatatatttgttttcttttgttttaagaaaaaagtataaaattttttaaataagtatttgaaataattatttgaaacaattatttgaaactaagctacacgttacatgttcagaaattttttttgtcctaaattacaagttaattgagttaaggtaaaaaaaaaactaagtatttgaaataattaatatttttattaatcatattattataaacatatatatttataattttgaaaaactttagtatcatggctcccctagcatagtccgcatgacatgatgtgtgaatacaggaaacacacatgacacatgcaatcacattattatgcatccatcacaaacactaatcatttcgtacggatattatatcatatgtatgacgtgctttctctctccctttccctctcaaaaacaaaaacccaaaattatctgcatgcatatcaatatcatcaattattatcatccttactagtatttagtagcaccccactttccctcaaaatccatactcaccggcgccggaaagagaccatcgacccaactaacttttctcatttaattattttaacatcacacgtttaaaaagaaacaaactttacaataacataccttattcaatcggcatggtcgtcgataggatttgattctttaaaaaaaaaaacaaagattaaattaagtaatgaatgaaaaagttaaatccatagcttgtgcatcttgtaacagctgaaattatctgctaattaaatacattctaaaatgagtaatacttgttttttttcattgggtagagcggactacataataatcaatacttaaaacaaaggaaaataatatgcactatgcatgcagccatattgttagccattaattaaacattctttgaatcaagtttgatggagaaaagtatgtatctattctgtaaggaagtacataatcaacataatagagaaccctcggaatacacggaaatacatcttcggtcagtctctagtagtaaacttaattactatcacttctcttctcactactcgagtatctatctatcactataataattgagttcaactccaaaaatttaatgcacttagaccgtaaaatttgtaaataacaatagtaaatattttttcatctctaattatagaattttttttctaatttttacatgtatcaattatttttttcttattcatatttttatttaattattcactctttaaatattaatgagaaataattaagtgaatagtaagataggaaaataacaatttttaaataataatacaaataattaaattaattacttttattaaataacataaattaattgaaagaattttatgactaggaaggaaggaaaacattttccggaactaattaactaactccaagtctagcacgataaacattgatatatatatatatatatatatatatatatatatatatatatatatatatcaccannnnnnnnnnnnnnnnnnnnnnnnnnnnnnnnnnnnnnnnnnnnnnnnnnnnnnnnnnnnttccatctaaaatgattaacattgatcgatcagtttcaccattaagtacgtacacacatcttaatcctatgaacataaaatattaattgttgcaaatatatatatatatatatatatatatatatatataatctggcaatattaagtaactatatattaactgattatatattgaaatttgaggcaatagaaataggaagatgaattagttaaagccaaagggctccggcttgcttgaggagaggaacgagagtgccgttgatgtgggcagccatgagggtctggacaccgccgaggaactttccgccgacgaagacggcggggaggggctggtggtgggtgccggcggcgagctggaagaggagggcgtggatggcggggccggcggcgtggcggtcaagctccaccaccgtgggacccaccccgaggctgaagagaaggcgcttggccacagtggacatgcagcactcgctggagctgaataccaccacggccttgcacgacgtcaggcggtgcaccacctcataagggctcatcatcgatgtcgctgcttctgatgctactacctccatttctgagttaattacttgctatattgccttggagagagagagagagctagcatacatatgaaatgaaatgaagaaggtgtgtgaatatgtgagtttatataatgtatcgaggaagctaagagagtaggttggtaagtgattaaccaaggctttttagcagttaaaagtgatattggactcgtgagtccaaggtaaaaacaaaaaggataagtttttaccatctttggaattcatcttactcactatagggtatattttcagagagcatgcataatggataatggattattaattgttgccatttacagagaaataattaaggaaatagatttttttttccttcttctttcttttctgaatccttaatgatcttgttgtttatatatataaatgggaaaaaatcaatttgatattggaaagatacgaagtgcattagtcattatattatatgttaatatgtaaagctaaattactccaaaaattaacaagtgtcagttagcgtgaggtactgaggtatgtttataagtaatgttggatttacatagtaacatatggtcaagaatttcatcttcttcctcttttatgatcatctctattttgcacatgtgagttctcccatttttttccttatgaaaataacctaaatccggcccctcactaaaatctgcttagtacttgaagcaaaatggcaacaaaagtccaaaagttatttaccccacccatttgtaagtgtcgttaatcttctcaactcattcactggcgactacaaaatcacactactaacgttcatgtcacatgtactaaaactagtaggaacttgtgtgcccccatcgccattacacaaagatgatgggtacgtttggtgattagacatgtgggcaacagaagcaagtggagagaagtattctagagacaaaagccaagtttttaaagaggtacgtattaaagagatgtgacttttaataagtgattgagaagtcaaataacaaaaactgattaactctcctttcaaatgaagatagtttagcgtaaatcacttggcaaccttagaattcttgtaatattcacagcttcactgtggttatagtgctatatatatatatatatatatatntaatattgtattttacttttgaaagtacgtacgcctgtgtttactcttttagaattgtacacaagtttaattaaggtagtgtaaagttcatgaataatgaacacaattattgttgttggtgactaaagtctaccgcgtataataactcattgtacagaaaaaagaaaaaaaaaacgagtataataaatatgacagataatcaatttcaaactctttcaaaaataaaaatagtgtgaactcacttgattcaaaataaaaatattgtgaacttgattcaagaatttgatttcgtcaattttacaaaaatgattgaatttgttttgatttcgaattaaatattttttttttcacttcaaaactatcttttagcggtgcttcaaaatggttcattactgtataaaaaatataaaagatgttaattattttcttcattaagtgaaatctgataaccttaatagtttaatctaatgattcttaattaacatgggtatccgatatcgttaatgtgttaagctgcaaagtaaaaagaaaaagatttaaaaaaaagaaagaaagtagtaaaagtgtaagggagaagaatgagctgaaaaaggaaggtggctagctagggcgaatgggaattggtgttttgtttccttgtgttgcgtttgatgattgatgatagagagacgacggcgttttcaggatgtgatgtcgggctgtcgggttcaatacgaataaaaataaattcaaagacagatatgtaagaaattaagtaaccgtacgaaaggagggtcacgcgtcttatggtgttggagaagagaaagaagaaagcgaatcacgattcagatttcacgactgtgactgtcacacatacaatatcaactgctgcatgcagctctgctgaggactgagtaaaactaaaataggcaaagcaaaagctggcacacttgcatgccacattatatgctatcatatcccaataatgcctagagaaattcctatctcttaaatgttacgtgtccatgtgcccctctctcagtccaacataattacttaccacttaattatagacttgtgtgcaataaagacttcaagtgcctggacatcgctttgactgctatctgccgtttccaatatcttgcataaacgagtatcattatcaacaataaatattgatcagatatacatcatactgaccatttattctttaaataaatggtttaaggtttaaattttaattttgaatatgaaatatatatcttaaacatattcatgattccaaaaacgattaattaagtttcttgactggaattactccatatctagattcaagaccatggtaaaaaaatgccacataaatgagcatcataaataataatttaataggacgacaggctattttagaggtgaaaagtggcatattttggagatttggtacagatgacataggctagaaaattttgaaaacataagtgggcgacaggctaatttagaggttccacattaaaatcagaagaaaagaaggaaattggttactagctatcaccaaactttatcaatgttaccttagcttgtcactctttatgtttgagtcgctgccagaacgaaaaaaattaagtatggtatgttgatattagtcgtgaaaaccaattgtgcagtgaacataatcgagtatgttatcaaagcataacaatcgattatgcaaataagcataatcgactatatatagtccaacagttgtttttaatttattgcaattttctcattcttttacatcaacaattttgacccaacaactcactatacaccggttacttattttttaagcataaatttttgctaaagatgctcttaacaaattgcaacgtacactcccctcgttccagcatctttttggcttttgcttcaggggcactcttcgtactggaaagtggaaatcaatgcttcttcaatttgtggtatagcttgaagccattcaagaccctcggggtagatggatcacaccctggattctttcagaaatattagggtttattttttggtgtgaagaaatgctaggttttaacaaatcacataaacacaaaaaatgaggtctttataattaaggccattttggtccaaataatgtgaaaatttcgaaatatattaaatttttcactcccatttttttcaactcttaagagtaaaattgttgtattatacgagaacataaaatggttcatggacgctcacaaccctataaacactcaaaaagagaaagagatagaagagagagaattataaatgtaataggtattatgacttgaaaaatgagataaagaaaaaataaaagatgataatttaattagtagtgactagtaaatactgtgtgtccataacttctgaaaaaattctaagctgcacattaacgcttttaatccgcagggtataacacgtgatggataaatttgcagttacttagggttataacgacaattatatttttgaaatattggaaactgcaatgcttccaatccacactatcagtatggcgcttgcatatcgatatattgtagataaagcaaagttgccgcaaattcagaacaatcaaaactagaagcaggagcattttagaattattctccaaactatatatatggtccccagctacattctactacgttccccaagtagcaaaatacacaagccattgacataaaaccaaatatggattgcagcagtggttaaagatttaggtttaacttcaagtctcgattctatcactaaaattttgcttaggggataacttttttcatagagatctcttgtcgtccaaagcctaatcaagtagcgacgaggtgataaaatcgtttacaattaaacctatatatgcattaatcttcttacgtagatctctctgccaatagcaccacaatatatgtatacacatgctaggtaatatttggattttttctttgttctatcgtttttatgagtaaaaaaagactaaaatatgttttatgttcttataaaattaaaaaaaaattcaattcttgttgctataactttttatatatatacttttagtctttataaaattaaaatgtcataatttaactcaaaattagagtaagttaaaatcaaacttatgtgtttaatgaatataggttggtctaattttacacttatctcgtatttaagtggacattcattatacatatagatttgattttaattgatctaactttgaattaaactataatatattttaatttaacaaaaacaaaaaacataaaaaagttttgtgggaatgaaaatattcttttaaaaattttataaggacgaaaaaatatttgaaaaaaaaaaaaaaaaaannnnnnnnnnaaaaaaaaaaaaaaaaaaaaagaggcagtgggcggagaaccagccaaggaggggggaggaggtggggagggatgaggggaggacaatgcggtggagttcatgcgtttggacgtcgacagagtagttcatgcgtttgaacatctgacgtggtttcatacatgtatcgctgacgtatccaactaacggacacattatcacgttttggatggagactagttacaggaatctcctacaaaacttttaaagttttagggatccaataagaaacaaaaaaatttcagggattaattataaaattcgaatatatttcagaaatatcaaacatattaaagcctaaaatatatcattaaattgaatataaaaagtacttaaagctactgagaaagaacgaatcaattttcttaatgtgaacttaaaataagtaccgaattgacatgaaataaatgtgagactacaaaataacactaatattaagtaaataattttcttaattttggtatagaaaaattataagacttagtcaaaataaatatcccttctattgaaaacataggattactatatttctctcttaatctaacaagatctctcaatatgtcttcttctagatgatcaacaatatctttcaattctcataaagtacagaaaaaattacaatttactctcttttatctcttttccttgaagagttatgtaagaactgtcacttattactattcttgtctaagatggatgggttgttaatgattcaactcctcacaagtctttatatacgtgtcttctttcaagatcaagggagtaatgaatgataattaatggtaacttgtaattttttacaattgttgatatcctaaannnnnnnnnnagatttgattttaattgatctaactttgaattaaactataatatattttaatttaacaaaaactaaaacataaaaaggttttgtgggaatgaaaatattttttaaaaaattttataaggacaaaaaaatatttgaaaaaaaaaatcaaacgaatccgggttactagcaaaaattcccggttggaaaatttagctttaaccaatatatatcaagataaaaatgcaaaatataactacttaaaacgcgtcaatatatctcatacgtactagatatatatacaaacaggaaaagaaaacaaaaagaaagaaaaaaagaagtgatcaatcacatacaccaaaacttaaaaggagcaatgacgtaaagtcctaaaatatgtagtacttccttcatggcaatgaacgaatactccccaacatgtgattcaaaaactggtaaattgggtcaagacaagccctgaatgggtttgcatgatctaaaaccctccatcttgaataggaagcagccctgttctttagcctttcccagaaagacacaaagcagttttggtttctggtcaccaacaacgccgcagattgtaggtaaaccgaagctgcacgcttcaccaactcgtttctgatagcaatggttgagtcaaagtcatttccctcatacaaggttaaataataccttgttggtgtgttacatataatgtccttcaggctcgtgtattgtatattttcaatgatttctgagtctctagcaactgaagagattctaggaattctcaatgaacgtgtgctctgaatctctcctgtttgtgtttccattgttaacaaaagccatgtgacgttgaattgcatgcaaatgaggccatgctgaagagtacaaattggttcctgcaaatattggaagtttttactttggtatgttgttgggggaaaggacaaaagggatgttcatgcattattaatttttatattaggtgcgataagatcacctttgaggcttggaaaggtatatagaaagagagacagagagagtttggtggaattactgattatatatgggtttcctttgatatagggaaatatttcccaaatagagggtcaaattgtacgcttatacgaacaagtcattattttaagtggtatcagatttgatgttcctttaaataagatctgggatttgaattttgtgaatgataaaaatgtgattaagaggatataatcacactaatgatgatcaactaaattttcaatggatcaacaaagccaataaatactctgaactaataattaacatcataaaaaaaattataaacttattagcattcactttatgaaaagaaaacagccatatttctgtcactaccttattgnnnnnnnnnnnatatatatatatatatatatatatatatatatatatatattgttgatatcatgtgaagccgtgaaggattcgataagacaatctgatgctactatggtcatgtccttttggactggacattaattaattgataccttgtctttcacaacaaaatttgagcaaaatgaaaggcatctcataggctaaatctggtttattgatcatattgggctgaaagagtgctgtttcatagcaacttggcccactttcctattatattgggctgaacatggccctcaaagacgttagtatatgaaattccaatgtgggaggcctaggaattttgagctggaaggtaggccgtaggactaggattgaagcctaatgattttccaacccatggactaattttaattagtttcattaaatctgagactattgtttcttgtactttcattattacttcctgtatattatggaaaactcattttaaaatgtaaattgttgttccttctgataaagttttcaaaattaaaattaaaaaaattaacttaagattaataatgtcttatgaaagattaaattaattaacttcattactgattaaaaaatattatgtatcatatcccataccaaaaacaatttaaatataattataacaatttcagtaaattatattagaaataatgtctaaaacgcactttaaccttcacaacatatatatgcagggaaactcaattcctcctgatgtctcattaataaaaaaaattatgggataatccccttgaaattgaatttccaatgtaatagctaattcaataaactcaagtaaaaaaaaaaaaaaaagcactaggcttcaaagtcatggctccacgacacacatgccagccaatttttctttttctaaaggatttcctttcctttatttctgcttcggtaggatccacaattccacatgcttgctcttgcatttgaactttacataaaatgggacctgtgagagtgtctaattggactctagtcactattaaactaaaaattctaaaaagtctaagaatgacgttagtgatgtaatttatcatttaaatatttgatttatcaaattgtgttccatacgttggacttttgtgatttcatctttctttccaagttggcaacttccgctttataagttccttcacttcatttttatatacacattttactctaatacacactgctttagtcagctaacttatctattgcgactcttttgttgacctatacagatatgtttaagccattaatttggataaggcatttttttaaggaattttggatgaggcattggatatattatatagtattaaacaaataactcgatctactatcgtattagtgcaaatgagacacaggtcagacaataatatttcaataatttcattaatttaatcaatttacgcttattattcatacacgttttcctcttccctcaagcaatataatcattcttgaagactaactgaagttttgaaatctccattaaaaaacaaattatcttcttttactattgacacttaagttatccttaaatgcgatttattcaaaatcgtttgtctaaactatttatttgacgatttgagtgttcatatatagtaagtagctagtgtttatttaccatgttttcatgtaatagaattattcgagttcaaacttaaagaaagaaaaaaaaaagaatataatgatcaaaatgttagatcacgtggacggttttttgtatctgtcactttttattggaccatttctcgggctattgttcaattttcattaaaaagatatttctatttgcttataagaaagataattaaaatgtatggaagagaaaagaatgaaaaaaattataaagaaatatttaaattaaataaagaaaaaaaaatacaagatccacacataattttgaaaatttatctttctttcttttttatttattcacaaccaaacatacactaaaaaaataagatccacgtgtttaatttactttgccgagtagtatattttttgcgaagttaattgacagtttcactttattatggttttacaggcattcatattgtttactcataaaacaaaagtaaacacaaattggaatatgatgatttgctataggatgtagatatggatgagacaggtatcaaaagggaaattttcttactttgaccgaatctgtcaactgtgtttcacatggaaatcgtaagcaacatgcttcatttctttcttggggttgagtttcgtgtaaacatttccttgtcggatgcctttcacccaaattgtagtcatcgcggagaatcttacttttgaaagcgaagcataaacgtgtacgttcttttgaatcacaaatgagcatttgtgtttgaatattaatttgatgcaatatatagaacacaaaacagattagaattttccaagacatatagatcgaaagttctttggcccatttgtataattatagctagagtgccatatatttgtaacacgcttaatgttggtagtttcttaaagatagttcatttttaaagtaaaatatatgtttaaatatgttggacatctctgcaatatacttgaattttataactgatatttgaaattttgttttttttttcgttggtttcttcaaacttcaaaagttttgtagaagatttttgtcattagtcctagtctaaaacatgatgatgtgtctattatttagacatgtcagctatacacatatatatagtcacgtcagacgttcaaatacgtgaactacatcgtcgacattcaaacgcgtgaactacaccatctcctcctcctctaccaccgtccctgacttcctcacctccccctccttccacgacttcgttggaaccatcctcccctcctcctccctcttcctcgaccagttctccacccctccatttttttatttattttctttactttttttctttctccatttgtcatattctcttcatcttctttgtgtgctggtgacatcggcatcgttcatggttaggtgtggcatcccgcaaggttttttctcttcacgacaacaaacatgaacacattgacttagatcatttccttctatctcttgctccgtgtcttgtattctcatcaacgaaaaagattgaacatcacagcgcatctacatcgacattgattcttcccacgtgtgagatgttactggacattggagtttttttaaaagaggttttgcctgaggatttggctttccgaaacaactagatcgacaatagggaggtagagtagaactttggagtctgaacaaccagatcaggtgagcacaatgtcgtttcgtcgtcaccatgtgcactctaaagcctctacccccaaccgaagcacctgccaaagaatgatatggcaaatcgcaaatgtgaagaggaaatgactcttttcatacctctagttaaaaacatgttattttcacccaaacaaatattttatagatctaagaacacaccggtaatgaagctgtaggaattggtgaaatgaaggggataacaacaaatggagaaagaaaaaagtaaaaaaaaaaaaaaaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaatgataattaatggtaacttgtaattttttacaattgttgatatcctaaaactcctaaatttcactgttgaatcaatgtgacagtccattaattgtggagaaattttaatataaatcgaccaatttgatataataagcatcccaacatttcaaatgaaaattataagattaatttagtgattaaaaataagaatttaagagttaaaaataaggaaaagaaattgtgaatttgaatatctcgttaatattttaataaaaactcgtaactaaccaaacttataggaatgatgactgataaaataaaaataatgtcatcatgatgagttgttgaaatgtccattctatgactatgactatagtcgttaccattagtaaaaaatgttttgataaagtatataaataatattatattatcatctaataataatttattatttataatatatttattaatttatataataattattttaaaaattatataaatgtgatttatgattacataatattttaaacttactttacactcatattattagactttataataaagccaaatcaatataaaagaaagattaatacatgtaattatgtataatctttaggcttagctttctatgagggatcacttttggcgcagaagactattaaaataaataaatggtataccatttgaataaacaacaaaagaaaacaattatcgtagtcaaattttttgtttaagaagaatgggattatcttcataaagaaagcaacaaaaggaggattataatattttataaaaaataagacaaaaataaaagaaactgttatctcaacaaaagatatttatgttctagaaagaaaaaaacttatcgatatattttattgttaaatctatacatccttcaaaaaataaaaatataactccaacctggatgtagtattgtccgttgttatacagggaaaacactccaacctggtgccctgttgtcaaattcttgcattacgaatctcaatactatattacccatttcaaaccatctgaacacctaagtttgtcagcattcaaatgcacaatccatagtatattattatagtctttcgtccacgcttcaataaatcagtagtctttgttttcggagaatatcataatttttttctctatgctgatgagtgatgacaaacccatatcatatctcttgaagagctaaaaggtccagagcttcagtagtgagttgacgaaatgagattaaaattgtcaagataacatgtcatgttttcttttaaggaatacctaaaataacttgaaatatacaatacagcaaagtgatacaatgaaaataggaagaaaaaaaagtgtattagtaatctgacatttggataattagttatcgaggggaattaagttactactttactctacatctctactctttattttcaattttaatataacacttaaaattgatgtcttagatcttacaaatcattcatttttataccaataaatttatctattcttatgatatatcatatttttagcatataaattagacaaaaatatttaaaataatatataattattaattttactgagaatatttttttcatatttttgtattaagaatattttctggtcgaccgtcggagattaagtcctttgagaaataaataagtattatgcctcaaatttacaaacaaatatcatatattattattatataaataaatatcgtttatacatataaaaaatacttaacaactttttttaaaatgcctcaaacccagaagatgcacccaaagcagtaccttgatcaatcttaagtattgtaagagcaatatatttgaaggttattgccaagccagaaattatatttgttttaagagttgtactatcacaaatttgaagctccgataaacactctatatatgtaaaatattgaattttatagcatttagatttatactttttattttattttaaatgataaatatcttttcttggaatgtagagtttgtataaatccgaatttaacttttttaatggtcaaaaattagtaatacgacgaatttttttaaaaatcctttcaagaaaatatgtggtgtcaatgcccggtgcaagcttaagtccccgccgtctacgagagtcttctccagtcgtcagcccggcaagataagaatgcataagatagtagtgatggactttgacttatcactactaatttccacataaattattctaattttttttattctctttttaactcaattttcatttcccttttgtaacttctttttgatttattagtgcattgttaagaatattttagaaaataggttaaaaatatttttaaaaattgaaaagcatttaaattcttaaataaatgataatcaatacattgaataataaataataaatacattttgttgaatgtttgtaaaatgattgaatatttctctttttggatcaaaactagacttgaaattcttaagtaagagtttaaggtttggggattaaaaaaatttaaaaatatgattagaaaaaaattaatttatcaaagaaaactaattattaataaaatcgagaaataatctgtattaacgttataataaatcacaaaaaattaattatcatgtatttacatctaatttgagagtttgtataaagataaaaactcagtttttattctaaccaatgatttattatgagattttgtgtaaaagataaaaactcaattttcattcaaatcaatgatttattaggaaggattaagtagttttatattgtgagtggcataagcgttttcttattaaatattttaaatacttttatttttcggtaaaagaatctaaataatacaatttaaataaaaaattacgaatatgagacttttgacaaattatttacgaatctggggcagtgggtcgcgcccaaaactgggcgtgatcggtcacgcccaattttgggcacgacccaccagatggcgacacgtgtcatgacagatggagcgatgcgtatataaatttcggacggtcataacttttgattgggatgtccaattgagatgaaaccggtggcgacgcgctcgaaattgagaggagaagccctaggcactaaagaagctaaatggtattttttccaaattatttacgaatttagggctgttaaaaaaactatttacgaatctggggcttttgacaaactatttacgaatctggggcagtgggtcgcgcccaaaactaataccagccaaaattaatactttgagggaatcagttgaaatagaaatcaaggaagcagaggccacagataaggtcagcatagtcaaaatgctgaaaactaaaactgtgagaagaggtttgtatgcaggaatgggccttcaaattttccaacagtttgtggggatcaacactgtgatgtactacagtcctaccatagttcagttagctagttttgcatccaaccgaacaacacttcttctgtcactagtcacatctggtctcaatgcatttggttctattttgagtatatacttcatacacagaacagggaggaaaaagcttgtgttgttcagtttgtgtggtgttgtgttctcccttgttgttctaaccgttgtgttccatcagagtacaactcactccccaattgttagtgcacttgaaacctctcacttcaataacacttgcccggattaccattcagctgtgaaccctggtggatgggattgcatgaagtgcctgaaggcttctccagattgtggcttttgtgcttctggagccaataaggtaaacttgtcctattattatatgaatttgtttaggtttaatgttattttgattcattttatttcttgttttgttttggtatattaagttttaaaaattttattttaattctttatattttcaaaatgtatcattttagtcatttttttaatttttcattaaaaacattaatgttatgttaagtttaaattttaagacagtttaatgtcatatttttaccgattatgttttatatttgtttcactttgagataaaatatgatatctaatttattgctttttattgattgaatgaatgtctattaaatagacttaaactaaaatagaagataaaatcacaacaactaactctatttagagaaaataaaggaatactagaaaataaaggtaacaacatagcaaatatcctataacatcttatacaattagaactatacaactatacaacaaatgcataagcgtctctaactctttgatacattatgttttaaaaatttcattctagttctttatttttcaaaatgtatcgttttgatcatttttttatttttttgttagaaactttgtgtttgtccgcgtttaaaattttagaaaagttaaattaacatagtgacaaccaaaaatcatcattgtctttttatattttaaaaattaaaaatcactaaataaataaagaaaagatagatctaaaatcacaaacaataatcacattcactctcatattattattagtataattgtcttcattcaatttaatcagttaataaagataataatattattcactaattattctcaatcacaacaggtaagggactcttctcctttagccacttcgcctctagtcgtcaacccaaaaagatgtcaacgagattatgtgttgatgttattccatttatgtggtattttattttttaccttttcatatctaaaagagattggaaatgatgataatttttttatttatttatttttttaaaataaaagaaagataataatagtttttagttgtcactaagtaaagttcattatttaaaaaaatttaatatcatttttggttcattatgttttgcagttggttcgttttggtacattaagttttaaattattcattataatcttttatgttttcaaaatgtattattttagtcatttttaaaaatttagaaattaacataacactaatatttctaatgaaatactaaaaaaagaatcaaaacgatacatttttaaaatataaaagattagaatgaaaattttaaaatttaatgtactaaaacaaaataattaccgaccataataaattaaaagtaatattaagccatttgtttattatattggcgaataagctaattagaccatgaaaatattccatcttgcaacttgttgcttgagtttaattattacaagttagtctccaatattacaaacttcgtattaactacactcactagtatcagcctaatggtagaggtttgaacagtataaatgagatcataaattctaacttctgtgtgatcattgtactctaaaaaaacttacaccaaattagtcattttctttatcacattttaactcctttgattgagaaggattaagtttaaattttggtaaattcatgaactaaactcttatattgatcaactctaggaactaagttgtttatttatccaaaaaatgatataatcttatcattgagttgtaacacttgtacaaattgtgtgcagctcttacctggggcatgtttgatctccaatgacacgacaaaagatcagtgccataaagaagatagactatggtacaccaggggatgtcctagtaaatttggatggcttgcaatagtagggcttgcactttacatcatattcttctcacctgggatgggaactgtgccatgggttgtcaactccgagatttatcccctaagatatcgaggaatatgtggaggaatggcatctacatccaattgggtctcaaatcttattgttgctcagtccttcctatcattgacacaagctattgggacctcatggacatttatgatatttatattcatcaccatagctgccattatctttgttattattttcgtgcccgaaaccaaaggacttccaatggaagaagtggagaagatgttggaaggaagagatctcaacttcaagttttggcagagaagttctcactatggagaagaagtaccaacaccgaagactcaatcaacttaagtctattgtgttgtatcatttgtaatattggagtattaactagggaagtataggtaataaaatcgtagaatgtagctattagattctaagtatatacaatacttgtttgtgtgaattttttttcttatcaacaaatattattttattagttttattagaaatatcgttcaagaaaatttgaacttctaatctttttcctccttccttcatccttctccgatcaatgagccaaaaccttatattatatcttctaccttggttgtctgaatgttacaaattgttatctgggactcttttcgaaggaccaaagagttttattttatgaaagaacagatgaaaattcatcagggaaaacaattggctactgttattacatctggcataagcaggggagataaggaaaggtgaaagctcctcaacacacagaatctgacttagtaaaaaaagataaaatcaattcggtcctaaattattttaaacagtttaatatgatctttaaattttaaaaaaattaattttatctttaaattcttaaaaatgaatcaatttgattttcaaattttttaaaaattcaatttaatccttaaattcttaaaaataatcaatttggttttcaaatttttaagaatttgagaatcaaagtgaacaatttaaaataatttgagagatcaaattgattcatttttaaaaacttgaggataaatttaatcttttaaaaatttagaaactaaattgaaccttttaaaatctatgaaccaaattaaatcattttgaagaacaaattgataattaagcataaaagaaaaaaaaaattggttactagtacaaaataagttttaatttttctataatcctctacttgtcttccctattaaatttgacatatttcccttattagattcgtgaaacattattacataaatctactgatctgaacatgatggtatttgaaaaaatacatttctctaacatcatgttgaagcagtattgaatacacacattacatattctcacctcatttctctctagaaaaaaaataaaaaataacttcctctttttgtttgttttcacggacaatctgtatgatggattgctagttttttcttctttttttccccctatttaatgccacgttcgaaccgacattccaatggttgagttattggcaaaccacaaaactacaactaacatggttgattacaacttaacttcgtgactactcgttaatattagtataatttatttgatactgatagtagaagttattatatttaggacatgctttgtaattataatgaataacaacaaaaagaaaaaggggtcatgtaacctttgacgatatatcaattttaaaacgtgtgtctaatatttcactattcaaaacattcttatgttaaaaatcttcaatccagccacatgtattaaatgcttttagaagttaaagaagtcacatgtgtcaataagtgagtaaaagattataatttatcagaagaattggaaagaagatataccaacaactcaacaagatagtcaaaagaagtaagattttttattctttttgtcaaaagaaactagatttgggagtagtatagtaggacacaggaaaacaagattcggtacccaactgcatatttggttgcgctaaaaaataattaaatattatttttggtttattatgttttaatattttttattttcgtatattaaattttaaaagttatattttgattttttatatttttcaaaattttattttcatcttttatatttttaaatgttttaaattttgattttttcttttgatttttattactaaatgttagtgttatgttaatttttaaataattaatttgaaattgcatgatttaaaatcgaaacaagattcaaagtcactaccacaacatcaaatttgaagcttttcatcatcattgagacccaatattttaaatctatattggtgttgagtcatagtatagctaaagggtgcatgatgatattgtttagtagatggatgttgtaaattgttgatgatgattgtagtgttgaggaggttgtagatatgagtaaacatggttgcataatttatgttgtggtggctatagattttgcagaagaatatgactgaggttaaaaaagtaagtggtggaatgcattttaaaaagacagttgtgctatttagctaccacaattttaaattaatttttcaaaatctaaagttaacactttttttgtaacaaatacaaacgttagaataatttcaattaactagattcaacgaatatttttaaatacaaaaagaaatacgaatataaatttaatatataatctaatatagtataatatttctttaggatatttacattatatctatatatctatctatatatagatagatatatatcgatatatatttctaatagattctaagggaattctttaaaattcttttatttaatgtttagtaaacaaatattagattttaattgattctttgaatctcgacaatcgactaaaaatttgttattatgatttcgagtaagccgctatggtgaaattggtagacacgctgctcttaggaagcagtgctagagcatctcggttcgagtccgaatagcggcatgacatcttatcttctaaaaaataggtcctataatgaactccattcttatttctannnnnnnnnnaggacaatttaataattccaaagaaaatagacatattatttcattaaaaatgatatgttttgttacattaaacaaatgacatatttaataatttcaaagaaaatattataattttttattcaatttactcttatgttaccatctattattcaatttattctcaaaaaattatataatataaatatctatatgtaagataagcatttctcaaaaaattatataatataaatatctatatgtaagataagcatgacaacaagattaattggagataggtttgactacccacgttatcatccgtgcatatatgtccaagtttaaaagagatgggttaatattttttaaaccaaatacatcctaattgagtttcatcaaatttagataaaactgtgaggaacccatcattttttttataattttaatttacttatatatttaaaaataataattttataatgataattttattttatattttttctcttaaaaatgatataattttattactatcatccattattgacaaaataacatttaatattaaaatttacatatatttttgttgtttattaatatactaacatttagtttcatttcctttctaatttgnnnnnnnnnnattcctagtatttagattttttcattatatatggtattttcaagtttagaacatatattaactcatatatcgttttcggtcgtatctattttaatttcaattcatttgataaccttattatttgtcaatgaaatcataggattatctgattcgtccaaaaaaggcatgataatcacttttttttgtataacaggattgttagttactcgttgggttttttcaggccatttaccatttagtgatttatatgaatcattaatatttctttcatggactttttccattttttatatggttccttgcttcaaaaaacctaaaaacgactatttaaatacaataataacacatactaatgtttgctaacatttttaagtgttttttgttttcactttcaaataaaacataaaataagagtgaaaatatgtatagaatttagaaaatattttatctaaaaatattttcaaaagtataccaaaaattaaaaataacaaatcaacattttcaaccttttctaaagaagtgaacacatgatgataccttagagtactttcttttttatacatgttttttaaatcttgaaaatttgaaaatgaaaattattttcaaaaattaaaaatagaaaatgaaaataaaaaataaaaaataaacactcaaatgaagcgtcatctaggtaaatgatcaaaaattgaaatgaaattttcaaaaacataagagactaaaataaaacttttgaaaacataaaaatcaaaatgaaacaacactaaaatataatggaccaaaataaatcttttaaaatttaatgtatcaaaatgaaataatattaaaatataatagaccaaaaataacatttaacattaaaaaatacattatatgtaaattcaatttgcaccaatgtataagttttaaaaattaaaccaatgatcaatccaaccaaaatattaaatcattagattaatggtcaaattagtaagtctgtattaaaaaaaattaaaaatttccgacaatgaagattgttttgacagagttgtccaaccacttaaccagggtcacacggttcctaccgattcgatagcatgttcgatccaaagaaaactcggctcagttatccctcctattctcgtttcgaccagctaggccgatcctattttaaaactatgcgcaccaaaacgtgaggtcatggacgaaattatggttcaaagatattaaaatgctttgcacacggtggtgatataactaggaatctttatttaaattttattcgcaataataaaaaataaagtaaattgaagattaataaagcattccaatcgtttagttagtagtggaggaaaaatgcatacaataagaataataagcattgaaaaacattgagtcttcaattatatgattctactccagatagtcctctaccacatttcattctgctttgaatatggctataaaatagaggtttatattgacatgtctgtacttgattattctctttcattaacttaatgatatttcaaatcaattaaatttgtcactttgtcaccttaaggcagaattagtgtttggctttattatgatatatcactgatctgtgaatcgtattatgatgaattatccaaagttacctctgtgatgagaccccagtatcattcagaaagaaacagaaaagaataataaagtcaaaagtattgttcacttgaaagaatcatttccgaaattgaactttgtctcttattcaaaacaatggtataatgcttttcaccctatactcactcccgtgaacacattaccaaaatggatcgtttaggatgccaattcatgcatagaaaattcaaactttaatagttcgagccacctaccaaataattagaagaaaagagaatatagctcacggcttgaagctcacctatacacacacacacacacacacgttatatatatatatatatatatatatatatatatatatatatatatatatatatatatatantgatgagtactcacctacatatatgcctgcaaccaataacaacactctatgctcaaaacaaagatcctctcttttattgttttttatttatctattctttaaaggataatatataaattaaaaatataattaatatcttatttaatattaattttttaaaaaactcaattataatatactgatagagtaaatatttagtaaaaaataaaagtgtatagaatattttaaaaataaactagagataaaggtatataacaatatagaaagataataattaatatttctctttatatacaatttagaatagttaatagtgttttttgttgttattctttaccgatagcatttttaattatttttctttgacaagagtattatttttagatatttttcttatcctgttaactcttttaatatatcatttttaatatttttaattataacatgaatttcaatattttaaggctgactttttaagaggaccttacgacatcaatttccttatagtaaggttgatttgaaaaaaaatatataataccttaagaaatcaattcgtgatatatgaacagtaaattatatcacgtatgtaaataattgttaacctgtattatcatttaggtaagtttttattttatttgtattatttgggtcaaaaattcgcctatacgtcttccgtttggactgcattgatcatcgttttcgcattaaataacaatttattgcgttttgataaagctggatatcactttccttgatttgattcttcttcttctttcttgctcgatatatatcatctatatcagagtaaggacaaagggaatcaacctagatgggggactgggggagtacctagacccatatatagtttttgttagggtattattcaaagtccagatcatgtttgttctttgcctaaaaatttcacccacttcacagttttacaatcaaacaaaaattttactttttggagcccaatggtttaatagggggtttgcaataataggtccattagggctataactcccactgtaccatctctgtctcctcttccatatcttactaattttcagaccattatttatctgtcttttaggcatagtcacagttttttctttaaaaaaatgaaaaatgctaaccaatgttctatataagaatacgggttaaagaagtgaaagtaaaaaaatatatattgagatttgtaaaaatacgttttcttatgatatttaaattaatgtactcttgtatgcacacacacacacaaattaaactaaaaattgaaaatctattttaaaaaattcaaaatatatttgttattgtattttttgtttttgaatcttgtgtgtcaatttgataaggtttaatttcttcgattaataactaactgtcacaaattaatctacaactcaccttactataatattatagattagtacatggtgtaactttcccagctgcaaactaaagaaacaactaaaaaaactttaggcaatataataaagaaatacttttgatattttaaaataatagtaaaatagttatttactagttctcttagagtttaaattaatgattacaagttaaaccctagccaagtttaggaaattacaaaaatatctttaatatatagaagaaaaaaaaaggacgtaagataatgttttgtgaaagaaattgaaaccaaatataaaataacaattttagagaattgaagcaaaacagatcgatcttaattttagttgataaaccatctcaagttaagatcaaaataatcaaatatgaatggtcatattttgaatgtaaaacatctcaaataaatacaaagaattttaattacttggatgtagtttataaaaatgagaacatatgcttttttccctacttttttttttttttttgcaaaatattcacttttaatcactaaacagnnnnnnctcttcaatgtctctataaaaaagctaaaattaaaggagtgtacataatacatggccctctatttctcctttctttcctcttcaactcccaaggattatacatacttttccattagcctcacagtggaaacactccatggttcttaatgcttttctgaccaagtgcttctcgttggcctttgttaacccactaaaaggacatacataattgtaagtgtaataattatatatatgcaaatagttgtaatattgctattatttcacttatatgatcatgcatgaaagggaccaaactctatctaaggggcacaacacatggaggagcaaaaccttcggaataagcatacaatgcattcttcaaaccaccggagacgtcgcgaaattgtggccactatgggaacacatgtttccctctctgaatgtggctggcacagtacaaatatatatatatatagcaccaccgcattactttctgtcagtattgtatcacactatcagtaaataaattgtccttgcgatacatcttatcattttgttaacaaaaattattagaggatatatttcttcaatgttggagttttgtagattaacattgtttaattatttgattaatttttcaattattaatattaattatgtaaataaaaatatataacatatcaattaatgaatattagctagttatttggtcttattatatatgtgagcatgcttatatatcatgggttggaccatcgagttaatgctctcgtttagtgtttgtaaaattgttatttcattagataattttagtgtgacacaacattttgcatgtgtgaaaaacttagctgctagttagagagtagtatttcctcatttggtgattcaattgagctaatagaagatgaatttcatcttcacttaaggtactttaactaaattgttattatttgtcgtgagcatgctagaatatcatttgttattaatttgtcatcattttttaattgtactagtttatatgataaaaaaaagaatgaacttagctctgcaagcattaactgtcaggaggaattttaggtctctagcttgtagctacatagcaaataaaaataagattagaatagtttttttcctctattttatttttaacttttgatttggtattttattttttattggatttagtttgattctctaattttaaaaattagttttctttattcttctaattttttataggttcaacatgattctctaatttttaaaattgattctactatctaaattaattgaatgatcatattatttaaatttcatcctatcatctaattggatattttgtgactatttaaacagtcataaaatataattttttaacacagttaatccattttagatgataagatcgaattgaatgattttaaaaattaaaagatcaaattgatcccaaagaaattataaaactatattaaatctaaaaaataaattaatttaatctaaacataacaagatattgttaacctgcaattccctcatggttagtttcataaaaactgcaggttagatgcataaatattaaatacaagtggggcgcactacacagaagcaaatacgttataatatactataccctagcttagaaatacctacgtacaagaaatggtatatagcaaactaacagcttaataatactgttcctacttattaataacaaaccaaacagcagttacaactaataacaaacagaaatatttgaatttgaaaataatataaaaacataacacagaataactataacagcagtgcgctatcttagctgatcctaacaacccttatcactccaagaacgaaaaactaaatttgcatgatttatattataccctagcttgtatcttctaatttacttctgttttctgatttctcacgttctttgttcctttcctctttttcaaccttaatttactgcgtaattacatttttattagtcacgtgtctctgagaggacgatgttaagaaatttttagccaacatgagtcttctccaagaatttggtcctaagaaatgggatcttcctcctgcggccgttatgagttgttgagtgctacctacgtgacctgaatatattttcagtgaattttcaaatatcattatagggtgataaaattttcctggaaatacctatagctaggccagttatttcttaacttaaaatccgagaaaggaaaaactaaaaccaaattttaaaaaatgaaattcacggaccgaccgtggtaaatttgtaatttgcaaaagtgcatctaatcaattaatgctcgcgaaagaactactgttaatttctctttcgaacatgggaaacaccatcttaaattaattattacttgaacttgaagttatgaatcttgtgcacgacaacctattcaccggagtattggataagaatggagaaatatagacaaattaatctacatgagggatacaaataggagggagaaccccgcaagtatacatatattccttaaagagaaaagagaataaagaggttcataaatgataagaaaacaatataaagtggtcatacttcatatatatatatataataataataataataaaatagagtttgtaagtaaataggtcgcatttaaaaagcttgcataacattatatatttttcaaaatatttttaaaattttgttaatctatgtgtaaaaaattatccaacagtagtatattgtagtatagaactttagttgatctggaattaaaaaaaaaaaatgcatatgggagtcatattataattaagaatgttcaaacttagagtattaccgctagttttatataaaaaataaacagaatataatattcttttgttttagttatatgaaatagacttattttctaatnnnnnnnnnnatatttttcaaaatattttttttgcatataataaaattttattaatctatgtgtaaaaaattatccaacagtatataatagtatagaactttaattgatctggaatttaaaaaaaatgcgtatgagagtcatattataattaagaatgttcaaacttagagtattacctctagttttatacaaaaaataaacagaatataatattcttttgttttagttatatgaaatagacttattttctaattgttatgaagtatgctcaagatacactcacacatttttatataagtggatgtcgttttgtttaaattaaattttagtgaattttttttatttgtaacaattttgacatttcaaaactcatcatattcaatagcagaaaaaattatttaataaattaggaataatataattacatatagtccttagttaaaatatttaattctctgagtatttttaaaataaaatatgttataattaaaattaactaatttgactattttatatgttaatattcatatatgggttttgatgaatctgttatttatttcttatataatggatgaaagatagtatatttctcactaaaaaaaagtgtaacactgactcctagtaaattcggcatcattgtttggataagaaaagggtatgtaacattgactcgtgatacaattcaatttataattttgaaagcttgatacgaacctcttaatatgagaaaataggtatttactcgtttatcattatatgcaaaacaaccaaattgtagttatccacttttctatagcatacaacaaaaagtatcgtcattattgaatggtgccccttacaagatcctttcgaacaggaaaaattgggccaaagccaaagaaattcgctctcccttttctttttcccgtctttctctttaatgaatacattcgctctcttttgtaaaggcgttaacttatgaggcaaagaacttgtgatgaaccttcttatggacctaaagttcttaatggtcacacacaatcaaccccacaactttgcaccaagctttatggaaataatacaagcctttacctcattcctctaccactaatgtagcactttcttgtcttcattgtcataaaactttgcctgcgttcttagcacttcgccatgaggtctctttcttgccctatcaattcttcatgtgaaaaaattcaagacattcccttatccttctatttttattaaccaaaaccatcaaagatgattggttgctgtcattttcttttcgtctttacctagtatatagttaaaaatgtagaagacaagtcgatttttttgctacaacgaaaccaacacacgtggttaattaatttcttgtcattttgatatgacaaattacaggatatatatagtgaaaattgtacgtatgtatgtaacaactgaacaatcaattaacagtgtgtattagaaatccacttagtccaataagtaacaactgaaaatagacaatcaacagcataaatatataaaacaaatgaaccaatttttttattaaaaagaaaaaaaatagttctaacccaactactttctattataactttataaaaatgaagattgtcactttgttgtcaatttgttgactttacctttaagaaagtttgaagaaatcaaattgtaccattgtccggggggtctacatggagagcaatgtgagcaattacggtgataacttagactttggagttactacgagtctaaaaaaattatatataattcgacaatatttttatattatttttataaataaattagaatcattgtctcctttcatatctcatttttcatatatcttatattaaaatatgacgcgtgattaaaaagtactactctttaagttgttagtttcttttatgtattattactacattttataaactatacgttaaatgaatttatagcttattatgacatcaaaatataagaaacctatgataatgagcaaatttaaagtgtttattttttttttccaacaagatgagaaataaaaactaaaactcaaactataaaaaaattactcaatatgttataaattaaaatttcaaacttggataataaagctttcactctcctctcctatcaactagagattttcaacattctatcttccctttataatatgtgtattttctttttaaaagtttataatatgtgtatgttacgtacgcactttcattacaactacgcagaaaatatatcccagtcatctcagattccctccatttatctttttattacgtatatttgactttcttaaccacatgtcgatttcaacttaaaataatcttatattacaatttatttaattgaattacttatctcaaattaaaatatagttaatatattcaagaatatttgtttattataaatattaattataaattatttataaacnnnnnnnnnnnnnnnnnnnnnnnnnnnnnnnnnnnnnnnnnnnnnnnnnnnnnnnttgttatggcagatttaaaaaaaaaaaaaaaacttcagtttaattcagcttgcacggagtgaaattagaagtcacattttagctcattcaatttcattttaaatattttattttatatttaatataaatacagttcaatatattcgatgagtaactcagctcgatgaatattgaaccgatgatgcttcagtaactcaatatccttggctcgttgccaaaatgattattgggaaagttgaacgcaatgcttcatacatacgatagacatgtaaaaaattggtttttatgtacgtgtttgatattgattttaagtatattttcacatatttgatttaaagttaaaaagaattcaaaattgattctaaatacaaaattgattttaggttgaaacaattttaaatatcatccaaaattttatattaaattttaatgctaacttaattttataatcaaaatccaaacataaatcatgttacttcaaaattaattttaatcaaaatcaattttcaaaatcaattttattgatgtttatccaaataaacacttaatgtcacaattcacaagaaatgagcttaggtaacgtgcaacaagatttccaaaaatggcacacatatatattaaatggaagaagttgagaactccttttgttgtttcggtgaagtgaacaattgcagctttcttgagcgtattacagttccggaacatcttcatttgacaatgaaattgcacaaatatttctgcccccccataatcaaatgtaaggaaaatttatttgtggatgctattgacgtaatcgtgagttccagttcttcattgattgcgacgtgacacaaatcaagcatatcaattctactgttgtaattatggttttaaaaacaggatcgaagtgatcagtttgatcgaaatcaatctaatgatattaaatcttaaaaaataataaatccataattggttaattgaatgttaataactaatatctcattatactaagattcatttaaggactaatatttattaatgcatatttccctctaaatgaagactcaaattataataattcggtgtatattatgaaaggacaattctttgtgctaaattcttaaatataacttataactactttataacttataattcttttttatttatatcttcattaatttacttgaaattccttttttacttttttttattattttagaaatcctttttaccgatagtcatagagaaaaatcatcaaatcttttttataaaatataaattttgaataatattactatcctaataatttttaaaatgacatgctattataaataaatttaaggctaaaatagaatttcggtaccttatttatattctaagtttcaatttagtatcttatgtttaaaaattttactttcatctcttatagtatttctatcagaacaaatgtcattttgttagttttttttactaacagtatcaaatttaactagtgtgtaatttctcatagtttggtaagtgtcaccaaattgatcaaattagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggacaatttaataattccaaagaaaatagacatattatttcattaaaaatgatatgttttgttacattaaacaaatgacatatttaataatttcaaagaaaatattataattttttattcaatttactcttatgttaccatctattattcaatttattctcaaaaaattatataatataaatatctatatgtaagataagcatttctcaaaaaattatataatataaatatctatatgtaagataagcatgacaacaagattaattggagataggtttgactacccacgttatcatccgtgcatatatgtccaagtttaaaagagatgggttaatattttttaaaccaaatacatcctaattgagtttcatcaaatttagataaaactgtgaggaacccatcattttttttataattttaatttacttatatatttaaaaataataattttataatgataattttattttatattttttctcttaaaaatgatataattttattactatcatccattattgacaaaataacatttaatattaaaatttacatatatttttgttgtttattaatatactaacatttagtttcatttcctttctaatttgagtttttggttatgtttcttcttttgttaattttttttaaatctgtttttaaagaatatttttaatctattgttatatatctaatacatgtttataagttgaaaagacactcagtatggtctgatgaagataatacataataaaaactaacaaccagtatgataatacctattaatcatatgtcatatcttaatttgaacaaaaagatatatgtaaaataaaataataacttcaatctagttattaaaataacatcaaataatattgaaaaattattatacaaccattttaaaaaaaatttaaggtcttttttagtcattgatcttgtgtcgtcacacctccaaatagggcccaagatcggcattggacccaatttgatgtagatgacattcttcaacatattcatcgatatctcatgagataaaccttagagttggcaacccatggcacatttcccatcctaggcgagaagataatataacatagaatgcacatgaatttgtcaatgtccaatagttttaaaaaccctttgcaattaatgaaagactaaatgataggagcaggagctaatcaaagcaaaaaggtttttcaaagctaaatcatggaagataaattcaacaaacttatatggtcaagatgtagctatggattggagtttatttgaatgaattactaagatagtgtttaatttatgtgttttctattttcatttttaaagaaaataaaaaataagagtgaaaatatgtttgcttgaatatattttcaaaaacatatccaaaactaaaaacaacaaatcaatcttttctaatgaagtgaaaatgcgatagcaccttagagtattttcttcttgatacatattttctaaatcttaaaaatttgaaaaggaaaattatttttagaaaataaaaaagaaaataaacattcaaaccaagcatcacctaagttttttggactaaagaatcaattaaggcttattttctaattttacatgaattttcatattnnnnnnnnnntttagaaaataaaaaagaaaataaacattcaaaccaagcatcaccttagttttttggactaaagaatcaattaaggcttattttctaattttacatgaattttcatatttaattttgatgtaataagtttagacgacttttaagatgtttttggccaacttttatgaattttaggcttcctaatcaattatgaaggttagtgagaagtaaatgcttagtgaaaatgcatttcctaatgggaagtaaagatttagtggactcttagtggaaatcaatttttcctagtaagaattaattatttagtggaaatgtgaaatttttagagagaaatttaacctataaatagagattattttataactatgaaacaagttgagttggaataaaatctgaatttttttcctttaattaattttaattgtattaacaaaatttatgatgatcaaacatatgactttcatttttttttctctctttatgtggcgccaatatccttcctttaaaaaaactaaaattaattcctaaatccaaagtctttaaaggcaatctatgttgtttccatgtttgtggaagctcttttttgcaagtcatccaaatttacaaggtgacattgagttagttaataggatgagggttgcccccacttatatataatatcgtaccattatttatagacgatgtaggacttagatttcttccaatatacccctcacatctaacaatttttttagcttggtgcgtggataaaatagtgagtaatcctttaataaattaggataaactttgatattatcttagaatgtagattttggtctaacttaatcccaaaagataattcataagatggtgattgtctcctagatatgtatataatttaccttgattttatctctatttaatatgatacttgaatttttttaatatgtcttctcacttccaacataagatatataagtagggataaccataaccttatgaactaatttttgaaattaaattaaacctcaacttacattctaagaacataaactataaattaaccaaaaaaacttatataaactaaaataaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgtaataacaattttggtggatatcatattcctttaatcgaagatgatattaaatttttatggcatacatattgatgaatacaaaaattaaattaaaagaagatgatattagaattgtcttgcactttttatcccatattttattttattttattagaattgtcttgcatatattttgttgtatatatattcatcaaaatctataaggacaattttaataaaaatttaaaaaatgtgagtaaattaattaaagtattgatgaattttttttgtgtgttcttttttgggaattgaacccagtccattatggactaattgtaaaacaattaccgtacaaaatatgtattttttaaaaagatataatgtgatatttttaaaatatttttctaatatcacataatgatccacaactttaacctatgattattaatttgtttctcatctttgttgcgtaaataactaattattattttttagcctttttgttaattcattttattctttatttttctattcaagaggttttccatttaacttttgcacaatcagttttaaggtagttgtttgtaacgagtattgtagagtaccaatacccttctatatacataaatacattaatcaacttccaaataaaaattttggtttcctaataaataaacaaagacattttttttaaaaaaatatgattttttatgaatatttaattttatttttaattttttattcctttcaaatattttttattttattttgactaataactagtccagagattttctttatctagcgtttgaagtctagattgtaaatagagaaatttatttgagaaaagtaatttattatggaatttaaaattatttaatttaaaatttattttttggatatttttatacgaggaatttaaattttgaaattttaaaatataattttaaataactaaaaatataaaatttaaatttccttcaaaaaaataagaaattgaaattctcttattctctaaaaattctaactgcatcactttttgcttcatttcaatcttaaaagaatactccggccttcgacctccaacctcctgttactctcacagcactcatctcacctgtgcatgagattcaaaattttaaaaattaagaaatttaattttttttatctaaatacaaaattttgaaaatgaaaaaatttaattttttaataaaatataaaattttgaaaataaaagaattttaattaatatattttaatttttctgaattttaaatttattaaaattttaaaatattccatccaaaagcaaaatgattttagttatatttataatagaaacatattcgtgttagatctaaattgcagttaaaaaaagttagatctaaattatttccttattagtaattagcacggagagttataggcttatagcagatagtagctgtgtcagtcctccacgggatatgatcaagcagttagcaggagatgctagtctcttgaggctgtagttgactagttaatgtatttacagaataagaaaggtaaagaattatattctaattggattatgaattattatatatcataaatttatgaattttttataatattataaaactataatagttatatagtttatgagtttaaattgaattcaaatttgtgttaaaaatgttaagtttaaatttgagtccatcttaattaagttggacaaaatgtaaacaatttttgcacaaaagatatatacttctttgtgtcaaaataagtgtatttgaaaaaaaatcaaaacaaatgatgcatgtcactttttaatataattttatttatttacaaatatatattaatgagtgtttataaaaaaacaaatactattttgtgtcagaataatcattgtgttggaaaaaattattattttaattaatcttatgaaataaaatattatatttttttattttcaacaggtagattcgtcaatggactgacaaaacatattgtcattcctaattataagcaataaaaataaaaaaataattaatgtcatattggaaagttaaaataataattttttcatcttaattataagagatatattaataaaaaatgagttaatgatcataacgttaattttgttatattattatttttttcatctatttattaaattttttatttgtgtaaaacaatataatgagatgaagtattaaataaatgcttataaaaatcattaataggcgctatataaataatagtcaataaatcaatgaatattcattatattaaaataaaatatataatttttattgaagcattaattactattattaataaatgaatgaatatatttattatttattgtagtaaaaataaaaatatttaatactacatcgaaaaaagaacaccattaaatgaaattgattgttatttgttaacactttatcgtgtagcgagtgaagtgcgggcgcggcggggactgactaacgtctaacgtcgaaaccgtggtttcccactataaatttggcacctccttagtccttagtccttactcatttccatacttcctctcattttctcacccttttcttttttttctttcttcctctttctcttctctgttcataacaacgactattgttatttgtatatggaaggagcagtacctgaggctgatgtctctgccttcagagaatgcctctccctctcatggaagaatccctatgtccttcgcctcgctttctctgcaggaatcggtggccttctttttggctatgacaccggtaaatcaaatcaaaccattcaattcttttttttatctatcggattaattaggtttagcagaaggaattattttctcgccatccgacaaccactgatgtttaaatctcaaagagaataggtgtcaatattttaatattcaactgtgtctcaaacaaaattgacttttgtcaccaaaagacaatacttttgagaaaacgccatttttttttcatttctatgttttgctcttatttgtgtgtgtatttggcgattgattggtgggtgtgtatttttgcaggggtgatatctggagctcttttgtatataagggatgatttcaccgctgtagagaggaagacctggcttcaggtaaattaatgcatgcttatcactcctaataactcccaagagtagaaaaaatgaaacctttgtccttcatacaattaaattattaattattttcccactcctttctttaatgaaattttatctcctcgtacattgttttcagttacaacttcacaggttgcacgcaaaaataaacgcatggttttgtgcattcatactactttgtagacgatcatcttgagcaaaatttgcatgcttttagtggataagactttgtgaaatatctccgaattaagagaagaaaaaaggaaggcattaagaggtcctcctgcctttcattcatatagctaacttttaaacccgattatataaatttatttatttttactatctcgatcatatagctatcttttcaacaaaagtatttatcttatcttaatttcttatgaattattgtaaagatttgaggtatttacaccattactcttttacgaaaaagtttaattttttatttaccctttttctgatgccagtcatgaattttgtttgatcgtctattaaattggcgaatattggattagtttctcttcttcatttttgttcggtcgtcacgataaatgcgttattgaaacttttagttggtaattaattatgtcatgtgaccctctcacttttttattttattttgagattctgttttatttaataattatttggacttaatatatctcaagatccggtttgatctgtttcaatttaaatattttcatttttatttgtttttacgtttttacacatgtctttttgtttgtttgttattctcttctttttcggatttgaaaacagcccacaaaaattgacaaatgttttttttcttccaaaccatgacatattctcaaactgcatcatcatcaatcaattcataaaaaagcaaaggcagcaacttagcatataaaatagatgggacccagtgatcactgaaagtaaacaagaaacattaatgttaaaaccaaaaggtgttgataaattatttcttaaattgaaaatattacttttatctaaaaatagacggacttggtgagaagaatattgcacctcctggttataaaaagtaaattaatgttaaaaatttgcaattttattttggaaagaataattgtccaattaatgatttagatctcatgttttttcatataaagaaattatttattgttatatttgagaagaaggtttttntcaaataaatcttaaaattattagggacaacgttttaccttattttacaaaaagatagtttcttaaaaaaataaaacttttattttcagtacactacagtgtgatgaattaaattttattccttaaactatacggtaagtgcacgcgtcactaaaatcttaaaattatgaaaaggttaaacaaaagaagaaaatacgagagaaataagagagaaggaaaaaattctctttaataggaaaaaagcctcaccactttttcttttctcactttaggagaaacagggttgagaagaataatgttttacgtttttcttagaattcctttgcctgcattttcaattcattattattaaaaaggcataatttttttactcaagagaatctctcttttttccgcagatttttttcaccactttcttttacgaagattattttttatttcaaacgaaacaaattatataaggatttggttcttctaaaatgtgctataatgctaaattaactggtaatattttgataaacgatacgtcagataaactcctaaggtggttaaaattagattttagtcaatggttcctataattaattatcatggatataatacagaacatttttccctccatgttctgagtttaaagcacaagttcctcaaattatcatgtgttaacgaactacttgtagaaatttgtgaaaccgtgcagggttttctttcaatgttgatttgaaatataagcatttatgttcatattgtgcaagtcaaattgttatggcttgattttgacacaacttgtgttcaaatgaaagatcttttatttaataaaatgtgtactgtgttgtgcctttaaaaaatttcaggaagctatagtgagtacagcaattgcaggagcaatagtaggtgctgcagtgggtggatggatgaacgatcgatttggaagaagaacatcaatccttgtagctgatatcctctttttaattgggtcagttataatggctgctgcacctggccctgctgtcctcctcctgggtcgagtatttgttggccttggtgttggaatggcttcaatggcatctcctttgtatatttctgaggcttcccctaccaaagttcggggagcccttgtagctctcaacagtttcctcatcaccggtggacaatttctctcctacctcatcaacttggctttcactaaggtcagcacaatcttctcttttactttgtgtccataaaagatactatattgcaaatggaattggcatggcttattaagtatgtgctcaggttcgtatgtactgatggatctaagatctgaggtcaatcagagtaaactattttaaaaaataaatctaatatataaaaatgaaaaatgatttaaacacataaaaataagagatcttaaatatgaaattttaaaataaataaatataattttattaaaaatagagaacaacagtgaaaaaacaaaatagtaaagagaaataaagaaagtgtttgagagagagaaaaatggacctcattacatctgtaattgatacttggtaaaacaaattggtggctggatagttttaataatatattgataaggggtgtatttgtttattctcaataataataagaagtttaataataagaagttaggagatccaaatacacaaaattaagaatataaaatataaaattttaagaaaaaaacatgaatttattaaaatgagggatgcatttatccacactctaacaagcataggtccgccactgtatatctggctatcggctaggataccttaggcaaaaaaaattggaatttgcattacaaatttgcaatccatgcttgtgtgttgttgaatttcattataaaaggcattgttttcttgtgagatggtcatagaaatttgttaatttttatttattcaggcgccgggtacatggaggtggatgcttggagtggctgcggcacctgctatagtacaaatggtgttaatgttcacgctcccagaatcgccacgttggctgttccgaaaggtaattcatgatacatcttacatttgttgttatctttgtaagaattagacctttatgtgtttataaaatctgtctttctattatgtaacagggaaaggaggaggaagcaaaagcaatattaaggaaaatttatccacccagtgatgttgacgaagaaatccaagctttgcatgattcagttgctatggaactgaagcaggcagaatcctcagaaaaaatcagcataatcaaactgttgaaaactaaggcagtgaggagaggtttggtggcaggaatgggccttcaaatcttccagcaattcacgggcatcaacactgtcatgtactacagtcccacaattgttcagttagctggtgttgcatccaaccagacggcaatgctcctctccctgatcacttctgggcttaacgcgttcggttcgatcttgagcatatacttcattgacaaaactgggagaaagaaacttgctttgtttagtttgtgtggctgtgttgtagccttgacccttttaacattcactttccgccaaaccgaaactcattctccaatgattagcgcagttgagaccgctcatttcaacaacacctgccctggtttcagccacgctgtgaatgctaatgaatgggattgcatgaagtgtctaaaggcagaatgtggtttttgtgcatccggcgtctctagcaaggtaagtcaaatacaatgtttcgataataaaggaatttaggtcagttgattgagtgtgtgagttgttgtattcctgatacttatctttgattattagagataaataaaaaaatgaatttctccatgcacagtagtaattattgaattcattgatatgcttgttcttacattagtgtccattacatgtgcatgcagcgcttacctggggcatgtttgatttctaatgacgctacaaagggtatgtgtcagaaagaacatagagcatggtacacacaaggttgtcctagcaaaactgggtggcttgcaatagtgggacttgcactgtacatcatattcttctcaccagggatgggaactgttccatgggttgtcaattctgaaatctatcctctgaggtaccgtggagtatgtggaggaattgcttctacaacatgttgggtttcaaacctcattgtttcgcagtccttcttgactttaactgtggctattgggacagcatggacattcatgttatttgggtttgttgctctcattggcatcttattcgttctcatcttcgtgccagaaactaagggagttccaattgaagaagttgagcaaatgctggaggaaagaagtgtgcacttgaagttttgggagaagagaagtcctccccagaagggttgattaactttgaattagatctttgtctaaagaataatatttcacaccacttgactcttatccgtgatatgagataattatggtttcttctaaggttaagtagtgaagaggaatatgtttaaatgttttctagcttttgtttgtagttttttttttctctcttgagatttgctgtttttattgtagttagtgtttggctagtatgttttatgaaatcctaaaggatgaacaatgaataatatataatgatgatatattatatataacgagtgttcagtcatcatcatcattatgtgttttatttcataatgcaaaactaaccgtagcgttcaatttaggtattaacaaattgacattttccagatatcagtgaaagttctaaattttgacattttgagaattaataaataaaatagaaaaagtttaatgagtgactcttctctccatgcccttaaaatatgaacaagtgagtaaataaaatggaatttttctaaattttttaaaacaagaagatgttgagaaatcgggttggctatgtaacactaacacccaacctaattaactaatctagcttcaacactaacactaatatgtacacactttaaaataaatttccccgattactattttatgaattgccgaatggtatacagatatactactatatgtttgtccaaaacaattttcacaaccgtaatgaaaataaatttcccccattatagcttcacaaaacattccatattagagtggagcaattcttacttggtcacaatgtgtttgtcttctcttcttcttcttctcctaaattcactctgattcgctgcccttgctttcactttccaaggacttcttacacgtgttggtggagtccattttccacatatggctctgtgcattgaagcagtaacaactataaacgaccccgctttgatcagattgaacaaaacgagacaaaagcatcaagtatggagggatgagtccctgaagctgatggctctgctttcaaagagtttctttctctttcaaagaacaacccttatgtcttcgccttgctttttctgctggaatgggaggccttctctttggctatgacactagtaatactacaaagtatatcatcatatcataatggtttatgtctctttgctaattatttttactttctaacttattgagacgatacccatttcactactcatgtgtccgttttggaagaaaaataacaatcctttatgcagatgcactcttctttgctggttctatcatcatggctgttgctcctaactcggccgttctcgtctttggtcgagttttcgtaggccttggtgttggaatggcatcaatgatatcccccctttacatttcagaggcttctccaactagagttcgaggagcccttgtaagtctcaatagtttcctcatcactgggggacaattcctttcctaccttgtcaacttgggcttcaccagggtaagaacctatgctatacttgttcaacagcttttctttctactattttgatgtacattcacataaaaaatgccttaggacaatgtttaaactttatactatatacttcacatgttttgtacattagacagatgctaaccaatattcttagaaaaatgattaaagaattgaaaatagaaatatttttattggaatgtgtaaaattgtgttgttcattatcttttttgtactttcttatgattttttcattttttttcttttaattccttaaccaatatcttaataatcaggtgaaaggaattttttagcaagaccatttacattatctaatttattaatctaatccaggattttattcgtgagataattgatgatatgctaacagaatttgtggtaccattttcttttttcaggggaaaggaacatggaggtggatattaggaatagcagcaatacctgctgcactacaacttatgctatttcttccagaatcaccccgttggctattccgaaaggtcagtgatttaaacaaaccctaaatacagtataaaaagtactatgcaactgctattagtactattatccaatcaaaattggtaattcatttcagtaattgctgtcaattttagccaccaaaataaaagcaatttgaagtgtggattttgattggagagcaaaaaaccaacagaacgcatgattatatatatatatatatatatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgcatgattatatatatatatatatatatatatatatatatatatatatatatatatatagattagttttgtcatagtggtcatccaccataatcatttctaagatacacactattagtggtatttcttttctttttaattatttcaacgtgtaaaagggaaagtaagaagaaggtatacaagttgaggaagatttacccagaaggggaagttgaggctgagattcaaaatttgagggaatcaactgaaatggaaattaaggaagtagaagctggtggaggttgggtgagccttgtaaaaatgcttaaaatcacaagtgtgaggagaggtttatattctgggatgggcatagtcattttccaacagtttgtgggtatcatcacagtcatgtactacagccccactatagttcagttagcgattttgcctctaatcaggtagcaacgcttctgtcactcatccattgttcttcttactgtcgttttccaccagaccaagatttcctccccattgattgacccaactgaaacaactcacttcaatggcacttgctctggttgcactgcagctaactaccgtgatcaatgggattgcaagacttccttaaaggttctaaaaaatgtggcttctatgctgcctgggataaggtgaataaaagaatgttaatcattattaaacatttcaataatcctgtaacattattaatcacttctgaaacatatttataagcattagtgccgcaagtacatatttataatccatggaaatcgaagagacagtgaggagtttacagcaactcacgcacgcacctttctcaaccaactaatctagatctctttgacatttattttctcttagtccagaataaaaaaaattactcttaatcacttgtgaggtaaaattgaccaatagtaaacatttcaattacttcacaacactgttagtatcagtatacaaccacatttatttgactgtgaagtaaaattaaccacatttaccgagaggtggagaattcacagctatacaaatttcattacttgataaaaaaaaatggtttttcatatcattttttaaatattagaaaatgttaatgatattgattcatgttggttcttactctggtatcaactgttccacagctaaaacctggtgcatgttgggactacgacaacaactaggagaatcattgtacttcacaacacagggattagtattccgaaggatgtcctagcaaaactggatttgttgcaatagttgaaataataggcctagcactctacatcttgttcttctcacctggaatgggaactgttccatatgttatcaactatgagatataccctttgaggtttagaggagtatgtggaggaatggcatccacagcagtttgggtgtctaaccttattgtttcccagtccttcttatccgtaactgaagctatttagactgcatacacattcatggttttttgaataattagtttagtagccatcatctttgtccttgttttcgtgccagaaaccaagggagttccaatggaggatatagagagggttctggaaaaaagatctctccacttgaagttttggcagaaatctacctcgtgatcaactcttttggtcctgaattagctggttttttccatatatattagtccttttctttattactaattttcatcttcgtttgcgtctcttatttttgcatcacatgaatgttacatcattttgtaatataatccattaatttatgcagatataaatataaatggggtgtacgtgaactaatagaatatgaaatattcatttctcttttcgcataggagcattgtttgaacttcaacaatgacagtgttcatgagataacaattagtttatattattttttattttatttataagaaataatttagagtgtaaaaataatgtatttttttataatttaatttaattttataaatagaatcaagataataatatattttacatgtagaagtttatttatttgtaatacattctttgtttaaggaaaaaagttatataggactggtgtagataaaaacggtttcattattgttttggtacttttcttattttttcaaaattaaaaggagataatattttagtactcaagattaggggtgaaaatctgatatgtcatgttagatcaggtttggttagatttgactttgacctgatttaaaaacataaaatttgacttggactaattacttgttataggttttttttttttaagtttagcctggttttttattttattttctaaattattttatattaataaaataatataaaaatgtcactaataaaagaaaaaattataaaagaagttaaatcatgttaggctaagataacgtattgtatgcttggcttggaagtcaagcatgctaggttttactacaagttcaatcgaaaactctaagcatgttaggttttactacaagttcaatcgaaaacaattgtccctagcttagcatgtttggaaccaaagcatgtgaagttttgctactaagattaaaacttgattaggaatcaagggtgtttttgtatgaagtattgttacaatcatgtcctttcatatctcggtaaatttgtagttttcttttcttaatcttccggttcaacaaggagaaaaggacattgattgatctggagttcaattaggagataaataaagtctgtataaaatttgtttctgggtactacacaaatgattcgatcttaacttcaacgcattaattatttgtacccaatcacttggttaaactagtgaatttgaagtaatgaaacacatgccatatagatgtaattgttggaccttagtcctatataggattgagtatactggcgagccagacacatttaaggctgctgacaaattgaacaaactctatgcgaattaaatggacttaaatttttggtttgcgttcatctcttgtagccaatagttaaataggatgacccacatgccttagctaaaattgtgagaactcatatcatagatagttgaaatatagtgattgagagtaacattacattgatgcagatcaagagctagtaataatcataatgtaattaaaattaaaaaggacatttttaacgataaaattcacatttcaatgttattttaagaaatctgcacttaaggtgaatctaataaagtttcttaatctcattctgagagtgatattcttaagctccttgtcaatctatgaaacttactacttgttttcaatatttgcttcctcaaatacatggtgaacaattagataaaaatataatctacaaatcaaagactactaaacttaagatgaatttaaaaattacttgaaaagaagtgaatgttctttttactaaaaaagacatgtggcaatctcagaaaataaagttttatcaaaattcaaattaaaactaaaatatgttttattttttgaattttaaaaatgtggttcaattaaactaaaaggtaaaattatctgaagaaatttttaaaattgaaagttttttcattatttatagatttaaatatttttttttatctcttgtaatatatcacttttttttatatatttcagtccttataaaatttatttatttcttttaatttgttccttggttttttgtttctttccttaaaatatgttattttttatttctatttttataatatattaataatttgttttagtctttataatttttaaaaaaattcaaaatagacaaaatattattaggatgaccaaaataaaataaataaattttacaaaaatcattttttttaaaacttcacataaaaagtactagtaaattataagaactgaaaatatattttagatatatttatattataataaaaaaattagaataaacaaaaaagtgtgagaaaaaaaagtttagtctaatgtcagtttgaggtttatttctgatctcttaaaccctattgtcttaattggctgctacatacatcactccctccgctctctctcccaatcccatggctctgctttccaattccaagcttctccgatggagactctctctccatccaaaccctatgtccgccttctccaccgtcgaagctctctccgaccacgaccagcctcctcacccctccccgcagccccaacccccacccattgttccccctcgcgagcacaatctcgaactcaccatctgcaagatgatgtccaaccgtgcgtggaccacgcgcctccaaaactggatccgctccctcgtccctgagttcgacccttccctcgtctacaacgtcctccacggcgccgcctcgccggagcacgcgctccagttctatcgctgggtcgagcgcgccggcctcttcacccacaccccggaaaccaccctcaagatcgtccaaatcctcggccgatactccaagctcaaccacgcgcgctgtatcctcttcgacgacacgcgcggcggcgtctcacgcgctgccgtcaccgaggacgcctttgtctccctcatcgacagctatggccgcgccgggatcgtccaggagtccgtcaaactttttaagaaaatgaaggagctcggcgtggaccgcaccgtgaaatcctacgacgcgctcttcaaggtcattctccgccgcggacgctacatgatggcgaagaggtactacaatgccatgcttcgcgagggcgtggagcccacgcgccatacttttaatattctgctttggggtatgtttttgtcgttgagaatagacaccgctgttaggttttacgaggatatgaagagtaggggtattttgcctgatgttgtgacttataacactttgattaatgggtattttcggtttaagaaagtggatgaggctgagaagttgtttgtggagatgaaggggagggatattgttcctaatgtgattagtttcaccaccatgttgaaggggtatgttgcggcagggcggattgatgatgctttgaaggttttcgaggagatgaagggctgtggggttaagccgaatgtggtgactttctccacactgttgccgcggctgtgtgacgcggagaagatggcggaggcaagggatgtgttgggggagatggtggagaggtacattgcgccaaaggataatgctgtgtttatgaagttgatgagttgtcagtgtaaggctggggacttggatgcggctgcagatgtgctgaaggcgatggtcaggttgagcattccgacggaggctgggcattatggtgtgttaattgagagtttttgcaaggcaaatgtgtatgacaaggcggagaagttgttggacaagttgattgagaaggagattgtgttgcgtccgcataatgactccgagatggagcctagtgcttataatttgatgattgggtatttgtgtgagcatgggcggactggtaaggcggaaacttttttccgccagttgttgaaaaagggggtgcaggattcggttgcttttaataatttgattcgcgggcattcaaaggaaggcaaccctgattctgcctttgagattataaagatcatggggaggagaggggttgctagagatgcggattcctacaggttgcttattgagagttacttgagaaaaggggagccagctgatgctaaaacagctttggatggcatgcttgagagtgggcatttaccggaatcgtcgctttataggtcggttatggagagtttgtttgatgatggcagggtccaaactgctagcagagtaatgaagagtatggtggagaagggggtgaaggagaatatggacttggtttcgaagatattggaggcccttctcatgaggggtcatgtggaagaagctctgggacgaattgatttgcttatgcttaatgggtgtgagcctgattttgaccatcttttatctgttctttgtgagaaagaaaagacaattgctgctctcaaactgttagattttgctcttgaaagagactgtattgtagatttttcaatctatgataaggttttagatgctctcttagcagcagggaagacactcaatgcttattccattttatgtaaaattctggagaaaggaggatcaacagattggagcagccgtgatgagctgatcaagagccttaatcaggaggggaacacaaaacaagcggatgttttgtcaagaatgatcaagggaacagatggaggtcttgtaaagaaaggaggaaagagaaaagctaatgtatccacatagtttgttctctcttcattttcttttttgtgttttagaggtgagagaggtattattcctttttcttttggttgtaataagttaccatatgaggaagtgaattcatgaattgttctttatttcaaatccaaatttgcaactcctgtgttctgagtcttctgactgactccaacattcttttttttttnnnnnnnnnnnnnnnnnnnnnnnnnnnnnnnnncttttctttataatgttaccagtatactcctatcatggtctccatttatgtttaattatatttagctcaattctttcaaataatgtaactgtgagaagttggaactgaactgtagttttcaatcaaacttttctcgattttacaggattttgaatctttggatttctcttttatgttgctttccaaatcctgttttgccatgttgaatcaacatgatgttgaatccatcttgttctaagaactgccgtcatcaacatatcctgctgtgctgacaatacaaccaccagccacctcgcgggattcattttttagtccttttttctacagctactggacttctgttttgcaggttctataaactcagaagttgttctactcacaagctaagaaaatctgggtgcagagataattgcatcttccataatttttgagaaattaggtaatatttgtgaactaagcaggatgacatcagacttccatttgatttctaatttcttcccttctcagttgttctgatgttttttctgcaataattcctcatatgactttaatttattttctgattactgttgttccaatttctatatgatggtatacctagaatgtcttacttccagatttggttggtttggactgattcaccttgcgtaggttgtctgaatcacacatgtttagtgtttacttgtaggtatgtctgatcccacaagtttcacgatgccttctgatcctgtgtgggactatcggggaaactcggtagaaatgctggaattggtaccacaggttgggctcctgcaacgctcactggttgaactgtgcaaccaaacaagtattttacgtaatttgtgcttattgtcttccattaatttcaatcctctcagtttgtctatctctgttctttgttgtctctcacacaggtggtccaaacctctctgttctttgttgttctcagttgaaacttacatcgatcccttacttaaaaccacatgccaaaccaaagtcactaaactggaagggaacttccatcgcggatcaaaaagaaggaaacttacatcaatcctgttctgaaaaccacatgtggaacaatttagttaaccaaactagaagcttccaatggtttactgcaaaatagtcccgtaacttcgggagaaggggtgcctcctcacaaaggggatcgcagtgactaggcccgggcaattgtttaccaaaaacacatgtctccgcaaagtcgtaagatcatgtatgggggctgttgtctgcccagtgcaatggcttaccaattgtcatcatggaagaataattttgcagctaagagccaactaatagcatgtcagcatacaataatttccggtaattgcattctcagtagatgtctaaaatccaaagcaagggattcaattcatcttatgctattcgtattgagaggttgcagaatatttgacggttgtgaagataataatggcatgttaaatatcctttgcggatgcttttactgtgccagttcactcattgacttggggttagagtaccttttactagcaatttttcatctccgtcaacagaatcagttagatctcatgggcctctggacaaatattcaatcggatcagtgtcataataaataatgtagacgaagtggctaaaggagttgcataattgctggtcttggctttctttagaattagatatatctgtgaacttatctaatttctcattttagttgtacaaccacgtaggactcttgtttctgcggaatgcggatatgttcgttttttcacaaagttacaatatttcttttttcttttttcctttttcacaatcgacaattagacaattgaacttatgacacagagcaagctttataatgaacatggaaactcctaatgtcccctctaaagacaagtttgcaatgttgactacccgtgtcctgtaagcaaggtatattaaaatatttgggattagtgttttatttgcaaagaatgctccgttttatcgcagttagtgctaatgatacaagttcagtattagatcacatgagatgagtcaaggatgcattagagaacgtgataaacatcacgtttcaaatccaaaatccaatttctttaaaaaaaatccaaaaatttaatttttttaaaaaattaaaaaaaaaaaagagaataaaacctgtcgagtcagatcggtccaaccaggatccagtaacctacccggtcgagtttgttcgggtcatcccgagtcaattgcatgaccgatccaacagtggaaccaacccagttaagccaccaagtctctgtccgactgatccaactgatcgggtcaaaacaagttcaataacactgggtctaacacatttaagtgtgtttggactagaatgcaagagcaagatagtaagatcataaatgaagtgagattaacctacattagttgattctcgatggtatactaacttaaccatgtgtttgaacatgtcattttgaggatcaattcatttattaatgaaattaaaatactatgtggttaaattatgcatttaggtaaagaatttaaacgaagatggaatttgcaacattttaataagcaactttatttaattaacaaaatgagagaattaaaattctactaaaagtaaagaattttaattattttttagtgactcattcctttctttctattaaagctcgatttgtctcgtctcactctcactttctagaaactttgaaactctcactctcgctcttccacgatggcaaacacattttttctttcttgattcagagcaatcactctcttaacgcttcatacaaggttggtcttttatcttcattattgagggtttcattttatattttgttaatttgtgttatgttttttatttggttgtttaatttcattgattttgtttttgatttgatagggttttattggcttctttctcattatgcttttttgttgttgaatttcaatttctttagctactcactcatttctctctacacattcacgagtcacccttgtcttttcattttttacccttctcaactcaatttcttcttgtatagaaaaatctttaagcactttcctaaattggttcacattcagaaacaattggtcgacttcaagctttatgcttccatccttctccttcccatacggtttccttaaaactcctctctcaaacataaatatcactcatatcatcgtcagaatgcggattcccaatcacatcttgggtttactcaaaatcgctaacacaatcactttgattttcattactccaatctccatactcaccaatgggatcatactcactcttagaagactgattatcactttcatccatttcgtaacttttgtcatcatcacttgcatacatgtcatcctcatggaattatccattaacattcacaggttcatcacaaatgcattcacaagttcatccacatgttcattcacaaattcatttacattttcactcacaggttcattcacatattcattcacattttctatcacaggtaggtttcaaaactcatcatttgttctactaacatacatatgaatataaattgaatttgattcttgacaaacattttcagcacatcatgatcagtcttaagaattttaccactaccagtagaacaaaatcacaaaataaaagggtgacatggtgtcaagtctaagtcattaacaatgttgttcacatagtcatgtgcgtcaaatgttccaaacttatcataatcaacattgcatatttcacttggttcgtcccgttggtcagtaaagtggaccaaaatatccatgatacctgattcaagacctatgtattccagttcatctattgtgttcttgtggtcccaaacatcaacactattttaatcaacaataataaacaaatgattttcagttcatccattgtgtttcctgtggtctcaaacatcaaaactattttaatcaacaataataaacaaataattttaaaaattataagtggtcctaaaccgatcccccattgaaaccccattcaaaaagagacaacaataatcaatcaaaattaaataaataatcttaaaaagtaacatatatacaaggtccagtggtcacttacaagcagaaccatagcgtgaacaaaaatcttggaataggaagagaaacagagacactcgtgaacgtcgaagaggaagacaaactaaggcactcatgaacgtcgcgaactagaagaggaacagtggagaacttacaaactggaagaggaacaatgaataactcctcactaacgataaagaggaataaaatgtgaacatcatgagaggaacaagaaaactcactaacaagaggaagaggaacagtacgtgaatcttaatttatgaaactaattgggagtggataatttgggttttacaattaaagtgtaagggtaatttcgtctactcacatatttcgttgactttagttaattgcattaacatatggggtaaacgtaatatgcaaaaaatgaagggtatcaggtgaaatttgagcaaaacatagggagtgcgagtgtactttactctaaagcattttaatggttaaatactattaaaaataaaaattatattatatgtagagtttactcataaataatagaaaagttgatcctttttcttgactattgatactcttgtaagctagaaacagaattgttaggaaattaaattttttaacgttattatgtgttacatattgtattaataattatattatgctatttaatatatattagataaattaaagtgattaattaaatatgcccaaatagatttccaagtaaatatgagataaataggtggataccaatgatagactaattagatttaacgggagcagtttattgacccaacaataaagaaaaacactatatagtattatggtattcaatatgtcaaattaaatttttgttaaatatagagaataacatctaaggagtgatttgacagactaaaactcataaataaaggctaaaaggctacaaaaacaaaaggataaattcatgctacaataaaacatacatgtatgttttatttatttaaatttttttgatgatccaatatgatacttctaaattttattagataatgattttcaccgtatccatttagaattaattttctcatagtaacaatcgtgattgggtttcacagttgtagagagaaggaaaaagatggtgcttctacaggatttaataactgaaatcctgttaaggttgccggtgaagtctatagttcgttttaaaagcgtgtgcaaagcatggctttgtctcatatctaatccctactttgcaaagtcacattttgaactagttgcagcacgtgtgtctagacttttgttcattgcatcttctgctcctgaactccggtccatagacttcaatgcatcgcttcatgatgactctgcctctgtggtcccaaccctattatcactttgatgaaatcataggttcctgcagaggatttatgcttttgcaccgtttatcccatctctgtgtatggaatccaaccacaagtgtccacaaaattgtacctttctcacctgtttctttcaacaaggatgtcgtgtttttcacacttcttggtggttttggatatgacccatcaacagatgattacttggtagttcatgcatgctacaacccaatatatcaagcaaaccgcgcagagattttctcactcagagctaatgagtggaaagaaatcgagggaatccattttccttatattcatttttattataccaacaaaaaccctggcagtttatataaccaatttgggtcattcttgaatggtgctattcattggttggcttttcgcagtgatgcatcaatgaatgttattgttgcccttgatttggtagaaagaagtttttcagagatgcgtctcccaattgaaattgattatgacaaccttaatttttgtcatttgagggtacttggagaatcgccccatctatgcgctgttgtggggtgcaaccattcagtagaaatatgggtgatgaaagaatacaaagtgcagtcatcttggactaagtattgttattgatgactttgctattcggttcttctttccactatggtatacaaaaagtgatgatattgttggaacaaatgtcagagctggattgatgaatgcaatgacaaaggacaactgcaagaacatcgaatctactgcgatagtctatatcgatccgaggtggctgtgtatacggagtctattttcactcccttgtgacagtaagtgagcaagttgaagaagaagatgattggcaccagcgaacaagaagaattagattgtaaaatattttctgacacctttattatacttttggtactcatcgtatattattatttgtttgatttcttttggtatttttttagcttgaaaaagtattaggcagaatgatgaaattgctatttcatcgttttgttttttgttttatgattattccaacatgatgttattactgttttactgtttgcaatttatatccttccattcttccacatgtttttttttcttagccataacagtgaatttattgcattgctagcatgatatgtagccaaattttaaattggggcaatcagttgatagttgtcgatactattgatatgaactgaatacgacttcaacattaatagtgatgtctaagttagcctaagctacatgacatgttgtgaagtcaatattatcaatcttggtttccatgccaaattaaagatgtttattttaatattcgtgtcttgaatcatgcataaattacattacttttatgaagaatattttatcaatatcagcttgaatatataaagtagccaaatagtgcaccctagaggcaggaattactttaccaattttagcatgttgaaatgctacactaaatacttactaataaagttaaagtaattatatttgtaatggctaatttattaaagaatacgaattttctagtctgaatgtggttctttaggcttagggaaggcatactatgttggttctaaaaatataaatcttagattaatgcctgtgataccaatagggaggttatgcataacgggttggtgttttttttcaatttaaagcttaccaatttatgaactcagttttctctcatttggatttaatgcattggttactacagggggatcttggcagagctatttctcactttgctttaagatttagtggatgtgattagtgcatctatggttatttagattcagcttattatatgatttctgtattcggttgcaggggcaacacacatctgtggttattatcaattaagtttaggggctggagtgatttgtggggagtctagcatttttttcaaattcaaaacacatatggtgtggttgcatggaattcaccctgtcacaaacatgctaaagtcggtttgggcatgtgcagctacatccaaattttgatcgatcagaataagcccaataaagcttttcatatattatttcttggttgtggaagtggtgaggttttgaagattggaacttgtgtatcttttagaatatagtgtatttagagtttgtttgaatgtaaggttaaaagtgtttttgaaagtttttttaatgaaaaaaattctatatgtttaataaaaaagatcttaaaagcatttgtgacttgtatccacacaagtccttatattacattgacttggaagtcaaatcattttttgttaggtgggttgatcatatcaatacctttagtttaggtttaggtggcctcttaactcttaaggctgatttgcacgcatatttttagctttgcgaaactttgggtttttgtattatatgcataacttcttacattaaaacacgtttaaattgatgcatgacagccacagcataattatagcttttttttccttagaagatactatgggaaccctaaacaaagaaaatgtaatttaagaactagtttaaacattctcacttccttgcaaacattggagtttgccaatcccaggatttttgccctttcaatgtcccctcttaggccctggatgcccttttgcttgtggataatttatagtagattttgttgtttatgttttccctagcattaaaaaaatctaaacactgacaattcatacaacggatgatataagttagaatataatttcacataaatatatagataagtctctatttcccaagctcatatacggtcttaagagaatgttatagtgtattcttagcattcttctttgaaaaatgtctgacactgtaaattcattccctacgattcatacaacggattatataagttggaatgtaatttcacataagcatatggataagtctgtatttctcaatctcatatatgatcttaagagaatgttatagtgtattcttagcactcctttgaaaaatgttcgacacagtaaattcattccctacaatttatacaacggatgatataaagttggaatgtaatttcatataagcatatgactaagtctgtattttccaagctcaaatacagtcttaagagaatgttatagtgtattcttagcactcttttttgaaaaatatccgacactaaaatttattccctacaattcatacaacaaatgatataagccggaatgtaatttcacataagcatatggataaatctatattttccaagctcagacacaatcttgaaagtatgttatagtgtattcttcgcactcttctttaaaaaatatccagcattcctataattttgtgtttaacctaccaatatgaaaattgttttctaacacatttgattaacaggaagtgtgttcacaaaagtataattacgtcaatcagaaggttactatttttgtgataccctctccattgttgtcttatgatttttcaattttacattcaaattttcagttacatccttgagttttcgaaatatatcttcaaattcccaacttctttaggttacaattattgagaagagaatgccgaaaaagagaaggagagggggagaagtccttaataaagttacattgtttgtaatgttttgatttttaaaaagaaaaattataccaatcgatatttactcaactacacgtgccacagccctacaagtacatattaaaagagacatacttcttcttttaggcccaacacacaaattatgtattagtcaggctgggcccacatctatccactatgaccacaaattagaagtacactttggttatggtctactggggggtaatatttcttaatccaactttttcccttcttttcttttgtgcactacattagaaacataaattcatgatgaacatatgcttacaattgtttcacatctcacaagggtattttattatataaaaaaaaactaagtgttcattttccaattttaccactgtgtcaggataagtcctcacaaatataatttataattttcaaaaaatatattttttattttctgaatgtaaagtgtttgaatgtatagtagagagagaaattattgtatgattccacagtccagaccattacatatttatgattctaataagtattcatgtaacaagatgtaatcaacaaatttcatgtaacatgtggagatggttatgattatagatacattgggtattcgaatatacaataattttttctttataggatctgaccgaatttttttcattttacaattagatactcactactcagtgggatctgaccaaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaacaatatagaaagcataacgtgaagctatcgaaacgtctctttattcagtctgcacctatggtttaggtcaattgcgggtgaatttcctttagcagttataatttggaccctagaaaatgcctctaagctacctaatacctattcccccatgccaagcgttgaatactaataagtaataacagtttgtgcatgtattttcctccataatttgaaaatgacctatcaatcgtgaaattaatttgtatgatatttttcctcattaggtctatccagacacttcttttcttatagtaaaattaatgttcttaattaaatttattaaatatatactaaatctcactcaaactttttaacttttcttaaagtaagttttaaactaaatttttataaaattattttttttagacatgtaatacaccattgttcttttgatttgattttttccatttcgcatgtgtaatattttttatttttaaattttcagcaactttcatattataatatttcacgcggtgacattttacttaatatctttattagtcagaattctccatcaattacaactcttcataggtaatcatttctaagatctcaaaaatcagttctatatgctttcaggatcaatgattgaccccacaaactaacataagatttttcggtgtattttgttctcattctcgcacttttcaggaaactttccaagagattatccatcctataactacttcaagtcaaacacgcttaattatgaagttcttaagagatgaactaccaaaaagtagatgcatcttgttggtataggtattaccaattaattcttttaggtcatcctcaattgtatagtttcataattacacaacatctggatctctcattctggtgtgattcgatcgaagtgttacatgtctatcagtttttgcttggtttgtcctcgaaccacatcgtactgggagaaagatttgctctgatatcatttataacatttctaatttttttacttctcgataactctcatattatgacatttcatgcagtgacactttactcaatatttttgttagtcagaatcttccacatgtcaaaatcttccacctccgtagttagttcattctaaaacctaaaaatttaggaatcttacatgatacaacaaacatatagaatttctattttattaatgattaattattaataaaattaaatgaatatttcatattaatgtcttggtcataataaaaaaaaaatagagtttcttggtggaggagacgttccaaaagtcaagtggcatttaacctgcataagacctacttgcctgctaaagttgccatctatcatctatctaacttcttttgccttccaagtttggcaaaaatctaaggttgcttatagcttcttcattctcaagtcaactatcatactcaatttggaattttctctgtgcaatttaatttgtggacacacacacaaaaaagggtaagctagcaacttgtccctaacttatgactttcttctttgcataatattgtagactattgtgattagaaaatgacagttttattgattgtttgatttagagttcactttttaattctttcccgccaccccctattgtaaactcttgttgattggagagttgtcttgccagctcactttaaaaatgataagcaataaaccatccatgaataagaactagtactcaagtcaatctttcattctcatacctttttttattgtattgtttatttaaattattttgcaaatttcctaaccctgggcccacctgtgttttattgtatgcaaacttttgaggtaattaagcatttattattaagtaatgtagaacattgtttcgcttctgataagattagcgtatcataaatcagaataattaacatgttcaagacaactgttatcatacttacataataaaatataaaaaaaataaatgacatcaaaatataaaccaaacagtttatcatagtgcattccactaaggtggacatgaattagatttttaaaaattcaatttatatctatttaaatggattagattttaaatttatatttatatttttttaaaaaacaatttagatgcaagatccaatccatttaaatggatataaatttagttatatccaatctatatctacttaaatgttatagttttttttttaattttaattattaaatgttaaaaagtgaaaacttagtacatgcttatttaaaagttattttcaaccgaccttggttaagactatttttgatcgatcgatcttggttagtatattttttgcctaccttaactaggacaatttcgacatatatcggtctagatatttttaaaccgacatcaaccataactattttttgactgacattagttaatgcattttttggcatattgactaaggatttttcgatcaacaccgatcgtgactaattttttgtcgacattggttaggattttttagctaacatcgataagatttttttttttgctaatgctagtcgttgatatttttttgccaacattcttcgagactattttttggttgacattagctaggttattttgccgacgctggtttaaactatatttttgttggccaacattaaccatgactatttcttttggttgacgttagctagggatattttttgttgacatcaactaggttttttcgatcggcgtcaattgggggaatattttggccgatgtcaactaagtttttttggctgatgtcgatcgatgatgtttttcaaccaatgtcggccaaaaaatagtctcatctaatgtcgacaaaaaaaatcctagccaacgtcaagcgaaaacctacctgacatcgataaaaaataatctcgatagacatcgacaaaaagacgtagctgacgtcgacaaaaaaatagtctcgactaatgtcggccaaaaaataatctcaatcaatgttaacaaaaaaaccttaccaacattaaccgaaaaatagactcaaccgatgacggcttaaaatcatcattagttgacgtcaaccaaaagaactctagacaacatcgacaaaaaaatggctcttaacaaagttggtcaaaaaaatctagtcgtcattatcaaaaaaattgtattgaatttttataaattcaaacaaatatccaatccatatccattctatatccaattaattagattagatttaaaattcaaaaaactggatttggatatgaaactaatctatttaaatgaatttaaagtgaattaaattggatcagatataaattattttatgaatatttatttttttcacaactctacattccacccttaaataaatggttttttttaattattaagaagttacaatcttaacaattagattgcttgtatacctttcaatcagtttcttttgcaatatttagcgtaatgaatattcagtaactaagatttaatatttaaagagtccaatgtaatatcacttgacaaggataacttattagacttaataattgccgctgtcaatttttttaaagtgacttgtgaatattattataaacttctgttaatgttgggtggcacgtaatggccttaaaatagattaattctttccgccctctaaacttataatacaatttgtatttacatcaatcctttttatatacatatttattttagttttctatagttatactacataagtacttcgattcaagacacacacagtcattcaaacactaaggtggatgtatctttactatgctgcttataagtatttcatatnnnnnnnnnnnnnnnnnnnnnnnnnnnnnnnnnnnnnnnnnnnnnnntatatatatatatatatatagagagagagagagagagagagagagaaattcatttattttaaaattaactaagtattaaatacttcttctgcttaacaatttattcataaatctaactattaaattatatgatacgatattaatggttatataatatatatatatatagatatgaaattttattgttgatatttaactaggtttatctttgaaagtatattaattctgtaaaaaatatatatattaattgataaaatatcaaatagttttttttctttctaaaattaatttattgaatgataattcaatggttgaaatgaaacttaacgtgcttgaatttaaattctctcttttcaatcatgcaggcatggccctttaattccacctaatgagactgatgaggattcctcctacactctagctataggttacaatatatatatatatatatattagacattaatgtttgaagattctacgcgagcatggcaaggcgaggatatgtaattaaataaccaaactcatgtgatttgtcttgtacacggctaaataaataaaggtttggagagaaaaaaaatcaagggttaattaaaacagcttttattaagacatgatgtgtgatacccgtaaagggaagcatattgtgccagaatcagagccattattagaaggaatacatgtattaatcatatcagttgattctgttggaatcacttgagcaaatgctatattctgttggccatcatatatatatatatatatatataacaaaacccatcaaagattttaagagttgtggaggaatctacctgtgtgattttgaacctaaattagtagtttctataaagattaaaagatataacaagttaaacagatggagataataattctagtcttttccagaacaacactttcttttatgacacggaatatttgggcagtcgatcagttgagattaatttaggtggttatagaatgaaataaaatagtacaccaacaatttcaaacatatttgatagatagttaaatttttttagcatgttgtcaataatttaatttgtgataatgtaattaaatgtaaaatattttattagaaaaaataaaacctattttagtaatttttatgtctcaaaagtaannnnnnnnnnnnnnnnnnnnnnnnnnnnnnnnnnnnnnnnnnnnnnnnnnnnnnnnnnnnnnnnnnnnnnnnnnnnnnnnnnnnnnnntattctttacggcctaatagttcatagatatttttagtgaaaaaaagagagtctccattgctattaaagttgcaaatcaattttgaatgttgtaaacaaacaaccccaaaaaatgtaatttagtgactttttatttatttattattatttttaagcgtgaatacgacctatttttctgttcaaataggtttatataaagttaaaaaaaaaatcagaataaatatattttgacgaaacatgatatctgcaaaatgacaattagtcattattgaattattgaggataactgctgcatgaatgannnnnnnnnnnnnnnnnnnnnnnnnnnnnnnnnnnnnnnnnnnnnnnnnnnnnnnnnnnnnnnnnnnnnnnnnnaataattagtttcttcttattcataaaaactcaaacttatatacactaaactttggttaaaatcttaaagcagtttctaaattgaaactgtgtaaaaaataaaaatattatttataaatattaaagtctaaggagaataaatcaagagaaaatagattaagcattaaacgtataaaataatattataatatcgtcaaattacattttatgattaatttattgaattttataataattattttaaaaattatatcatcaatcatttatgattaaataatagtgaaaaattttgtcgttaaactcataaatcaataggagatatttatgtaaaggaatatagtttgatcctaacaatttactttccttattcatatttcccacgcctccaccagacaatatcaatgtccaaacaataaatcaatttctaattctgcctgggtcatatatgccaaccaagaccatccatgaggattcaacatggtactccaataatcatataactttatggttccacaatcatattgatcacatggagactttcagactttgaaaaacttcaattcgatccatcaaaatcaaattagcttgaagttgaaagtgctgtttaagataacttgttatacatcaacctcctttttatttgtatgatatgttcaaagaaaaatatagaacaaaataaattataatatttagttttttataatttttaatccataattttgatctcataattttttctctcataatctaattttcaattattttgtgttttttttcttttattttgatttaaatgaactctagatttaacatatccatctaagttattataaaaaaataatttaattgattagaatatgaaaaagtgtatataaaattgtaaattttttagaataaaaggacaagaaaaaagaataagggaaccaaaaattactattaaaaattaaaggagaccaaaattataatttagtctaatatattaatttatgggatattgtataatttaactaataaataattttatatatttttaataagtaatcttgtataatttataaatttatatagtttaaataaaatatttaataaataatattctatcattttaacttttaatattttcatacaatagacataatattcacttgaaaaatcaaaagtgtaattaataaacacaataatattatatattaaatatacgttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtataaccaacttattcaattttaaggactagtgattcactcaataattaattatggcaattgcctaagaggaaacagttttcctttgtgtgattgtgtttgaattttcattaagataaatctgaacataattaattattgcaatagcctaaaaggaaaccaacaaatacataaattaattggtctaagattgttctaatttaactactaatttaatgtttgagtcttggatttgtaattatattaatattaactataattattttttatcatcacctttcatttatatgaaatttaataattaaaattggtgatgcattataattaaattttttaaaaaaataatgataaaaacgtgaaattatttaaaaaaacattactcttacaataactttaatccctcctccaaaatcaatgttactaattttagctttttacatttgtttacatcaaaaacataatttgttggctattgaacgcgtttttaaacacgttcctagccaatagctttagtggtgcttaaaaaataaaagtataaaaagtaagatgtgataaatataaattataaagttaaaaacaacagcaatttagtcacatattttttagtaaattagatatcatagatgttattcaattcattaaatcagagaaactaaactcatttatgggtgttactcacttaaaaaattgaatacaaaattttcacagtaaataaatcatcttttaacatgtgaactaagcaaatcttaaatcctatgtcaagtcgagcagcaatatagtaacatatgaaaagttatacatgtaattatctaaaatactccgtgacatgaaaggtgcacgaagaccgtgacacgtgcaatgctggtttaaggtcataactggtatcacactcactccctgatcgagaaacgagccacagcagagcacagtcacagagccagaaagcaaagcactctctctctatggatctctaacattgacacgtgcccatgcctccttatcactgtaccttctctctcgagcgtgtcacccaacaatttcacctctcactctcttcataatcacatagaataactcaatacgaacacaacactttttcacttattttgcaccctaccctcctttattattattattacaagccagatactaactgtaagacattgactaaaatttaaaaaaaaatattgagatggataaaattatatttttataatttttataataaatatttttcttttagtctttaattaatcataaaaatactaattaataagattattattattattatttcttgcatagcccattggtggtactacaattcaaggtgcagatccttgtgttcatttttggcttataataataaaaggctaatgtgacttgttaagctttaattttatatttttaaagtgagtttatgggttggattagtaatttaataatggaaagtgggttttatggggttgtactaaaataatgttggcttctttttacccggcaagtgattgagcatggaattgcgagaacagggcaacacgccctcttggttgtgtgtattattattgctgctgagtgcaaccccatttgatttggttgtacttttgaggccaattcagtggtaaacatggccatgatttgtataagaatttaagaatcatagtatgacaacacccaacccaacgtgttcccctttttctctttttactattatcaacctcaattctttccagatttggatctcctgcggttaagattaacggtagacaatcccaaccgtttaaatcttattactctatattttaatcataagacactccactccatattttttttcaagaatgaaaataaaatttaattacacattttacccttttcttttatattttgtaaattttaccacttattttttatatatactttgttatcatacctaatattaaacattttgtcccaacgttagttaaccattggttatcgttagttgattgttgacttcacaatgttaattattgatgtaatattatgtccgctaacttggttaatagggttgacatggtcgtttgacacaaacatggtagtgcataagagaatgactttataatggatatttttttttcgtttctaattataagattttttcagaaatttgtttactgttttttataatattttaaaaaaaatttaaatgtattaattattttttccttttgcacccttacttaattattttatcttcaaacattaataaaaaataattaaatagatagagatataagaaaaaattaattttaaaatgatattataaataattaacatatttaatatatttgattaaattaactatttttcttaaataatatgaattaattgaaagtattttataattagagacaaagaaaatacaacctaatactttagataaaaagagattttaaggtgatgatgataacaaatataataacagtaataatgatgataaaagaaaaaagagagaataattattctattttgttgctttttaacttaactatgttctcaacataagaaacatattacaccaacaatataaggaagaacaaccctaacccaacaatattccctttcaaacaactagatacttacaactatcactaaatgacaaacaattgatcctaagggcaaagcctcccaaatgcaatgaggagcaacctaaaagaggatagcaaccaatattttctgacacgtatactttctgcctcgtgactcttatattggagtatccactcattttagtgttaagagtactttttacaaatacatatttaccttcttacttactatagttttggaaatttggagactagaatcaacttacatcaaaggaataagaggaatcatctatatgttaaaataatttagatcataaaaaacattaactaattttttgtacaaatttaatttatacatatgtacaccgatgtcaccgagtataagaatcatttggtgtttaactattatcacttctcataccatgggagaaaaaactaatcgtcaaggcgtcaactagagtgataatattttaacattcatttattttaaatattctatcaaaaactcttatttcattttttctttcacattatataatctattatacttatatttttctttttctttttcactctctagatttcaaatagcatttaggagtaaaaaaaatatttttttcccgccaactatttgtcttttggttaaaaggtaaaaaagaaaactgtcatgcaaaatatttcctaggtatggtgcgtggccatttttattaatagattactctatgaaagtgttttcgccttgctgcttatatttgacagttaatttgactacaatactaattagcgcaaaaaatctgtgttattgatatgctggaaggattttaaagagtaaaaacttttgtcaaaattaatcattgaatgcgtaaattaacttatacatgattattttaatttaaattttaaatatacaattacattaaatattttaaataataatcctaccagagctttgcaataattatattgattcttatacatgctgttggttaaaaaagagtaaaaaagttgtcaaaatctaagttagtattagttaacttatctccaataatataataatcacaaaagatgttccatttgtactacaaattgatcatggagtgtgaccgaatggttggtctctccccaattgccattctggttgccagcaaagggatcttagtgggtttttgctgcatccatgacccatcaaatgctgttcctgcagctgcatataccttccacatgacacttgaaagagagagggtaggaagctaagacgcacatcattggtcgtacggacagctacaacctttgcccattaattaaatcataaataccctcaatttttgctttataaaatttaaattaaaacatgatgtacatttaaaaccccaaacaacttttcgaaaaataaagttgtctttaattggaggagccagttagttctgaactcgacatttgggtggtggtgaagaaattttttacactactttcagggtagtgctatccttttcatcttcattcgaattaaccctcttttctaattacaattactactctgccatgcattcacaatcggatttaatttcgattagtatatttaatttgttcttgaggataaattttgtaaccttaatcttatcttgtttctttagtttgtttatattatattttcctttcttcaattatttaaacaaatatataaatgttgtataaaggtttactagaactacgaagaaaaactaacatagatttaatgaatcatttgattcttatgattgtagaatctttaaattttaatccatacacttagaaatcaatatatattttagtcctcacacgtaattttatatcattttaatctttgtataaactcttttcaatccatttaaattcgtacaattttagacaacaaagattaaatcagattaaatactgtacctaaaggaacaaaacaagtagtttttgggatagggattaaaatataaaaattatataaatataaggactaaatgaataagtaaaccgtcaatataaatgcatggattttataggcaaattagttaacaaattaaattaaacataaaatattttgtccaaattattccaagataattattatctatatatatgacgcatgaaattagaattataatttaaaagtctaattttagctttacattccaattttaatttaattcggagtataaaaaataaacactagctgttaaaagttaattttcttcaattacatatttgtttgtaaatacttttttgtattgttatttacgcataataaataatgtcttgcacaaattttaattgctaattagttttttttttcttatttatcatcagtgactttacttatatgacttacaccttatgtttgaatacaatttcatcttccaaataattttttgatggtaaagaaagaacggatagttacaaagttttttttcttttcttttattcgtgctccctctctgtctgatatcttcatatatttattttttgcatttttggtacagaaagggggatgggggacacatatcactgatggacctgctacagctttcaagttttatctagcaaaaaccacagctcatctacgaacttttatccataaaaacagtaaacgttgaatgaaagtagacggcaaataaatttttaacttaagaagttgtaatttcatttacatagaacaatatatattaagttaagaaattacattattaatatataactattttaaaattatatttttaaaataatattaaactttggatcgagttgagatgagtcaaagtactcaaaagatattgaatctaattctaaatccaaattagtcaaagttaacttcaaattgatatgggttagtatagaacacgataagccatgaacactcttattagcaagcatgagtttgttcaataaataaatattatacatcataaaatacttatttaatgtatgtatgagtttgtcaaagttaagacgcattgttacgatgaaagctaattcgaattgtgtaatttgtaatgagtgcgtagaatcttccaacacctcttttttgaatgtaaatttgctaattagatttggacaacatgctacttgtggtatggtgacatacgggtattgccaccttgttgcattgctcacttttttggcaacatcaagggacaattgttgggaggaaagaaaagtcaatatggtgggaaatttggttaattacataggaatgaagtaagattcaatgtcaaaccaattgatccagggacactctttgatactattagctataaagcttgaacatggtgtaaagcgtacgttaaagactttgataccactttgtacgcttggaacactcatcctcgagaagaattgatgcaactggagtaaagcgagacgctacatatggctcatactgtttctctctaaaccatttgggtcatcttgtaatggtataaaatacttctcagcctcttggcttttgtgcatgtactgttcagtggcaatggcacttcttgtgacatttgctactttcttaattaataatataatgcctttcatgtgtaaaaaaattacttaatttaaaataactcttataataagcaaagatattggagatcaccttaataatttttatttttatcccaaataaatgcaggagagtcataatatcattccaagtacaatttaaattaacactttggcatgatctattaacgaagaatcaccacccaaattaaaataagaaactattttttcgaggttgatcaatcttatgatccaactccaccatctcattgacaaatagagagacacaagaagaaaaaaagttccaaccaaacaatgaattttaaaagaaagatttgtggatggattaccattttaagacatttaatttctaaacaaaatacttgttgctttgagaggtatcctcattgtgggtgagtgtttatatatatatatatatatatatatatatatatacactgaagaaacatatgttaatatatcttttcaattaaagtttgtaaggtatgtatatatttaattaaactatgatataaattattataaattaatctatttatttgaaacattaaaaatatttaaaattaatgttattatatacttttattatttattacagtacaagaaaattgttaaaattaatttattaaaaaatattgataatttaaaccaaacatacacagcatacaatctcttgaccgttattttaccttgttagttttaattttttggaactacttgcagggtcccatactctttaattcttgtaagaaaccagcttcttaattaatgagctagttaatagtcagtccatttacaaatcaataaatcgaccttgctgcaagaactgaagatatttttatctaaataaacatatcatctaattaaaacaccctatacaatagtacgaaacttcagtgtcgtgcaatttcttcaagggctagtagtacctgcaataaaactgttgtgatgtggggctaagaaattaaaactttaagctgtttcacaattcaattacactttgactgcttagggctcgctagtggcacatcctgttctcgacaacctatttgatgaaggaaagtgataggataattatatatcactttagaaaataattaaccattgtgttatatatttactccaaagtccaaactcaagtccgttgcttcgttaggttttactgcatttgaggtattattatttactttaaaaattgtatgaatctcatggttgtctttgaaaactgtttcattcggagaatagggaagagagtattgataaattactattggtactgatttttaaataatgtgagattttttttaagtaatatctgaacggattccaaaatcacaactttatcaaaatgagtcttctctgacttttcttttgaaaattcaagacacatatatcaatatatcattcacacgcatagttatttcaatatacgatccgtcttttctgttgaggtgctaggttattacagaattttcatgcatattatggtcccctgtagtcttaatttggtccctaattcatgcaagctttgtatttgcggctttccgcgcatgagattttttttgaaagatggcacactaccattaaccaaatataacaattagttcgtctcattggttactacatgcggataaatgaggttatgtcacaacaattaatatccattttaccttataacgtgaatcttcgtgaaacacctgtttatacagagtggtaaaaaattcatataggctctaaactcctttgcatgtaacccttgtttcaaaatatcctgtcatttgagtgtatacttcttgagaaaatataattgtattttaattttataagcaatttataataaaaaagagagaaaaaaaaatacaagtgaatgatgtaacgggaaaaattgaagagaataataaagtgaatctaattaaactacactaacaacggaaattttttatagtatatgtcatctaatcacttattatcatatataataaatttattcacttttataataatattatatttaacgttatacttaggataattttaataagttgttactataattttttttatactaactatccataaaattaaacttatataatattgtaaaaagtgttataaatatatattatataaataagataattcttaagttaattttcataagtgtttgtgtactaattgtcctgcactatttcacccatctcatcaaaatgggatcactgctttttaaaatttgtaagttcttcaggcttccttttagtaaaggaaaaatttatggacatattggcatcttcttttgttctcactgaattctgctataattgttaaaaccagcctatttaatcttaacctaccaatccataaggatgtttttgatcatcaaagtccagtttttnttctttctttcttagtagacattcttggttcatttaaatagaaatttatacaatatatcaaatcacgaaggaaaaaaagaaattgaaatttgggaaacacgaaaaaaggccagtacccacttaaaaagaagtcaattgcgtgctgcaaaagcctgactttttttttcttctaaaaggtgggaattagaaataagaataatacatgttctataattaatttatttttacataagtttaatttgatttctagatttattttacagtttgagtttgattgtacaggtgatcatgaaaattaatttttgtttttttgataaattgattataattcacaatacactcaacattgacaaatcactttaaaagaaaaaagaaaaggcaaaaaagtttaggaaggaagatattctccctttctaaagtttaaaagggtaatcgcgtaagagactgcttatgaagatacattactcttattgaagaaaatcactcctgaaaataaccttatataaacacagttccatcaacatttaagtagatataatttgtttttggctacttctgacttataaaaagtgtgagagggcgagggaggtaatttcttttcttttaggatgaaaacatttataaagctcaattataacttatgctagttggcaaaaaaattaatatattgtttttaaaaaaaaattatgaatttggggtattgttagaagtatttatgcaagtgtggtagttagttgcgccaaaaaaaaaaaaacgtaactaaacacatttaccccaagcgcgacaggtgctcagtcgcgccctcattaggcgtgaccggtcgcgccccagataggtgcgactccctcccccgttgcgtcccacacaggcgtaactctgcactgcgccatgttgcacctgccccagacgcgactcttccgttttaaatttgaaatccaactaactttcaaaaaataacctaggtataactaactaattatatcgctaatttaataattatattatcataattttttaaaaatttgaaatacaactaattttcaaaaataaactaggtcactaactaataatattctaagtcaataatgtcctcaacagataactaactatatagctaatttaatacttattttatcataattttttaaaaatttgaaatacaaataattttaaaaaataacctaggtcactaactaataatattttaagtcaacaatgtcctcaatagaaaactaactatatcgctaatttaataatcatattatcatgatttattttaaatttgaaatacaattaactttcaaaaataacttaggtcactaactaataatatattctaagccaataatgtcctcaacagataattaactatatcactaatttaatgattattttatcataattttttaaaaatttgaaatacaactaattttaaaaaataacctaggtcactaattaataatattttaagtcaataatgttctcaatagaaaactaattatatagctaatttaataatcatattatcatgatttattttaaatttgaaataataatgtcctcaacagataactaactatatcgttaatttaataattatattatcataatttttttaaaaatttgaaatacaattaattttcaaaaataacctaggtcattaactaataatattctaagccaataatttcctcaacatataactaactatatcgctagaatttaaaaattatattatcataattttttaaaacgatatgcaaagtcgagcttgggggaggcacaacaggatgcagagtcgcgcttgtgtggggcgcaacaggggagggagtcgcacctacctaggtgactggtcacgcctactaggggcgcgactaagcacctgtcgcttatgggggaaacatgtttagttacgttttttggaggcacgactaactaccatacttacttaaatacttctaaaagtaccctaaattcgtaattttttttaagaaaaacaatatattaaattttttgtcaactataattttgtttttaaagaatccaatctgatatttattttccacaatatttgatcaaatataatatttatttaataaaatatacaactcattcacataccacgcttcaataattagatatgacaagaaagaaacgaacttatctttaaagtgaaatgaaagaaagtgtatatttattttcaatttaaattgtttataatttgagtttaatatttgtaagtataaaaaagttatgatagataaaattatcaaaatattattaaaaagattaacaaattcaccaatacataattatttgtgatagaatgataacgtaattattattttttatattatgagtatatatatatatatatatatatattttaatttgaatacagtaaaattaaaaattaggaaacaaataattttttcttagataactaaaaatttaaatgaattaagtttggggtctcactaggacagagcaagccttaaaatttaaaacacttataaatgtatttataaacaagattcttatattataacaaaaattaaatacatgttttttgagaccccttgccaattcaattaatttgttggttagaaagcaaataattagtttttgtattcttagggtaataatgaacgggataaggttaggaagtaaatacaagaaaaaggagggacatatatgaacagcactgtgtctagtcttttccgataagcctggtcattgttcaaatggggaacaacatcaacaacaacaacccttcttcttcacaagcactttgagttcaactcaccgttgtgcttctctctctctgtctatatgtttagtgttttaccttttacacgcacacttgtctctctctagaaatcacgcaattctcatacacccggatttttctttccatttatcacccaccaaactaccaactttctctatctcttaccacaactcaaatgtttctttttgccatgagagaaatacaaacaaactgtaagtgtcaaccaaactccaaattcacctttaacaaaatgctagcatatgctctttggtagtgaatttcaggtcttgttttagccatgttaaggtcgagactataagagagtgatttaaaaacaaaaaacaacctgaactttttgttttcctcttttacatttgaaggtgctcttgagagttgagacatgagaaaagaccatttgagaaattcaacaaactcctgaaatcaggcagcaaaataaggtttcatctcatattttgtctttatttctctccccaccctcacttcgatctctttctttttggttaatactgttttttcttttttaaatttttttggtttacaaaatgaggggtacttactgaacaaaaagtattgtctttaacgagctaaaaattttaggttcggatttttgtgtttttttttcagtttgtttcaataataagggaactccagagacacagatctgtaagcttaacacctgggtttatttttgtctttgattgagatctcagcacctgtcacggaatctgacccaacattgtttaaactaataagactccaaattttatttttaatatgtttatttaattaagactattgagcatttcagaaatagtgtttttttttttttttaataatgaaccttgcagtgcctggagttgagagaatctgcacccttccaataatcaaaggacttatttagagccacacatcatccttgaaaattttccagtcaatttggcgccaaatgttggacctttctacatgactttgcaaccacgctgaagtaagccatatttgttgtctcatattttcatcctctggtacgtaccaacaactcctctatgccctttgagatttttcagaaaacattttctgcttatgttgttttagtgttggttttgcaattttacaagttgtgtctattgtgaattaattttatatgtatgcggtctttcataactagactaattgatgtataactaacgaagcaatagctttagttttacccatacacaaaagagaaaaatttgagttgagttacaaatgaacaattaccttagcaattagcattaacatttaagggctaatttataagtatctataaaaagtattattttttttttgaaaatcaagtatttattacgtcaaaattactaaaatagttgtgttatatatatatatatatataaattataacgactcatacaacatttttgtataacaatattttgggtgtttattttatgtatcctatcatttattacatattatatttttctcattttttacaaaatgtcaaatgaattgttgtaaaaataatattttcttataaaaatataacaaatacttctttataatgcttaacattttccagaaaccaaatatatgttttcctaagttggtaaagattcattattaatgacagtttgtactgagggacacatttcaattcaaccttttctcaaagtattgagttttttttcttcataaaagtatatcggtttttaatgtgccatataccaactatactaaacacagtcagatcttatctacttggggaatctgagaagtgtacgaaatatttgaattgaattgaatttattttaatttacttttgggtttgaatgataattaattaatagaaaaatcgtttggttgtttatggtagcagctgggtgtgattttgcaaggaagggtaagagagagggtgttgagacctagttcagtgttctgcaactgcaaaaagctaaacaaggccctcctgatttggaccgtgatatatcagagcataaaaaagcctttttatcactacacaaccaaagcagtctctgaattatcatcatcaacaatgcaaaggacatagtagccaaccccacactttcactcttttctctctttctctctctctttacaagtgtaacataacaaacataaagagaaagacaaaagtgtgtgttttgtgcaaggcatgattgtggtatggaggaggaggatgagattcaagcacagaaggtgagaagaagaggaggcagtgatggagagagcacgaacaggttccacagcagctggcaccaccaccaccaccactcttcgaggatcataagggtgtctcgtgcatctggtggcaaagacaggcacagcaaagtgatgacttcaaaagggttgagagatagaagggttaggctttccgtgaccactgccattcagttctatgaccttcaagatcgcttgggttatgaccaacctagtaaagctgtggaatggcttatcaaatctgcttctgatgccatttctgaacttccttctttgaacaatttccctgacacccccaaaagtgatgatcatgagaagagagcaaacactgatgttgctgctggggtagttgatggggagaattatgaaaatgagaatggcaataacaataaccagagccagaacatgtctttgtctaaatctggttgtagtagcacttctgagacaagcaaaggttctggcttgtccctctcaaggtctgatattcgggtgaaggctagagagagggcaagggagagaacaacaaaggaaaaggagaaagagaaaaatgagtctcatcatcatcacagcaatgttgttcctcctccacatcatcataaccccgtttcacaaacagcttctttcactgagcttctcactggtgggattcccaaagggtgtgatgatgaggagcctaataacgtgatgatgttcaacaaagcagcagctggtagacagcaatggtgttcatcatcatcatcagcagcagcacctatggactactttctgtggccttcttctagaacaacaacaacaccacacaatcagcatcaccatcatcatcaatattcttctggtgggttctcattggcacaaatccaactaggacattctcttcctgaggcaatgaatcacaatgtttcagcattcaacaataatgtgagtggtgagaaccaaaaccactcatcatcagatcttcatctgcaacagcaacaacacttctcatccataccggatcatcttatgtcagctgtggttacttcttcttcttctcatcatcaacctagcgggaacgactacaatctgaacttcaccatgtcctcgggccttgctggttacaatagggggacccttcagtccaattctccgtctcttttgcctcacttgcagaggttttcgccgttagacggatacactgtacctttcttcatcggagctgctccttctgctgcagttgctgctcctgccacggagaacaacaccaccaccaccaacaacaaccattaccaccatcagttctcatctgttttcgatggcagccgcttgcaactctactatggccattccgaccagaaggggaaagccaaaaactgatatttggattgctgcattttcctcctggtaaactatcttcatctttttattatgttttctcttttcaacccttttatttttgcagtaacaaccttatctaataattcatttaactcgcttgttagagttgttatgatacccagataaatctaagggttttgatatagcagctggttttttggccaataattattgaatgagattagagagagggagaaagaaagtagtgagtttttcaataagagaaccacaacccgtaaattttaaaaggatactataaaatttctctcatttagtaactaaactttatcaattcccattgagaactcataaaaaccactgtaaccccagtgcccggaggctccacgctatgcgcaggtaagggggagggatattgtacgcagccttacccttgcatatgcaaagaggctgtttccggattcgaacccatgaccaacaggtcaccaagacacaactttaccgctgtgccagggctcgccctctcccattgagaactcatatcaactaaaatatgatatgaccaatgcaatccttgaaagactcgtccttttagcagttggccgaaaacccaagttttaattaagaatgactcattgttatatataggtctaactcaataataaaaacatgtgttgaaaaattaagttagataatatgtaatatgcctgctattatttctcaaaaagtcctgaaatgtatatagtagctgtttcttttttgttttgtttccggaattgtttgtttggctttggtgtattgtaaatgtgtgatacattgcactccatcttggttgtttgatgtggtgccccttaatcttcttcttcaatgctttggctttggtaaaagagaaatacttgcacaaacacacatctaacacgtaagatttagacacaaccaatcacacaagtctaagtgtccagttaatggatatgacgtgacattaaatatttgatggtgtgcgtattgcttgtttggacgatgttgtttatggattgatgtgttgtgttgtgtgcaatactatgagccgctggggttctaggtaatgatgaacaagttggccattgggtataagtttacggtgttgtcttttttgtggataggaacatgggttgccgtgaatagggtatcggctagttgtctccttgtttgtgctctcattggttccctcctctatagcatgtcaggtgaaagcttttgtgtggcacaaaccatgtgtgtcactgatgagtggggacaatgttaattacgcttgggcccaaaattaatcagtctctaaaaatgactttataatcccaattactccaattaagctctcttgctgtgcacccacaagacacgatcctcattggctcattgcctaggttagagactagctaggattttcaatacacatggggtggacctttttcatgtgttgaaaggtccatgcacgtagtcagaaacttcactgctgacaccactcatgcttaggggagtattgaaagaggaattgtatttttatatgcatttttcccactgtattataacaaaaagtttgaatttatgagctgatggaaaaaaagtattgagcatagattcacacccaagaagaaattaataactcattttttttaagaataattttggatcttctcataacatctctttataattttcttcattggaagaaaatatgcttttgatatttgtaaaatattaaatatgagaagtgtttgcggcgctctcgatttaaatttattgaaaattaccctcaaatatccccaaatttggcaaaacttaaaataaaatacataagctcttgctgagattattattggatggtttataaaaaattctaatttcctttctctattcaaagttgaaaattataagtgatgattaaaactctttgctgagattattataaaaattaaagtactatgtagttaattttacttcctggaattttcaattaataattattactttcaatttttctctctaaagtacatgttttactttaaactaatgacccactatttaagcaaaagagaaactgcacatcgaccatggaatcttgtttgggagcttcaatttattgagaagagcatcgaagaaaagccatcctttcactttcaaatgttgaaaatactcagttttctggaaatgaaaatctttacatggacttactctttttgagttatataaactataataataatctaatggcacataatcattttggataaaaaataatattatgtcacgtatcacgtatatttgagtaattatttaatataaaatgattatgctttatttgttagcttagcctgcatatcttgcctagccttttgaacttgagtaggatatcttctcaagcatattagggctaacatttttagtaacatttttagtactttataataaaaaggtcctccgcataattattattttaggatctgaacattaattcttttaaacaggtgacatgggtattataattgatactatactatgagacggttttaatttaatggtcttaattggttggaagaactttatccttataataattatatgctgttcaaatcaagttagttggatgcctaatgtgatgcttaaatgacaaaaaaatcagatcatatgatttgttttgaaaacaatagtacatggaccacaaatagaacctgacaggagtaccaataagggtttgatatactaatgaacaaattagacgatttatttaagaaaaaaaaagttcaaataaatcaatgtcctgtttggataattttttcacaagtactaatagaaaaagctgtggtgataagttaattttaaattatggaagaagttcaattcactatttcttaatttcttcttttataagtatttataaagaaatttaaccaaaccttgaagagttaacaaatagaaggaagccttaattttctctttagaaagtttctcttgaaacttttctattaaatgcataaatcatttgatataagacttataatttaattaatgatcctaattgataggaagaaccttacccattataataattctaatcagctgaaacttagttggttgtccaatgtgatgtttaaatgttcggatctagacaaaaagccagatcatatagtacattgaccaataataaaacatgacgcgtgccaatatctaacaagagtttggtgtagtaatgaacaagtcatacgatctaaaataaagttcaagtaagtctatatgaaaatatatctcaaagagttaacaaatagtcaaaactagaaggaagccttcattttcttttcagaaaatttctctttgaaaattttctacttgtctcataattgggacatgttttactacataggagttaaaattgatggactttactatatatatatatattaaaacgtaactcttaaactatactaattattgccacatcctactagaaaatcatttagacatactaatgaaattaggaagatcgtcaaatttactctggaaatcttggccttttcttttcttgattgcttctatatattcccatcattcttgacagttgcactatcaacttgagtttctttttgtatgatttggttatcgtaatatccgttggttggatcatagtttgggctgagttatattgggcactgtttaccgcagtagaaaaggaaaacacgcatgttactacattgccatatataacaaacaaatatctaattcatcttaactaattaaaatagttaaattaattaattctaattaataatcttataaatttaaattttcgaaaacactcattgaattaaatgatttaagagatggttgtatttaataatactattcatttttctaagggataattttttcatcaataagtatgacttatttcattaatagtctttataataaataatggtatagaagaaaatgaataattaatgcattcaaaaatgatttatattttagaaaaaaatatatttttatttgttttttatatatccaggaacggaggtagcatgtgacatgacacttcctcttgcattaggattctttcatgttgagggaaaagtctagttaaaatattgaaaatagaaactagaaaacacttaattattctttgtacatgttttttgatgctatgtagcctattaccgttgtggcttttagaaagaaaaataactaagaggcgggatcactcaaatattgaattggaaaaattaatcattattcttacatttacacaaattttaaatacttttaaatctcttttggttcctttcgatatataaattttatcttttaatctttgatattttgtaacgaggctaaaagaaattcaaaagtacttttacatggactgaaaatgatgatttttacgtgtaagattacaagataaagtttgtacaacttaggggttatatataaaagtaatttttcctattaaattggtacataatggagttgtagattagtcaatagctttgctgttcaaatactgtcaggattcttcccacatataatccttctcaaacaacctcttttgactttttatgaggccctagtgagttccttttaagggctagcataaaattgtaggggcagttcctgaagaggctagtggtcatattgtaaaagttgagcaaaatctatggtgcaagttcaatggagctttatgaaactctatatggagtatggctgctatataaacctagctgaaaagtcattttgtaaatgaaaccaaactcaatataggcgnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacatataatgtgaattttggaattgctcagtgttcatatttcttaacattacaagttgtaatacacgtgttactaaaataaattctcttttgttctttggtgtctttggtttgtaggacttgaaaatagagtactagcagcaagctgtgtcctaaagcttgcttttgccaaaagggatgagccggcgttgtcatcaagtgttggtatttcttgttaacgttggatcactcgaagtcattcaattacatttagtatttggatatatatatatgcgtgggaaatcattgtgtgtttttggagaaatgtaaaagctacttgattcaagatattcttttactttctgcaattattttgacattattgtctatactataaatagagaaaagtgttgtccatcaggacactaaatttctaaacaatgtctgatttttggcgtttattttatttagaagaatttttaaacaaaatatattaggtaatcagaaaacaaagaatatttttctttttcaaaaaggaggtgtcaaactccaccgaatagttcaacaaaaaaaaaaaaatcctccgaattgtgagtgtctcgcatgtgcaatggcaatgcaaactgtaagctttgtcataaactcttagctttccgcaaacaaagcttcaaatgtttcagacttaaaggcttacgtagccactgacgtaaaagtaacggcaaaaagtgtgatccaagcattgaaccggttcattgaataagttgagatactcggttaataagtcatctattgaattggagttttacttataaaattgatatatattaaaaatattaaaaaataaataacaatttaatcatttaatactctaaatttaaaataaatgttattataaaatacttaatatctcaaataataattaatatttatgtcaatacaagtacataaataagtaacaaacaaaaaaagtattcaaatatcttaaaaataatcatatgttcacaaaaaataacataaaaaagttcatattttttattttgaaaaaagtacctgattcaataaaaaatctacttcacttcaataaaaaatccatcctaattcaaccaaagacacacttgatccaacctgatcacatcaattatgatatattttttatcctcttaacaatacaaaccggtgtgcctattgggttccaacctatccgattattaaaacaatgataaggagcataggaaggagaaagaaatgaaggtagtttgagagggggaaaatcaaagaaaaagggagtgcaaatagcaacagcaaaaaaaaatgtgttatttataacaataatttacacaataacattgcttgtttcaatattttaaatcttatatattttttctcttttcgttttctcttaatagtaaaaattattgtaccaataaagattcctcttaaaagaaatgattttctaacttttttttatgaacaaaagaaaaatctttgcattttaaatatttaaatatgaattaaaaagtaatcaatctacaattgtggtttcaactttaactcaaattttgttaagtccaaaactcaaaaagatcttcctaacaattttggaagactaagaaaaagctaaaagaacttaaattatttactactaaaaataataatcagataatggctagtatggtcctttacaatttaatgacgttatttataattgggttatttaaaatttagatcgaattagaataaactatatatctcattgtccagaagcttctctcgctatgcaaaggtaagatggaagaatattgtacacagtcttatccttgcatatgcaaaaaagctatttccaaatacgagaacccacgatcaacaagtcatcaaagcacaactttagcactgtgccaggactctttaaaaattacgtatctcattgtctaaagactcattgctatgcaaaggtaatgaggaagaatattatacgcaaccttatccttatatatgtaaaaagactatttctagattcaaactcatgaccaacaagttatcaaagcataactttaaaataaaccaaaataaaatcaaactacaatttcaaactgaacccatattttttggctggctaaatggatcaacctatcaaactcaacccattttcacaactcaattagggagtttagttacatgtcacttatctattgtacccataagttgattatttcttctcattttagatatataggggtttgctcagctcatgcagttgaatttgtggggtattcttaaaagtcaggaaattgctgagatttagattctggaatattattgtggacagtgactgctgaatagctacacttagctcagttgtcttcctttttgaagaacaaaagcataagttctagagaataaataaaagacttaccataatgtaacaaataacaacacataatgatgcgaacagagtagatggcatggcgaatctagagaactttgttctagccctaacaaaatcatatatcttatctcaaattaatcactgaagttatacaaatgagtcctctaactcctatatatttatttatacagctacctatcacatatatcatggacttaaattatgatgatatatggaatattggaacatagtttccagcggttcatgtataaggaataccattcttcatgtgctattttttttaaaggaaaattaaaggtacatgcaatccatatgtctttatatggttaatacaagactctaccacaacgatcacatgcactagaggcaactggagcagcatcttttggctttgtcttctgcaactttggtagatcaatttccagaacatcagccagggccttggaaccttgttggatctcatccagactgcaaacattactttaggtcacatcctagaacaacataccagagaagagaaacttgcaatggacaaagacactagggagcctttgggatctagtactcccttcaatcttgaatataagcacacaaaaaaaaaacttacttatgcttattaaaaatgttagttagcatcatttaattgtatcattctcattttaaaaatatttttttccctaaaatagccttccttggaactttataaaaaatgaaagagaaacattggaaataacctcaattaaatgaacgatatttgaggaatgatctcattaaataagataaaattacttgaaatttgtttatatttgagaccaacacccaagacatttttttgcttctatttgagactagagggtgtatctaccattcccagtaatctatctttgcttccaaactccaaggatcataattaatctacataaacacaactagagtaatgaatatatgcttgtgttagtttaggtagtaaagaaagacatatcttataaaagaatgagcatatatttcagccttaaagtttccacattagtttatgactttatgatgatcaataggccaatttgatactgacacaacacacacatactctcacttgttttttaaaaggaataagttcataagttataaattgagataagtttgagtactcccaaaggtgtagcttgttaagatattcctcaaagttataaaaccttagctttcactagcttgaaatttgaaaatcttccaagttattctccttcaagccttctaggatctatcaatgatacaactttcaggtgtcaattgagaaaggtatatgaaggttaatttatcagaaagagaggaagaggtaggtcattgtaatacatagatttaaacagcattttttttcaacaaacaatgaatgatcaagaaaccaggaaacttgtaacattgatgattgaagaaaatcacaaaaacttggttctgcttgataaaaatttgaaaatattaagtactaatgattggctgcggtgagacaaagctatacttcaactgtttaacaaatttaaaatgtagtcccatattcccatgcctgaatcaacagaaaataactaataatgtgtacaacacagacactcctcaattcaaccattctattaatctgattttttctttacttgtcagcagattttttttttctatttatgttttatcgtgtatgtcttttggttatttattgatcatagtttggcttcagtaaaatctggactacacagtaatccagttttcatttccaataattattctaatatcaactaataatttccaagaggcagaactttaacataatgtaatgataacttgatataaagacattgcttcttgttttcgtaacttaccttatgcaaagtgggggagtaaagcggataattgtatcatgtgttggcttggcaaggactcctctatacttcaattttttgcatagctcatagcccgatacaggcaacaaattttttctgttaaactccactccaatgaacaatcctcttccccgtacctccttcatgtagtctgggtattgctgctgaatcttaagcagctgaccagcaagctcctctcccatttgggcagatctgttcaatagtaatacatcatttgcagattttatatattaatatctcagagaaaaattcacagtagaaaaaataaatgaaccaaattaataaagcatttactgaaacatggaaatttaaagtttgaaaggattcaagtcaacaaaagctagaaaaacactcaatgctagtaaaaagcaaaataaaaaaatttagaacataaattgatgaacataagctctgtaactcaagttctgaggggggggactgagtagaaagttaaagggcttagaaagaattattaattccctacatttaaactttgttagcaaataagtacctcaggatctccaaaacttgtattatttagtaacttcaaggaacatcaatcttttttgcacgccgacgcagttgttttgtaaacatggtcggaaacttgtaaatggggcaaaattagaaaatacaaataaatgatcaagccaagtctaaagagttgtggttactttttcgggaagggtgaggaataggatctgaaacaaaaataggtactgttggaagtgcaaatattcaagatatatgatgaatagaagtccttaacacaggacatcctaaaaaaatnaaaaaaaaaaaaaaaaaagatacacaacaggatttgatctaagttactgagatttatttgtaaaattctctgaaaagcacaagaagcatggagataagttctcaatcatcaataaacaaatttatcccaatataagaataacattatatttaatacattcaactcccagaacccaggccttagttttgaagcttttatttcacatgctgatgatgcttgatgaaatgaataaaatatacttgtcgagacttgtatttaactattcaagtctgtattataataagtatgtattggcaatataagatttggcaatgcatttgatacctctcaacgagtctttcattttttatcacttctagtgaggcaattgcaactgcactggccagtggatttccaccgaaggtactgtgaacaataacagagaagaagaaagcttcagcattattagtcttagctttcatactttaatatcattgaattgtattgtactaaatgaaattattagctaattacataaacaagaaatgaatgcaaaactaaaagcaaaatttcaagagtacacaaaggatggaatttttttataaaaaaaatagcaattgaaagttcttaaacgaagaactcattttaataagaaaactgagggctgttgaataggttcatcaacctgtagaccttccatcaaataggaaatgattataccatcctagaaagatcaaatattttctttaagtgcattgaaataaaaatagccaactatttaatgtgctggtgatgctacagttcctgtcctgaacgtaggtgtttacatccatgatgactttgcagtggaacataataagaatcctaccacaataataatcccaatattctaatactatttatctttattttcagatacttcctaccattagaacttataagcacagataagtacaatatgaatgaccaagccagtgtttgtaagaatcatcagctacaaactccaaagaatcacttacgggaatttacggtgcagtaaataatctcatctcagtcaattgtttctcctttggaaatataaatggttctgttcacagatagcttttgcaaatggagtagtctaattttgtcccatgatcctatcaacttgaacagaactaacatccctaacccaaaataaaataaaggcttaaatgcagttttggtccccctattttgctcaatccacaattttggttattccattttaaaatagagacatttggtccctatgttttaaaaatccgcaattttagtcccaatatttcaaaataaagacatttagtccttttattttagaaaattcacaattttgatcctcatatcttttttaaaaaaatagcaattttggtacaacttcaattttatctacattttttttcgtttatttcttacattataattaattaaatcattttatgatgataccttgaatgaatgttaggtctaggattcaattgtatcaaaataaaaaaataaaaacgtaggcaaaattgagaatttgacaaaaataaaaaaatttataaaataggaagtccaaatgtctttattttgaataggggactaaaattgcaattttttttaaaacagagggaccaaatatctctattttaaaacagagggaccaaaactgcatttaagcctaaaacaaactatatactataagattccaggttccaacagaagggagaattctgtctcttcacatgatctgacaaataaagggatttaaggatgaaaacagatgtccatcataatccagaagtttgacaactataggcaagaaaatgctaaacaaaaggagcagattaaaataaattataaatttataataaaatgaaaccttccatgctgtccaggttgtatacaaagcatcacatctttgtctgcaagaactgcactaactggtataactcctccacccagtgctttccctagtatctgagagaaaagacagttaaaacagttatgcatggtggtatcgaaaggagatagaaccttaaaaaaaggggtgtgtgtgtggggggggggggagtttgcacgttgcagcagaggcagtaaatttctcattttcttgaaagaaaacacaaagttgggtggccaagtctttcaagtggaaggtagtcgtatgcatctaaatccctgcatacttggcaagtgcaatggcaatttctatgattcaggcatgttcataaaatatatatttataggaatggagggagaaactatatcgattttgactaaaagtatatatccaaaagattttctgtcataaagcaattttttttattaaaagcattgagaaactaatccaaacatggtattatctgatttatcagtcaaacacaaaaaacataagcattccaaagaatgacatcatatgcttaaaagaagtatggtatctatggaatcaactacacatgcttttttcttgccaaatagtttcggtttcaactctaaaatattgtttggtatatcaacgagttttgcattgactgccgagggcctaacacaacctcctcctttactcggacttggaaccatatatgaaaccataggtggagttcctggatctaaattattgaagggcaacaatgatcacaacagttacctatagattttgttaaccctatgacgacaggtaatgtttatatgaatctagagatataaagtactcaagaagtaaaggtggtttctaaccacaacatctgggcgaacttcttcccactcacaagccagcatcttccctgttcttgctaacccagtttgaatttcatcagcaatcatcaagacgttatatttggagcaaatatctctaacagcttttaaataaccatctggaggaaatatcacctttaaacaaaaaatattatatattaaaagaatgtagagaagattatatactttgagaagaaaaaacataataaaaaatgtctacagaatgttatagccatcctgcaggatgagtgatatacaagggtaccataaagtttttcttttaaaaaaaaaaattcaaagaatttagaaaaagcaatacaaagtacatattgttcataacattttacaccatatagaataaaaccagttggcagattaataaaatgaagaaaaaaaacttaattgcactttttacccccaaagtttcataatgtcttgaattttgccctccagtttttttttccaggaattttgcccccacatagaataagcaccagaattgatgaaaaaattaccacaaattgtcttaattgtggcagtttaaaggaaaaaccggcccaaaatgtcttaattgtggcgatttttctacgtggggggtaaaattcacgatgttttgtaaattgaggcggcaaaattcgtgagaaaaaaaaattgaggggcaaaattcacgacatttgaaactttgggggcagaaaatgcaattaagccaaaaaaaatcattagattagattagaagaaaaagaaaaggcatttaaatatggattagcaaaaagaaagcaaaaacacccaaaacatataaaaaatgtcaagttcacttgacttttataagccaccaagaacaagtaactatgtttcatcgaggctatcatagttcatacataatattttacattcttattaggaaactaatacattgttgcacgaacgaaacaaaacatacaatgacaggaacgcagaatgtcaaaaacagctcacttcacaagtccaacgaatataaaaaaagtaaaaaaaaaactatgtaccccattgtccggaggctccacgctatgcgcaggtaagggggaggaatattgtacgtaaccttacccttacatatgcaaaaaggttgtttccggattcgaacccatgaccaacaagtcatcaagacacaactttaccgccgtgtcaggcatgttctatgtggtattgcaagcaatagaacgtctaaacattggtagattatcttaaaaacatgacttcattgaaaatagaatttgtggtgtgcttctaattcattatccatgtaaatgaaaatgtcaaaattgctgtagaaattttccattctagacatgcattatgtattttactaaaactaaaacatgcaacatggaaaaaattctaactgaaaacatacatcatcagtttttttgtgtaactactaacatcagtaaacagattagagaaagagaaagagagggctatatagcagcttccttatcatctcaattcaatcaacacaaggttggcaagcccataaatatgcacttccataaaacttaccccagcttcaccttggataggttctaaaataaatgcagctatgtgttctcctttttctgcagttcatagagaaaattcaaatagtgaactccaaagatctgtcatgataaagcaaaccactgaagtaaaaagtatatggcggcacagtgcagaacctttaaaaattctttcaagggcttctgcatcaccaaaatcaactttaagattgccaggcaataaaggaccaaaaccacgggtagcttcgttgtcacagctcaaagatatgacacctagtgtacgaccatggaagcagccacaacatgagacaataatagcctggaacaagtgtccatgagtaaaaagattcatagaaaaaatacctgaactgattctcataaaaattaaaaagaacaatccaaatagaatagcaacaaaggacagatgcttgtgctcaaataaagaaaaataactttcaggttgtaaaattgaatggtaaattactgacattatgaacagacaacaaaagtagaaaaatatataaataaatataaactgttaaacttcctacatcatataaaacagaaaagaggatgatataacaaattttctacattttctctttgtaatggaagaataccatatgtttaaccataaagaattatacatctcagatgcatcttgtttgcaaaatcttccataagcatatgtcacttgatgcctcagtcatacttaaaatttattccttcaagtgttgtcaaagttcacatcaacagatgcctaagtattccgcagataaaaaaataatagataattagatttgtcaagtattctggtttcagtttaatgtatccttaattgtattttccatattaatggtcaaagctttgtgaattggacccctctgtatctattttaagctacacaacattaaacatggactcaaatggtaaacatatttgaaaacgtctaaactgctatagtacacagaacatgtgaattataagtttttgaaaacaagttaacattataaaaaattgcgattaaatcactaccaatgcccatattaagcaaagatttagttggacccaacattttgcaaaattgtaacatatcatgatattacaactattagcatgcatcattctcatacttatacctcatctttgggaattcttttcttttcataaccccactttcgtgctaatttcagtgctgtttccacaccttcagcaccagtattcataggaagtaccatatcataaccaaacatgtttgtcacatactcagcaaagactggaaagcgatcattgtagaaggctcgagagctcacagtcagcctttctgcttgttcttgtaaagctttgagaattttaggatggcagtgtccctacagcaaaatgaaaagcacttagattattagaagttcgatgccatttgttttcctaaaaatcaaggaataataaaaggaaaagtagtagcaacagtagaagggatctggccacattaataacctcacaccacaaaggaaacaaaaaaaaaaaaaaaatgtatataagcattattattcattagggcaccattctgaagaaaaaatgcagatctagagcattgggaattaccaagatacagtcaattttacctgattaacagcagagtaaccagatagaaaatcaagatatttgtttccctctggatcccaaacagaggttccctttgcttgagaaaatacaatcggaaggggatggtaactgcatttgagacaggaaagatcacttcaatatttgaccaaaagcaattaattaacctcattaacaattaacaatcaatacaaaagaaaagtgtgaaaagaaaagccacctaaacaagtaaccaaaagaaagctatgttcaataccaaccagataagctgacagccaaaaaaaaaaaaagcaaatccccacaatccttttatttgtaaaaatgctcagaagagacaccaactgtgaatatttactattgagagtgttttaaggaagcttcaggcataaagaaactggcaaagtgttgctggtattttttttatgctcaggtgatgaagaaacagaataaacatgattgcattaaagtacagtttttggaaggcactttcagcttactactcatgattagttttaagttttctttttaattatacaattcaaatattccaatgaatgattcaaaaacttatatcattcattcaactcaccaaagtttaacccgatccaagtgggacaacaacatcatcagatttaaacatgaaaagttagagtcgagaaaaaataagacaaacccatacatcaaaatcttgtctttggggcgtagcaacatatggcctaggttgagagaaggaaagaaggagaaacgtacttgtgggcactatgttcatattccttgtcgatgattttctgagaagaagatgaagaagaagcattaacttctgtggcaaccccaaaacttctacttcccctgcaaacccttcgtaacaaacactgcaccggtctcgtggcagccattgatgagagacaaaggttcctcagatttttcaggattcaagcgaatgtaagatgaaatgaaagtagcatgttttaataattgtcaccctctctgaaatttttttgtcaaccaacatgttttactatattaaatatcaaattaaatataatatttaaacatcaaactaaatatccatgatagtatttattttaaatttttatggattactatcctcttttaattaattcacatctttcaaaaaatactaattaatttaattaataatattaaatataatagtaaaacttattatctttctattcactttctacttaaattaatcaatgtgtattaattttattcttcaatttttataagagagaatacattattttttaatttataactttttattataaagtaattaaaaatattttgacaaaaaaataattaatacaaaaagataacataaaaaatattatatttaaggaaaaataaaacaaaaaaattatatttgggaacaaagtagtataaatttaaaagaaagaaaagtaataagataggattaatgttctaacagaatttaattaaaatatattcacaaaataaaagtattttacactattatttacttattttataaatatcgttaatttagttttattaataataatctgaaaaactatattaacaaaattttcttattacttaaccgtataatatatttttttgtaacgacagtgcatactgcatagtcatgaaatactaaaaattataataaagaattttatttttttttgcaatataaagtattttccattttagaaaaagtgagatgagggagggaagattatgatgcgtcagctgtgggtgtcgttttcgccaactttcaaagcttatcagacggcctcgaattcccacatgtaagtgcgtgtttgtgtttgttcgatcaaaagtaacaaatggttacttctcacaaaatgacagtttttaaaatttctgccaactgaacttaatgaaaatacaaacacataatatgttactactatttggatcatgtctggatctttgttcccacttccatactccaattggaatattggatttgtttcatcaacggctcatcgatataaatacacagccaacaaataccacgatacactgtcgatcgattcactttgtagtatcttttttatcatattaatgttgtaaaaaaatgaatttgaaagcataaaaaaaaaatctattttcatttgataatttaaaatgctgtaagaaatttataattattcactctttggatcattaatcgtaacctttgacaattgttagtcatcattatcattattacgtagaaaacccactcttgatattttttaaatttatattatcattctatcgctttcatttttttatcgcatagttccatctccacggccatcaggttgcgtacacgtataaaatcatacacctgacagcctacttcaaattgctttctaagttggatttacactttcccgaactacattacaaggatatcaggatatgcattataaataacgaaaattttgcattgcttattatgaattttaatttttaataacatttacaaacattttaaaaatgtttaatacattccaaaatataaaaaaaggagaaatattgactctacttaaaatttaattccattgacgccatcaataaaataatattattacattcacataaaattatcttgataatgattaaaacttaagaacaaaagtcagacatcgctatgtcgttatttacatgtttaaacacgaatcgcttcggagagtagaggagacggtattccacaaattcacaattttatatttctccatcataatgagtaataacagccataaagtgttcacgaccattcaaactataacataatctcgtggtcttgtggaaataaataaacctcgatttatatatatatataaaaaaatcaatctttcaacaagttataatggcctcctcaaagaaaaaaaacaagttctaatggcacaattgctagtgaaaaataatgaataaacagggtaacgaatgagaatagtgaactggaaactagtacccacaccaaatcaaagatttaactatcacactacaatacattgcttgcttaccaatacgaagccgcgtacaacttataataattaatatgattgtcatttttaaagattttaatttgatttttcgttaattgaaagtcaatatcacaaattatgtaaaagattgatgcttatataaaaaaataatttgtgagaagccatcgaattgattagctcaaatcaaggttaaccatttgcccaaaaaaaatatatgcaaaatcaaagaaattgcagcgccaaacatatactaattagatgaagttcaattaaatgtaaatacatacgcaaaaaacatcaaagcaactgtcttgaagctaagctgtatatacaatggaccatcatcttaaactacttaatgtgcaccataaatcatatacaaagtgatactctaatattaacttcccctacgttcagccccccaatgaaccatactcaaactaaacctccagcataaaatgtctcagtgcagaacattatcaacctatcaaattatatccattaaaaatcaacggcctaatgactaaactcaaactaaaccagacatctttacttaagagaattctagcagaaaagctaagggggaaaagaatgaacagtattccgtacaggatcaagaatgagggtttgaaaatttcggaaatctgagctagctatagaacaaagggagaattgatccacatgcatagtattatattgtattttaagattcaaaagtattataacgaacataattgtgctgagttcattgtggagagagttcaatagatggctaatgaaaaataaagaaaatttgtactttaaatttgctaggaaaagcgtaagtttgacattatcccagagaagtatcaagttaatagcattgcatataatagatagatcataatggctaatggaataaagaggtccgtcacatttcaaaaaagggaaaaggagttttgagcacactgatgttgcaactagtaatctggatgagagaaatgtttcacaagatggcagtatggatacaagggaaatgtttctggaataagatggatgatttaatctagttgcatcctataatttagtcatataaaaaaccccaagctattgcccacaaatttaattataacttgagttgggtgaaatcaccattagagcagaggatgttatccatgtcacggtaactataatccaaatttagttggaatactaaatattatgctataaacaggaaaacaaataagccagaaatggatcaaccggatcattttataaattcaacagcccccttcatagaatttaggagatcgagttaaacaattctgaatcatattggaagagaaggcttgctacattaaaatgtgacagctagcaaacataagatgtggctcagatgacaaactgagctccgtgtgaacaaactttacctccagtgcagaggttcaaattccactggagatatttagcaaatattttcttgtgattgacatccatcacaagtcataagaaatggaaagcatgtacaagttccgaaataaaatccagaggcttttcagataatatgcatgagttgtgctacacaaccaaaaaattgttagaattctcacattctgttggatcaagacggtaataggagaccattcaaccatccaagagtcaactcacgattcttttctttgttcttaaatgtcttatgttttcgttatatgccaaggaagaagaagctgtatcttcctactttgtatttatcttctgtcttaatattttaaccacaaaaaatatggcttctagcatttttgtacatcatgtttggtgtgacaacaagatggttatatgatatctagctgtaaatgtcctcatgcatgacagaattacaagatatggaaatagaattagggcgatgaaaatgatccagggttttccgaaatcctttgaattcatgaggcaacttccccacttttgaataaattacttggataaccaaggatacgagaaagcacagattgctagaggcccagcatctcattttgcatcaatagggaagatattttcagcaagaaaggagaataagagtgagccgtcagaaacataacaaacaccgttttatggttccacagaataatttatggagatagtgatgactacacactaatcaaagacaagcatcatgaaaggacagagagatcctagatttctaagataaaacccagatgagaatagattaagaggaaacaaaaggaaaggaattataattcctacatacaaaaccagcaatggatcctcaggcacggtcctgtagccactggtgtggaagaagcaggattcaacctgtaaaaccctagagaacattgtctctccaggaccaacctaacagaataaggagaggaacaagaacatgcttcaagaattaaacttttcaccttcaataccccaggaaagaatttcaataattcaggttgccattataaaagcctggatcaaattttcagcagcacgcttttgttcaggtgtccctgatataaaagcaatacgatcaccacgagcagatttgttgtcagatatctcaattgatgctcctgaaatctggtttgaaacaaggcattaaataggcacatcaaatgaagcaaagtttgtattagttttacctatatgcattggggtatgggagaataaacaaattatcatgggtatgggagaataaacaaattatcataaaccaaagttgaatacagtttattatgctaactaatctagcccctgacattgtatagaacattgtatactcgagaataaagtagcataagcaaaggaaaatatttcataaaatagtttgcatagaaggatctcattagatgtcatcttgtaaaatgataccatggcctagcaaatgtgaaaaaatggaaaaaggttgccgatcaaagactagggacacccttaaccttttgtttcctaattagttacacatcactaattgttttagtccaagacaaatcacttgatatgattaaaaaaattggatgtccattatctcctacaaataactggactaaatggaaccagtgcaagtgagcaatcaataaaatcactcaccaccaagaataaatttaaaaaaaaaaaacataaatatatatatatatatatatataaaatacaacctagccctatcctactgggtgagttggttagatggatcaatcaacaacaaaatattcagcaaaaccatttagagcctttccttttgattggatatcttctaattgatccactttactcactgaaatgcacgatatggaatttttaagaaaagcaattattttaagcatacagtgaagagacatacagcagcaagaaccaaacctcaaattagtttttaagataaataaaaaataatagataaatgtcccatcaaatattagttccccctgcaattacataaaagaataaacaattcagaatgtgtgaactaaccttcctgatattggctatatttgcccctcctttacccagcactttaccaacagcattagcaggaatcaacatatccagagttgatgggggaggcaaactgtgtacaataagagaaaaaaaaatacaagttcaaccaatttaatacaaagtttaggaaagttaaatcggagattaagtgcatgattgattacgcccaaatccacgattagactttagagggtaaaattgtacaaatacaaatacaaaccacaattaggaaaattttcatcctcaattcgacgtgttaggcaaaagtccagttggggatggcaaatggaatctcattctcaaaccatggtttgggtgaaagtgagagtttctttcataggattgggaatgcacataatcaaaatattacttttaagataaaggcatccaaatataaatcactcaactgcatacccagttttacaaaagtcgggttcatccaaaatgagtttagcaaattccaatccaaacaaacactaaatcatcagctataaaagtgttcacatcatatataaatgtatgtatactaacctgccatacagcttggtggcatacgaggtcatagatccatagccattttcctccatctattacataggatcaaacaaagagagaaaagattagtgacacaatatttgaaactaaaaatggaaaagacatgaaaagaaagagactgaaaactgttcattagcattctgtattagaaaaatagaaaaatatatcataatatacctgcaaaaaattatcaatattcttatgaccatacagcaagaaaaaatgtgacataccgataaagatccatatccaccataaagactgcttgaagaaagcatgcccaggccagctccactttcagccctatgatcataaaccatcggagcagtaacaggaggaactgaatgcatcatagatggcaatgaaagaccagcactgcctgggtacaaggattcagcacctatcaaaggattatggccagtatccctttctctcagtacatcatctctaagtcttaagataatctggattagtgcatcgctcacacaatcaactgagccacccacctaaatcccaaaaaacattgaatgaaataaatatgaaagttggtaaggggtatcaccgttgtgaatgggttttcatgcatgaaacatgaatgaatatttttaaaagaaaataattgtcagttaccatttacttttcaattttgctgtttacctattaaatcatgattggttgctttttaaagaatcacaactttcctataaaagctttcattctaaatagaattgctgaataaatatactgtttaaacaaggagagaaaatgagtcaaacctcaacaagttcatcattagcatctgcacattttggcttatcacctttagatattcgaacatcagccttagttctcttccgaatttcatttatgattgaaccacttttaccaataatacaacctatcaccttggatggaactagaagccggattgaaacagtggtatcgtcttcatcatttatcttcccttgcatcagcagaacagcttcaactgccattgacttcagatcacttggtgactaaaaaagacatatccacatgatcattatccattttatgataaaataagactacaagtatagaatcaatatgttttggaaaaggatagttacattatatgaaaaaaaaatagagaatatgggaacaacaatccacaagtaaatcaaacataaaactgaacttgctgtacattaaccatattagccttgggggggaattacttcagaacataaaagttgtgacaaaactgtatacttaattgccacctcacagaatgctcaataactattcacatgcctgaagttattgtattttagctttaaaggcacatgtaaaaatatgatctgccaatattttttgaaaaacaccctttgtttccttttccttgtttctttccggaatgctgttaacaagtataagtgttgacttcctaaatgaatatcaatcctcattattgtaagggatggcactgcaaagcacaaggtagttgactattaacaactatagatctaacctgttttaatggatgatatgcatgaaatttattacagcgaaataatagagggctatgtccatgaaaataaatttgacagtattcagcaaactagtaaatagcaacctggccaagacagattggagataaacttgatgtaaaaacgttaaaatgaaatgaaatttattgtacataattctgactataatttgtagagaaaacacaaagaaactagggatcaaacattttgaacttttaaaatgcaaaagcatatacacaaagcttaacacaaatcactcaaggtcctgaaaatcaagaatcaatcaactcatgacttcataatcaagttttaaattatttttctgttttctgattattgcatataattttgagaaatataactacaaaaataagtcaaaaaaatcattggtaaatagtaagggtcaaagctttcccagttgaacagcaacacacatatagctttgattatttttctctcaaattttttcagcccaaggcactctagcattttgattatatactgtccagaaacaaaatatctaagctaaacaaacacacactagggtacatcatgaactccatcaaatgcaacaccgccaacaattattggatgagcaattttatgttataagaaaaaaaatgtaacaaggaaagatagtgcacctctgttgtagttataatgattaaacactcatcataattagccttggaatcatcaacctcaatacgagcaccacttgcctgcctcatacttttaattgtactaccacctttgccaatgacacgcccaatcttgtcagagggacacaacattctaacaattaactcctcagaccgggaagcaccaacaccagaaacaactggaagggcagatgagtacagaggccatgaatttcctgcatcagcataaccttgcagatctggtacatttgttgtgcctataatttgaggaactgctctagatgtgacaataggatctgaagctggatatagtccaccaggaggataaattggaacatcagagggaataataatactgggtagggcttctggtacagctgtgtcaagagagatgtcctccctgggaccgaacttatacataatagatgaaactgcaaatagtgctcttttaactgcttctgattcaccagtgatctactcatagaaaaagcaacaacatagtaaggaataagtttactgcaaaagaacttatcttgacatgaaaaaaaaatgattaaaaatatgacaaaagatatagaaatttcagatttttctaaaaactaaatgcaaaaggacaaacaagtacgatactgttaaatgttaaataaaaattatcaagttcaatgtgtacaattagaaagacaaactgtaaaaagacttctacgccaatacatagtacgatactaatacattattagtaaaataaagtattaatattggcatgtgtcagagggtggaggattagatgctactattctaatcagagaaatgattacgaaccaaagcaataaatcattcaatgctgagttttataatactcaatatactaaccaagacaaaattatcaaactccatagcacatgtgtgtgttggatcagctgcatccttggcagtaaccttgatatttgctcttgtcttacttctcagctttttaatggtagccccagccttaccaatgatatttgcagactggctagatggaacaaggatttgacattcatctctatcctttcgtttcttctcagaatctccaagagctgctatggaattcacaatggcaacgtgaacctttagaagagcaccttgggcagcacacagaggttctttaccagcgaactcatcatcaatctcaacatcttccttctccttaacatagctgtagattgttataacccgatccttggcaccgggaaaaggatcgacaaccttgactttagccctggtttcttgccttattgaatttatcactttcccattcttcccaataacactcccaataacttcatctggacagagtatcctataaacaatcaattcatcattgcccctgtcatctctgtcagtcattcgtctcttttgatttttcctgtccccatcatggtctctctgtgaatgatatcgttttccagtctcccccattttacaaaatatcacccaactcctgaaaagcaaaacacaattttagttacataaccagtgcaaatatatacttctatttgttagtctctgaccatcctccctcccttattccccttctcataaagaaataagttaaattaaagcaataaatatcacacctgcataagcccacttttaaatattcacaacgaaacattaatacagccaaattgaaagttgaaactgctttcaaattcgacagtatcttttatcacccaaagtgcgaccaacgagcacaaataattagtgcagcaaaatttggacaaaaaaaaaaatccacggaacatttagaacagagtaaaacggagttagaattattacaaaaaaaannnnnnnnnnnnnnnnnnnnnnnnnnnnnnnnnnnnnnnnnnnnnnnnnnnnnnnnnnaaaaaaaaattgtaacaaaattgtctcttaatcaatttaagccctaatttagttccaactaaaagaataaataaataaataaataaaaatcttgaaaacgctgcaactgaacactgctacataaggaaaggaatgcgggatatagggtggatgtgtcaaaccgaagattttgaacataccggttgttagagagaacaagagaccacacgaaacctaacgagagagaagaagaaggtgggtcaaggctgcgagcaatccaggattctcattctcggaaccctagttttaacgttttctcttcacaatgatttgtttcttttcttttgatttatttattttgaataaataaataaataaatattcagaaattaaaccggtaatatttttgtccaataattacggcaattaactttaaccagtctattagtgagataattatattttattttatataaaataaataataaaataataaatagtttaaatttaaaattatactgatattataattacatttttaattaattaaatatttttaaacatatgatatattttagatttatagtaataatacatattgtgatataagtttattttcttaaatcaaaatacttaataggatcggatatatttatacaaaacttctcagcacacgtaattaataaatgataatttaaagaaattgaatttcaattgagaaataaaaattaaaaagatatattaaaagnnnnnnnnnnttaataaaaaatttaggttataaaagatattgaatgttaaaaaaacagataaatttaaatattttaatctattaatctaacccaatctaaatcatttacaaataaattaatttggtttagtttttaatttttctcttagaaaactaatcaaaacgaattcatttaaatttaattagattgagttacatacttcactaagtctaacctaaattgatccacatattgataaaaattcttcaaattgatgaaaattcgtgcagtgtgattgatatattcttaagtacagctcataaataaatgttggatattttcttcatttcataataattattgtgtaagaagataaaatttatcttaaaataattattattttagttttctaatttaacagtaattattttttttatttatatatcttgtaatattaatgatattgattaaaaaaataaattgaaaaatgataagcttaattttgcaataaaactataaaattttaagaactgtgtgacatattaaaaagattaaataacgtgtaacgtctgtgtcttcacgaatacctagcccactctgtatttctttcccttactttcaagttccgagctttactttcagcttcaacactccaagccttaccaggtaatgttatagagtgtttcttcctgcaccattcgttatttctaatacaccattcataaacagtacatttccaaaattgtccttcgcttttttgcagtttttataaaggatccgtataattcatgcttacggattcgtcaatccgtaagattcttacggatccgtgaatccgtaagaatttacggattcgtgaatccataagaatcttacggattttccaatccgtaagttttttttttttgcatgtacggattgggcaatccgtaagcccaatccgtttggtttttttttatatacggattgggtaatccataagcccaatccgtttgttttttttttgaaaagttaaaatatattttagaaaataatggtgcaagcaagtatcgaacttgtgacctttaagttattaatacgatgctctaaccaattcagctaatagactaattatgtcaaaaactaattgatattgatatatatatatatatatcactaaatttatttaatttaaaataatttattatattaaaaaaatattgtattaaatatacattgaaataatttaaaataattcttaaacattttttaatgttttttatccttatttttgaagctaacaatttatttcatatcattaaataatttcatagatatgtaaattataatataaattttacatataatttatagatatgtctacatgcattaattcaacatgtaattttaacatataatgttattataaaatttaacataataaattaaactataaattaatagctcaattacaacatcaacatcaacaacatcaacagcacctttaacccaaattaattggagtcggtggtagatgaacccaatgataaatcgaaaataaagcaaaaattaatagctcaattacattaaaaaataattaatgttgctaatataacactaaaattttcaatgtatatttaatacaatatttttttaatataataaattattttaaattaaataaatttagtgatatatatatatatatatcaatatcaattaatttttcacataattagtctattagctcagttggttagagcatcgtattaataacttaaaggtcacaagttcgatacctacttgcatcattattttctaaaatataattttaacttttcaaaaaaaaataaacggattgggcttacggattgcccaatccgtatataaaaaaaccaaccggattgggcttacggattgcataatccgtatataaaaaacccaaacggattgggcttacggattgcccaatccgtacatgcaaaaaaaaaaacttacggattggcaaatccgtaagattcttacggataatcttatggattgacgaatccgtaagcatgaatcatacggatccgtgtataaaagctgcaaaaacacgaaggacaattttggaaatgcactgttcattaatggtgtagtagaaaaaacgaatggtgtaagaagaaacactcaatgttatatgatgttatctatcccaattcccaaatatcacattcttttcctttcggtgaaaacgctacaatccatagacaactaatattagtctatataactaaagataattatttcttttatttattgtacacattttatcgaataattttactcttaaaaattactttttaaattttaaatttttcttcaaatttacattaattttcactattttatattattaatttgtattctattatttttattaattatatttaacttctattttttattatttaaaaagtttagagacacacttcccctaatatttataattgcagaaccggccttgaaatcatgcattctcttctgccttgcggttgtcgttcactgtaacttctcgttcggtgagtgctatgatcatcacatcacaccacgtgtgcgcatttaatcaattttgacctacactgggtcctggaatgttgtctatacccttcacttttgaacattagaaaggataaacatcatgtataaaaaaggttgaacaaaagaatgcgtatacctatattacatatgaaaaggttaaacaccaatatgcaaaaaagtttaaaaatcataaaattagtacctaggacgggtcgagaaactaaacccctgatggaggtggatcgaaaaggttgagtcttgaggataattaataaacatcacagacaaaaattggcgtggagagctcaagcaaaggtttgaaatacaatctgtaaaacatgttccaatagttagaaagcttctccaagatagcactgaaaataaaccaaagaaaggggaaaaaaaacataattataagattaaccattgtagtcacttgtcaagagagaataaaacctaccaggtatctttagaagagtgatattgtagtagcaataaacaagaccatggatattgaaatccagaagttctagaacattaaagtacacaatctactgaatctagtgttgagcttctggaggaaaagtgaaaatcaaaataagaacaaaaggtttgaacattcagtataaaaaatcctacatttcctctgccaaatctccaatacattcttattgagctagttttctgtctttgatgttttatttgaagcagcggcataatatccaaaaattattgttttttgatttgctgatcgatagcaactttggttgaagttattaattgggtgagtgtctttgacaagacttattttttaagaacacacaccaatatagatttttatttatatgcacttagctgtcattgattgttttttacaaaattttagcagtgcaagctgacttacatggctgaaaaggaaccagataccagtggaactctaggggaaagtcgtcccactccaccattaagtggacaattgaaacaactctagtggattcacctactgatgccaacactcaatcttcatttgaaggtattccatcttcacaaaaggtatgtaacaaaaggcagtgtagatatgaggatgaggattatgagcttatggaatccggattcaactaagaaaaatgtagatttgcgcctgcaaagatgattatcatggatgagttcagttaacaaaaggcaatgtagatatgaggatgaggattatgagcttgtggaatccgaattcaaccaagaaaaatgtagatttgcacagaatttattagtgtgcttgtgcctcaatttgaaatttccagttggatgaccattgctagagattgcatggagttgtacagggtggaaaaggctaaattggaatctactttatctcttaacaagcaaatggtatcattgactaccagtacttggacttcaatccataatttgaattatctgtgtgtgattgctcactatattgatgaaggttgggaattaaacaagaagattttgaattttggattgatttctgaccaccagggggacatcattggtaaagctttagagaaatgcttgaaagagtgggaaattaccaaaatttgcactattatagtagataatgctaatattgagaatttggctttatcatatttgactcgaaatatgagtgcttggaacggaaccaccttactgaatgaggagcacatgcactttaggtgttgtgcccatttattgaactcaattgtatctgatggattaaaagaaatgaattgttgcattgctaagacaaggtctgcatgtaagtatgttaagtcatcttcatctagattggcatgttttaagtggtgtgttgatgaggcaaatataacttgtgaccaaatgattgtgctttatgtgccaacatagtggaattcctcctatttaatgttgaaggttgctgaaaagtttgagaagacatttaatctcctcgaatctgaggatggttcttatgtgaattgtcttgattatgaaggacgaactccaaatgctgatgattggaatcgtgcactcgtatttaataaggtttttaattttttttatgaggcttcactttctttctctggttatttgaacgtaagttctaactctttcttgcggatgtgggtcaagattcaaaatgcattgagatcatggatggagagtgatgattctgggctgctacagatggcaactaatatgaaattcaaatttgacaagtatggtgatattgatgggaatattaataatttgttgtttgtggctattttcttgatcctcgattcaagtttaaatatcttgaattctgttttgggagaatgtatggtcctgaaaaatgcaaggacatgcttaaaaagttggaagatttcataaaaaaattgttcgcaaagtatagttcatcgcatcctattattcctgatatttgtgagtctagtggcctatcctttgatgttaccacccaaaaaattgtgagtaatggtgatggtggtattatggatatcaatgaggagtacgggataacagtgaagaaaatgctaagccacaaagcatctagtaatgactacattttaagctaaattttttgcaagaatgatatattcagtaaacattaggaagcaccgcttcagtgattttggttgccaaaatcgctaagccacagacgacaatggggactctatactttagtaatgactattcagagtaaagaagtttggcagaattctagatcattctggatgtaagaaaacctggtatttcaaagcatctagacttcttggaaatcccaaatatgtgccggagttggtgtactactatttgcttttgtcatcgtgctttatgaattttgtgaacaattatcgatatatatccacctatgctattaaatttgctctcacttctacaatatttgaatttattgataataattaagtactatgatgatgaatatactgtggatatattattaagttattgccattattaaagaatgtatttggaaaggtgtcaagagataaaatgaataattagattgaacaatttgagcttgataccaataaagagtgtgatgttttgaaagatgcttctaacctgagtgtagtgattggtgggtatgcaataagacatttatgaaaaaaactacaaagaacccaaacatatgcatcatgcatggggtgtgaattattgcaaaggcatcccattcgttgttacaagatgttctgcatgcaaaataaaataaaaattataaagtttgcactaaattagtcaaacaaggcttaatgtccactaatctcatgaggggtgatgggttgcaatgttctcaaatacggtgtgcgatgcgttagaaaacagcactttaagaattggttcaactatccgagagattgtaattaaatatttctatgatgtattacttgctttccttatgttgtcctttaaatttatttggccacaacatttcatgtttgatgatagtcaagccaaaaattaaaatgatcaacaatattggtcattttttaaaattgtcacaggaatgagcaaggttcattattttaggaataaaatgctgaatattattgatgcaacgaactagcagaaattacatcgtttgcaatgatttaatccacttggtaagggacctcctcaatccaacgtctatcaaaaataggtgaaagataggaaactaagcaatgtgttgcctggttcccttgtcttttggtaaaaacaagaacacttattcttgaattggggcaaagcttcctacagtcatctacaatgccatgaaatgaaacaaagactagctctggtcttctctctttttccattgttggaccagctgaaggcagtctgagcaaggttcattaaaagaaagagtgattttgagttctattttaaaagttaaaatattattattatgcatatattttattttcaatttaattattaacatgaattgaaaaaaaattgttaaaagaattatatatggacattaaaatttatattggtaattacatatttaaaattaattttaactaaaaatattcaaacactattctgtctgcaaaaattatttttctgatttactttgtctaaaagaaaacgcattgattgaaacttacttttgcaatgggttctttggtttggtggtttagttatttagcattgtcagcatcagtaaccgacaaagaaaaaccaagtggtcctctactctgttagtacgtgctacagaaacaggtgaaggacagtattatttttctgatacattatttataaacgctcacccaaattcaaaccaagtaaaataaatcttgtcactgtaagtttgtttgcacattattatgctttttcaagtttaaccaaaaaatattagttataattttcacgttttaagctacattaacgtgtttctttgctttctaatcatcagtattaaaactaaacatgcaaaaaatcaggatgagttaaaatcaaatatatccagggatatcctaacacgttaaacaacactgcaatcagcaattcttacttgtcacttctacggttctaccagcgatgaaaactacgcgaggttattcacagcaaagtctcctccctatttatagtttttaatttcttgattaaggatgagtttatttaaagttaaaaaataattttaagataagtattttttatataacaattatttttaaaaaatagatgggatttatttttaaaataaataaaattattttttaaaactaaaaaatttaaacaaacacactaaaaatatttaaaactacttattttattaaataaatatttattttaatatataaatttaaacaaacttactctaaacctggttattccagaacaaaaagcacatcgtaagcttcacgttctcgtatcattatatactcagtgaacagctgagacagtttccatttttaccataacttactgttttgcgagtgcatgtaatgtactcttataaatgtaatacaattaattgtcatacaaactacttttttaattaaaatttgaattaataatgataaaaaatattctttttaattgtaatcaaattaatttgattacttttatatgtggtaacttctaaagtaattaattcaattttaattagaaaagatcatttatatgatactgattaggttaaaaaaggtagtttgtatcttaattaatttaattttaatttaaaaggataatttatatcatcatttatttgattggttaaaaaaagtaacttatatctataattaatttcaatttatttcgtaaaagtttaacaaaatgtatttatattgtgtaagagtgggtgaaaataatatacaattggaaatatatttcggttatatactttaacacaacaaaattgtgtttatgttattattttaatataaatacatttttgttgtataagagaaaaaaaaattacacaatgaaaatgtgatttcatttaacaacatatataattgaatcatgtttttattgtatattttttcacaccccttcttatacaatataaacatgtttttgttgtgcattttgtcaataaaatcatgtttatgtgaaaatagtnnnnnnnnnnnnnnnnnnnnnnnnaataatatatatatatatatatatatatatatatatattctggattaaaatactatttttttacccaaaaaaaattagtgagaatgcatgcggatatatctacccctgcccatacaagttcaaaaattttaaattctgaaactcttgtagtatgtagagttctgtaatgcatttttttgtgtgtgcgtgtaatgtattttatattaagggtatggtagggcaaaattaattgaaagttaaaaattaattaaaaattaaaaattagttttattaagcatttaacaaaattaagggttaaagtagttgaaaagtgtaaaatgaaagaaaataataaaataataatgtatttaaaaaggataactaggaaattagataaatattttgaggataaaaatagaaaaaaaatataaaaagttaaaagttagatgttttaaaaaatgttattttaaggttatgttccataagacattttaattagtttttaactttttttatgagctaaaatccgtgtttgatgttaggtaaataattttttttaataatttctaatatttttttaaacctacttcgtttttaaatgttaacttctagtatgttatatttttttatttttattttcaatatatttattcaattttttattatattttttaaataaatcatgattttattattttattatcattttatattttttaactgctttaataacatgattttattattttattattattttatattttttaactgctttaataattaattttattggacatttataatttaatacgctttcaaatatcagttagttaattttttaattttcaactaattttatcaaatataatccaagtaacattttaaaatcattagaaatttaaaaaaaaaaaacttatttattaaannnnnnnnnntaaacatgtttttgttgtgcattttgtcaataaaatcatgtttatgtgaaaatagtattttcaaaaaataaaatctaaaccacgcttggaggtgcaaatagcaaatttagtagtgagaataacaatttcataagatgtttgaacattgtggacaacgtgtttgatgcaaatctagctgatttttttaacataactatataaaaaaatgctttcttgattagtttataagataaaaatactaactaatgaacagcataaaaaaacaatattattatttattttatcaaatttatccaaaagctccttactcatggacacatggttaagcagccaaagtccaaattattatataccatctcaaacaataattggtaaatgcttcacattgaccagagtaatattattcataatcacatgccctcacatgtcctcaccacaaaggcttggagattctcctattgtttaaccatctagttctagtaataatttctcacctaattacataacatgcatttctttttcagaccccaaaagaaaaggaagaaaaaaagaaggaaaagaaagtaagaaacccatgattgtttctattgatgtcacaaaccatgatgcacaaattcattaaactgtactgcaaataaatacaaacagacagctggccttctgcaccctccacacaacacaacaacaacattaacaacaacacatacactaattagtctctcactggtcactactttgcagcacactcttgagttttgactctccctacctcgcagtttcatggcttcttcagtgaccagatcagcctcaggcttcagcttctcagagatctggctcttggtggcagccacagcactcatctgtggctttctgggttacatagtttatgatgcaatcatggccactgcttctgagttgctgcaacgtttgctggtaatttctccactgttcttgatcatcattgttcactggctctccactggaagccaaataagcttccccatgccaggatctgagcctagtgccatccacagagctggtggttccccttggggtgttgcatttgttcttcttctgcttttccttctcatttcttaccaaccttccctgcatgaccttgtttcttagctagcatgtactatatagtttattaggctatgaaaatttagtgcatgtcacttatgtggggtgcttgttccttttttttttttttaccagctaattattagtttgttaatttttgttagaaagaaaatgcgaacgtaccacctttctttttttcttttcttcttaaccactccactaatcttgtatcttctataattttagagttactgtaactcataatgaacctgttaatttctatgtgaatctgggtgtaaaaactattgcagtgtctctctctgcctctaaaagagtcttgcttttcctttgtagcaaattttgtggctgcttatattaagtttcgagctttgctgccctatggcaggtgtttgtccttttctctgagaaaattgaaatgtcgcggtgtgtcaaacatcaaaattaccaaggaaattggactattatatatctttttattttggacttcatctgttggtgttcatatctaaatataaagtttaaaataatcaattatttctcagatgaataatccggacacactgtaagtctttctccggctttttttttcattcaaccaaaaatctcacattccatagactaaagtaattaagaacattttcacgaaattaaggatttaacttttataaagttaagtcatgaataatatatatatatatatattctggattaaaatactattttttttacccaaaaaaaattagtgagaatggatgcggatatatctacccctgcccatacaagttctaaaattttaaattctgaaactcttgtagtatgtagagttgtgtaatgcatttttttgtgtgtgcgtgtaatctattttatattaaggctatggtaggcaaaattaattgaaaagttaattgaaagttaaaaaattaattaaaaattaaaaattattttattaagtgtttgataaaattaagggttgaagtagttgaaaagtgtaaaacgaaaaaaataataaaataataatttatttaaaaaggataattaggaaattagataaatattttgaggataaaaataaaaaaaatataaaaagttaaaagttagaagttaaaagctaatattttaaaaaatgttattttaagattatgttccataagacatttcaattaatttttaactttttttatgagctaaaatccttgtttgatgttaggtacataaatttttttaataacttctaatgtttttttaaacctacttcaagtaatatttttttaaatgttaatttctaattttttatatttttttattttcaatacatttattcaattttcttattatattttttaaataaattataattttattattttattgtcattttatattttttaactacttcaataacatgattttattattttattgtcattttatattttttaactgcttcaataattaatttgactggacatttataagttaatacgctttcaaatatcagttagttaaattttttaattttcagctaattttatcaaatataatccaagtatcattttaaaatcattagaaacttttaaaaaaacttatttattaaataatcaaataaatttttaattagtaaaaaaaattaaaaactacctcaaattactttgtaacatggctaaataatggcgtgttaattgtccaacctaggcctacgcatttacgaaacaaattcaactgctaagctacgaattcttgaaagttttgaaagaaaaatccagagcattttatagaattttcccagtcaccaaatttgacaattgccacattaaaattgtcatgattcatgaatattgtcaaaatccaattccttattttccatagtatcgttatgaattttcctcaggatttttattcaaacactgtaatctttaaaattcatggaataaaaacaagtattctattgtataaaaaaaaatataaaatcattgaacaaattgcaagagatatcatgttagtcaaaattaacaccgttaggcattagcaataaaactgaccaaaatatcaatttgatctaactttatgggactataagagaccaaatcaaaacaaaaaattaaaataaaataaaaaacaaaaaatatattttaaaaatcctttattttatagtaatatatattattaataaagggaaaagttccttttaaaaaattaataaagaaaatacttaattacatttagtatacacaattcattaaacaatttttttgacagaaaaacaattttattcttaaaccatttttaaactttcattgttctcttttaaattatgataattgcctcatcattataatactattgtaagttttttcttccctgtcacccttattttttattaaactttttcctaagggtgttcaatggtatggatcacccgagaactcgaattgattcgaatagtttgcgttgaatcatttatgtatttggatcaaaatcaaatcgaaccgatcaaaatcattcatgtatgagttgagtcacgggtttagatttatagatttattgacccattgatctgatccgtgaacccgtaataaaaatataaattttattacatatatatgtattaaaattttaaaactaaaaaaatattttgacaataaaaaaaggtgtggtactgtaaatgnnnnnnnnnntaaaaaaaaaaaacttatttattaaacaatcaaataaatttttttaattagtaaaaaaaattaaaaactacctcaaattactttgtaacatagctaaataatagtgtgttaattgtccaacctaggcctaacgcatttacgaaacaaattcaactgctatgctacgaattcttgaaagttttgaaagaaaattccagagcattttatagaattttcccaagtcaccaaatttgacaattgccacattaaaattgtcatgattcatgaatattgtcaaaatcaaattccttattttccatagtatcggtatgaattttcctcaggatttttattcaaacactgtaatctttaaaattcatggaataaaaaccagtattctattgtaaaaaaaaaatcattgaacaaattgcaagagatatgatgttagtcaaaattaacaacgttaggcattagcaataaaactgaccaaaatatcaatttgatctaactttacgagactataagagaccaaatcaaaacaaaaaattaaaataaaataaaaaacaaaaaaatatattttaaaactcctttattttatagtaatatattcataattgttaatatatattattaataaagggaaagttccttataaaaaattaataaagaaaatacttaattagcacaattcattaaacaattttttttgacagaaaaacaattttattcttaaaccattttaaaactttcattattctcttttaaattatgataattgcctcatcattataatactattgtcagtttatttcttctttcacccttattttttattaaacttttctctaagggtgttcaatggtataggtcatccgagaacttgaatcgattagaataatttggattgagtcatttatgtatttaagtcaaaaccaaatcgaaccgatcaaaaccgttcatatacaggttgagtcacggatttagatttatagatctatttactcaataatccgatccgtgaacacgtaataaaaatataaattttattacatgtatatatatgtattaaaatttaaaaactaaaaaaatattttgataataaaaaaaggtgtgatactgtaaatgtctggaccgaataaagggtcaacttataatcatctcatctcatctttgttgtgaaggtgtagtactgtaaatgttacaggtttaggtttctttttcttttgcgtttttgtattctctctcatctcatttccttctctgcgtttcagccacttctgttctctctcatctcatctccttctctgtggttctgcatcaactccttatctgttctctctcatctcatcaaatcgatcaagtatcaggttttcttttgcgaagctttttaacttcttgtgattattctggtttgtattcattgggattttgatggaaacaaggataggaagaaaagaaataaccttcattgttgagtgttgaatcgaatttttgttgttgtatttgatttactgtttttttttcttgtttgctttataattaagctaatctttggtaaaatcttaagagagaaaaatgtgtttatttggattaaagattgagagaattagtttcagagtgaggaatagttagggcctgattttttttctcttattggttgatttattctttgagagtttgatttaaatgatgtttttttatttttattttattcttttaacattctttgaaagtttgatttgaatgatgtccttttttttttcttttgttcttttaacattaaggttacttaaaaatcaatgttcaacttgaccaaaataatgatattactttttttgttaatgattgaaataatgtcatttcatcataaaagcaaaaacattatattagtataaaatcaatttatttttgggctaataaggttgtatttaaatttttagaattatttgatttgattttaaatactactaatattggatatccaagtgttgaaattgcaagtactgaggtttcttaatgtattactatatattgttatttgtttaatttttttttcatattttgtttaccatgtttataatattaataaataatattttatttatttgtttctttcagcaaatctggttacaacaaatttgattatagcaaaacttattgtaataaattaatttgtgagaaatagttgtaattcagactattataataaatattgttcaagaatcttttgttttaatttatattataagtttattttaaaatattatgttcatgatattaaatgaatcaattttactattttgatacatttgataatattatgtcaattgtattggatatttgaaagaatcattatataaaatagtagttctaagaaaaaaaatttaaatggataatccgttggtccaaaccgaactgaaccgtttatgaatgggttggtttaagttccaattttttttttgaaaatccaactgaatcaaaccaatcaaatttgattgagttatgttctaaatttgacaaaaaccaatttgaaccgatttgcgaacacccttacttttccctccttttatatatatatatatatatttttttttcttctaaatttaagagagacatgcttccccattaatatataatgacgataagcgaatttgatgtccacgtttttttttaaagtacgtaattgcatgcataaccaatcaacccctcttgcctatttttttattcaatcccatttgctctctaaaccacctactccttcttttttttaactctcatgtcaaaataactattttaaactttattaaaaactaaaatttttcataaaaagttaagtttaacatttttaaaagatttggttagtcagcacgcacgatgtgtgttccacccaataataaataaaaaaaagcttaatccagttaaatacaagtaaaactaactaattttttacattaattgagaaaatgggttaccaaaaagaaaatgggttaatattattatatcacatttaaaattataaactttgatataaaaattaaaaaagaataattgaaaatagaatctcaaatctcaataaataaaagagtattttttatataataccgttaaataattaaaatttacttatatatagatttatcaaactttttgttttgttatttataactaagctcggagggagtataatttattatgattatgtagaagaacaatcaagtaacctacatatatggtacttagccaaaaagttgttgaccacatatatacttagtaattgcggcgggctgtggtcaacaatacgatagctcacacttccatggaacagttttgtctcgttcctcactcactttggtaagaaagtcacagttcctcactcactttggcaacaaagtcacaaagtgtttgtcccattcttttgatataattgatgttatgacgattctgataatacactcatcattttgtcactatgcaacttattttattattttcattttttcctgtttctttgggtctgatatatacctcgtgacttttttttacttttctcccaaccttttcttgttccattttgcttcatcgtattccacccacctcggaggcccaagccaaaggttctcccacttagtacatggttttgatgccaatttgtttgctgtcgtgtattacgtatttgatcataatttttttgttatactaattgattatgaacatgattaactctgttttgtagtctttatttacggctcctttcatttttcgtactcaatgattgcaattcatcgtttggggtactgtttgaggtttaaacgttttgaaagtttggatccttaatctactggttttgcttccatcatggatgtcttcagaatctggtccttgatcactagttagaatttgagtggggtaaattagaactgttccggtttgtggaattgctcatcaatatcacattcccgtaagtttggatctgtttcttctaaagtcaacacttcctttataggataaagcaagtaattttacttgttgatgaaaaaatcacctgtcaatattatatgtgtacatacgtaacaaatcatgaaactgaagttttgataagaaaatttcagaagatcctgctttcatgtagtggggactgatgaatctttcatttgacatggaacggtaaccagcatgcttttagttgaaataccatttggggacaccaaaaagactaagttttctgcttttagttgtcacgttgacaggattctaactagcatgctttgtagtgttctaagtttttctgcttttagttgtcacgttgacaggattctgactagcatgctttgtagtgttctgaaatcagccagtgaacttgagatatattcattcttgcatttattgatattgcatagcatctttgcattggaatgcatctgatataatatcatgttatttaatcacactatatttcaaactctatttcagcagatcctgcggacattgtaagtaaatcttatggagatggagatgataactaatgttaccgagtatgaggctattgcaaaggaaaaattgccaaagatggtttatgactactatgcatcaggggcagaggatcagtggactttgaaagagaaccgaaatgcgttctcaaggattttgtaatatacttttctcaggaattaggacctccatttatctgttctagccctctagaaacttttcattcaaaatctaagctttcttttcctttgatttactaaggacacattaggattccctgggtgatgggattgcaacttgtgcttcgtttaattaattttcatcttttttgttctgaagcccttctctcaatatctatttggtttacttcaaacaggttccgcccgcgtattcttgttgatgtaagcaagatagacttgactacaactgtattgggcttcaaaatatctatgcctatcatgattgctccaacagccatgcaaaagatggctcaccctgaaggtatgtgatcagattctttggtctgtgccacattaatatattgccattacattcggtgcatgtttggattaaagtttacaaacttaagtgaatgaaatttaattttgtaaattatgcaaaagcaactttttctttacttctttttcaaactgagtttcagtttacaatcaaatacaactgagaatcaaacaaaatgttttttctgttttactttttgagtgaaatttttgaaggcaagccctgctataacggtaaagttgtgctttggtgacttctttgtcatgagttcgaatctagaaacagtctctttacatatgcaagaataagactacatgtaatattcttttcccttaccttcgcataacaaggagcctctggacaatcggatacgtactttttgagcggaatttaaaagattcccaactgaaaactaagcataacttcagtcttttgttgttgttcttgtggttatatacaagtataacggcttcactctcctatggcaaaaagcactaggttacgcatttccacaccttgaggtggaatgattataggatgaggtatagaatgccataatatgtaacttcctagcatttaattgaatgagaagatattttgtggctctttgaaagatagcttatggagtatattatgctgaaaccggtataggttctgtatagtttagtgtgcgataagcacaagaacatgaaaggagatttaaaagaggtttgcttaattacgaagacaatagaacattcccttctaaacaaaaactgctattattctttcttaaataagattacaatcccatttgaagcaaatgaatttatcctaaaaatctcagtcaatttcatctaaccattttgggaagaaaattccagcaagttaagattgtctaaaatgttttacaaaatgtttgcaaattgcaatgaatatagtgttttatagagcagaatattgcggaatgctccaaccttgacatcgtttaactattgtggtggttatttcttgtataactacgaagtataaaattaatctgaattaaacataaattcttctgatttcgttaatgcataagtccctgattcttaatatatttttaatagaagtttattttttactacaacaacaattgataaaagcttctgaattaaaagaaattatgcaacttttatgcaggagaattagctactgctagagcagcatcagcagctggcacaatcatggtttggctttcactatatttgtcatgcactttggttttatttcgagatgaaaactatatttctttccttgtagtttattatttatttgactgtaatatgaaattttatatgcctacttaactacatgcatttgttatacttatttacgttccagcagattagattttataattttttataattttttttttgtcacagacactatcctcatgggctacttcgagtgttgaggaggttgcttcaacaggtcccgacattcgtttttttcaactttatgtgggtattttttcctcaattatgcaagcactactattaatatctcctcttatctaaaatcctcaacaatcttgtcttaatacctaatatgttactgttctcttcttctctcagatgcttaaagacagaaatgtggttgctcagcttgtgggaagagctgaaagagctggtttcaaggcaattgcccttactgtggacactccaattcttggtcgtagggaggctgatatcaaaaacaggttggcaaaccatttggaaatttcaatcggaacagcctttcaacaaaactttatatggttcatcatggttgaattgctaaatctcctactttaagatatttactactggctagtttgatgggggtattttacagatttacattgccaccaaacctcgttttgaagaattttgaaggattggatcttggaaagttggacaaggtgtgtgattacattgttattttctattatttggtttagaattttgaaataaatgttttttttttcttttttaggcttaaatatgtttttatctttaatatatagtcaaattttgcttatgatccttgataaattttttcttcacatctgttccttgatatttgaaaagttgttttagattcttacacttagttaagtgatgacgtgtctgtaaatattttataatgcgatttgtgacgactcaaaaactgtgttagtatttatttcaaaattaaattaaaaaagaatttttctctctcctattttatcattttttttgcctctctctcttcggccctcttttctttcttccttctgtcatgaatacatcaccatagttactgtcatgaaccccttgtgtctgttcctttcatgtttcgtcatctttgttcaatgcctttggagtggatgcttttgtagtgggttaatttaaaacttagacaagcataatttagaaattagtattattaacataaaatcaacaaatctcccaaaattaatcaatacattccaaattccaaatcacaaatccaattaatctctatagctcatagcaaattcagagcaacaacaattcgaaaataacaaaaaaaatcaaccgaaggacatcgttgacgttaatgactcaaagggtttagagaagcttatgtggtatgtgaagacataaatgtacgccaagatgatttttccacaatgattgtgaatgacattcacggcgagatcaaggtgggagaggaaggtgcgaagggagggattgtggtcaccgctggcaacccaatcggggatggcattgaagaaggcttgtccaagtaactcgtagtcgttgaagaataactactcgatgtcagtgacctccccgtcgacgtaatcaaaggtggcggtggaagagccgaaaatgagagagttgtgttcgcaataaactttcttttggtagtcttgctctgcggtggtgactttgaaggtggtgccgaagtgtttcagatttgaaagttaaagattgacaatggagagaaatgttccagatctgaaagtcaaaaacaaagagaaagttaaatttgattttgaaacaaatattggtgatttttgaaccgctacaaattgtattatcaaatatttaacagacacatcattatttaactgacgacagagatctaaaacaaaactttttaaatattagagagcaaatgcgaagaaaaaatttatcagggattaaacacaaaattcgactatatgttagagatcaaaagcatatttaaatcttttctttattggtcatattattattgttacttactatttgctctttgggattacattgcagactagtgactctggtcttgcctcttatgttgctggacaaactgatcggtcactcaactggaaggtgatatagatctttgacacatgcaatttcctattctgtgacactgaatgtggaagtaataatatggtaagtcttgtttcaggatatcaaatggcttcaatcaatcacttcattgccaattttaattaagggtgtacttactgctgaagatagtaagcctatcaaacagacgcactttgtttctttcctgtccttttatctctttaaaattgttttctcaatctttaatcttattccatatttaataatgtagcaaggatagccatacaagctggagctgctggaatcattgtttccaatcatggagctcggcaacttgactatgttccagcaactattatggctttggaagaggtagtggatcctaaccatttctagaaattttatattaattgaaatagaaacgaaccacttgctatcattctttatttgattttatttcataatgccttatacattgaaacttcaaagctgttatatttgactcattggaaagttttttagattgcctgcttccttactcataatcattgcattttcattttctttttaaatttttgggttcggttgaataatgtcatctttcaattcatttaacatattggaaatattggttgcttgacttaaataggtagttaaagctgcacaaggaaaaattccagtttttatggatggtggaattcgccgagggacagatgtttttaaagcactagctcttggagcagccggtgtattcgtaagtacatgaaagtttgatcaccatcatagaaaattaaactattgaatgctgaactttagtatatgtgtttgtttgccttatggcatgaaaatatgcttttgtatttcattgatttactactttttaattggaggcagatgatctaaaataatctgaatagccccacattcttgctatttatatctttgtctttcatctcaaatttcagattggtagacctgtggtgttctcattggccgctgatggtgaggctggtgtgagaaaagtacttcaaatgcttcgtgatgagtttgaattaactatggcactaagtggttgtcgttccctcaaggagataacccgtgaccatgttgtcacagagtgggatcacccaagattttctcccaaattataagacggcaagactcaaccttgttctatattttaaaaaaggagttttagaataacctttgttcttattccatgcttcagtagaaaactttgttgttacagcgagtgaggcattagtcatccattagtaattgctacttttttattagttgtacataataagtttctacttgaactcatttcattgcacttggtgctaagatttggtaaactctagaaacataattgccaacaaaatgtaggtttttcttggcaaaagattaagttttatgatcatttatctctcatttatgtgcgacaactttgatttgataagttgcttgatgtctttggattgaaaatgctcccaagaccatctcatttgatgtgatggttatcatggaatgaagaacaaaaacatcacatttgaatcaaaggatcttaagaccacatgacttggttctaaggtcaccttatactgtagggtgttcttaaatgtttggtaacccactctattatttatcatgaagggaagggagggagtaggagtgaatatgtaagaaaagaaaaggaaaaaaaggaaaaaggtgaaaaataagatgaaataaagattatttgattttagagaaattgagtgaaaattaattttttgagatcatttgatttattgttattatttaagaaaacatgaatgaggcatgtaggtgggcacatgtgtgtttcctttaaaacaaaaaggtattatgaaatcatattgattaaagcattgggcgggtggggaattttttttgttgggttccactaatgtttaaaaaatttctctttaattctacctatcaaacaactcagtcttccttactttttccctctatttccataataccaaacacactctacaagatatttctttacccaccttttgactctaacgtgttatatttgattgggaggaaagaaaatgaataaacgtgtaagaaaataaaaaagagtgaaaaaaatgaaataaaatagaaagaaaataaaaaaagtaagattgtttgatcgaaatgaaaaagagtaaaaaagagaagaagtattcgagataaagtatgtggttaggaaagtaaaggaaaaaaaaaggaaatttaatattaaatattaatgtattacctttatttttatgaaatctaatagttataataaataattaattttaattattagatattaagaaaataaataattaagataaagaataattattttaaaataattctctagagtaacttgatttctagttagatattattattattattattattaaaaaagtaagaatcaagggggaggggtctgaataagtaaaaaaggaagaggaagacataaccatatcgagagactagtttttttgaaaattgtgtcatttgatcgctttttatttcatttgagcaatgaaaattattgtcagtctcattgtttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgtttttttttttttttttttatataacttttcccctctttcatcttaattcaactcttttcactttcattacactaggcccttgtaaatgcagaccaggagactttacaatgctaggagtagtagccaaccacgaacaaaatccatgatgaacccctagacctccatcaaaagaaaatacccaccacatattgtgtttggtactatgtcttgcaatgtatttatttagataataaaaaaaataacgtaaaaactaacaaagtacacagaagctttatatataacctttgaagcgacagaaaattaccaacacggacatagccaaagatatgaataaaccaaaattgtggtcatgagatcttccacgtgtaatccttctttgagaaccgtgatattgatccatccattcatcgtcaactcacttggatagttggataagatattgtccattttcacttgcctcacaagttaacaccaccaattccttaatttcctcattatctatagcttctccttaatttcaaaaccatctcgaataagacaaccttatcatcatgcatggcttagtaacttagaagacagaagcaagtttctattttattttcaatatatacttattattttcagacatagttttgacaagtgcctaactatatacgtggaatgtggaaggtataccacaatcttttgcaacttatttattaaatttttttagaactgtacaagtagagaagaaacatgattaaggtgtttaatttttttcccccaaaaaatgatatgtctaatctataaaaattaacttaaacaacatataacatggtagttgcaccattatagttactgtaaagaatgctgaacattaagtgatacatactgtagcactttgcccatgagataatgatcattgcactccagtttcagactttagcacgagaatttggatggtttatctaaatccaatggacgtaggttttcaactttatgtgaagttatgcagattgcagatcaagctcttaaaattgattttttcacacatacattcaacaaataacaaatatatacataaacatatatatgtccaatcaatatatataaaaacatacatatttcttatttacaatttaaattcggattgaggaactctaatttatactgtaattttttaattaatctttaaaaaaatttcttaaaaaacagttaagaatttgagttgagggacccaattcttaacttgattttaattttttttgaaaaattatagtgtaaatttagatttttttaatctgaatttataccgtgaataagaaatttgtatgtttatgtatatatttgttatttgttctatgtttgtgtgaaaaaatcgttaaaaattcgcttctgtttttgtttttctttctttcctttttgttacattggacataaacctttcagaccaaggaaaaagagacaaagaagggactaaagttataacttaaaacaaatggagcaatcagaatttcgaatacaccgaattctcaaaggaacacaacctcagttttaatctcttatttattttttgggtaaaaaatgcagttaagcttaaaaaaggtgtactcatcatcattttgttactatgcaatttctttattattttcctctcgtgtttctttggctctgttacatgatgtaacagacttacatgccttgtgactctttcacttttctccacactttttcttgttccttttgagcttaatcgtattcctcacttcggctgcttagcaatccaagcgcaaaggttctcaatttcaacttagtacctgattttaattccatgttatttgcagtatttgatcataattttttattattactaattgattatgaacacgattaactttgtcttttagtcttgattcacggttcctttcatttttgtacttaatgattgcaattgaccgttttgggtactgtttgaggtttacacagtttggaagtttggattttaaatctgctggattgttttccatcatgggtttcttctgaatctgatcctagctcacttaatttgaaagggtaaattgaactgatcctgttagaggaattgttcatcaagatcacataaagtaaaatgatccataaatttggatctgtttcctctaaagtgaacacttgctttattggataaagtaagtaattttacttgtggatgaaaatatcactggcagatattttgcatgctcggaaacaagttgagaatagaagaatcatgtttcagatgtagaagctataactattggtttcggaaaaccacatccaaatcatgaaaccaaacatgctaattatgtaaacatacataacaaatcatgaaagtggagtgttgatatgaaaatttaagaagatcctgatttcatgtggtgggggctgatgagtctttcatttgacaaaccctttttcaaaaaagacaactcttctattgttgttaattgaaataccattgagggacatcaaaagactacgtttttaagcttttagtggtcatgttgaccaagactgtgttttgaaaggattctaactagcatgttttatagggttttgaaatgagtcagtggacttcagaaatatccattcttgcacttattgacattgcgtagcatctttgcatttgatatgatttcatgttatttaataactatatacttgaaactcactttcagcagatcctgcagacaacataagaaaatcttatgaagatggatatgataactaatgttacccagtatgaggcaattgcaaaggaaaaattgccaaagatggtttatgacttctatgcatcaggggcagaggatcagtggagtttgaaagagaaccgaaatgcattctcaaggattctgtaatctacttttctcaggaactaggacctccatttatctgttctagccctctagaaacttttcattcaaaatctaagcttacctttcctttgatttaccaaggacacattaggattccctgtgtgatgagattgcaacttgtgcttcctttaattaatttttgacttttttattctgaagcccttctctcaatatctatttggtttacttcaaacaggttccagccgcgtattcttattgatgtaagcaagatagacttgactacaactgtaatgggcttcaaaatatcaatgcctatcatgattgctccaacagctatgcaaaagatggctcaccctgaaggtatgtgatcagactcattggtctgtgtcactttcagatattgccattacattcagtgcatgtttggattaaagtttacaaacttaaatctgaatgaactttattttgtaaattgagtatgcaaaaacaacttccctaagttctatttcaaactaagtttgaaggcaaaattatgattaaattcagttttaattgaatccaactggaaattaaacaacaagttttttcagttttacttttttagcagacattgaaagcctccaacctgaaaactaactataacttcagtcttttgttgttattgatcttgttgttttatataactacttcactgtaacaaaggcaaaaggcacataattatgcattcccataccttaaggtggaatgactataggataaggtatagaatgccctaatatgtagcttcttagcatttaattgaatgagaaggtatcttgtggctctttgaaagaaagcttacagagtatgtttatgctgaagcaggtataggttctgtatactttagtgtgctataatcactataacatgaaaggaggttttaaaagaggtttgcttaattacaaagacaacagaacattcgcttctcaacaaaaactactgttatcctttcttaaataagattacaatcccatatgaagcaaattaatttatcttaaaaatctcagccaatttcagataaccattttgcagagtaaattccagcatgttaagactgtctaaattgatttctaaaatgtttgaaatgaattgaagacgatatcaagaaaagtagtgttttcaaatgaaaccgaaaagggtttgggagcttctggaaattttatattactttttagtgttttatagagtagaatattgcacaatgctccaatcttgacgccatttaactatttccgttgttataattacaaattataaaattaattagaattaaacaaacactctgctaattttgttaatgcattaatccctgattttcaatattgtttttattgaagattatttcttactacaagaacaatttagaaaaatttcttaattaaaacaaattatgcaacttttgtgcaggagaattagctactgctagagcagcatcagcagctggcacaatcatggtttgactttcaccatatctgtcatgcattttggttttatttccagacaaaagttatatttgtttccttgtagttttattatttattgaaccgtatgcctactgaactgcatgcatttgttgtacttaattactttccagcagattagttttcataatttttgtgacagacactatcctcaactgctacttccagtgtcgaggaggttgcttcaacaggtcctggcattcgtttttttcaactttatgtgggtattttttcctcatttcttctttccatagttctcttttctgtgatgtgtattaaaagtctcgtctcccccatgaatacaaaacattttcttgacaatgaaacatttccaagcaacttagtatgaaacagaaaatcacttttatgaattatcaattatttttttgttgcacttttatgaatgttttaatgagtttggaaaactaaggcttgattcctgcatactgccacagggcaatgtattacttacattttttttccattgttttttgccagaaaagatcttaatagtttcacaaatattttcttttctttcctctgtgatttcctccacacttccttttaataataaaatgttattctcattgcttaagttatgcaagcataaatatgaatatatcctcttatctaaaattttcacaatcttgtgttagaacctaatatgttactgttattttcgtctctcaggtgttaaaagacagaaatgtggttgctcaggttgtgagaagagctgaaatagcaggtttcaaggcaattacccttactgtggacactccaattcttggtcgtagggaggctgatatcaaaaacaggttggcaaccatttggaaatttcaatcggaacagcatttcaacaaaactttatatggttcatcatggttgaattgataaatatcctactttaagatatttactactggctagtttgatggggtattttacagatttacattgacaccaaacctggttttgaagaattttgaagggttggatcttggaaagctggacaaggtgtgtgattacattgctacttttcattattggtatgaaattttgaaatcagacgagtttttccattattggtcatcttattgttataactgttgctattttctgtttgggattacattccagactagtgactcttttgctgcctcttatgctgctggactatatgatcggtcactcaactggaaggtgaaatacatatttcgcagatacaattttctaatcagcgacactgattgtggaagtaaatatgggaaatttgtttcaggatatcaaatggctccaaacaatcacttctttgccaattttattaaagggtgtacttactcctgaagatagtaagcctatcaaacagatgcactttgttgcttccctgtccattttatctttattcagattgttttctcaattttgaatctaacttcatatcctatgctaataatgtagcaatgatagccatacaagctggagctgctggaatcattgtttccaatcatggtgcttgccaacttgactacgtccctgcaactattatggctttggaagaggtactagatcctaatcatttctggattttttttaattaattgaaatagaaatgaatcacttctagtatcattctaggtagtggaactaaagtcttagtcattctttgttttattttagttaatcacgcattatgcattaaaacttaaaatctgttatattggaatcattgcaaaattcattttcattgtctgttaccttgtaattgttgcattttcatctttttaaatttttgtgtcctatttcaattcttttaagatattggaaatatcggttgcttgacttgaataggtggttaaagctgcgcaaggaagaattccagtttttctggatggcggaattcgccgagggacagatgtttttaaagcactagctcttggagcagccggtgtattcgtaagtacacaaaaatttgattaccattatagcaaattaaactgttgaatgctacttcagtatgtgtgtttgtttgccttattgaagcatatatgcattagaaaggtgtagttcctatgttctacagagaagcatatgatcctggatcttagaaatttccttggaatatgaatttccacaaatgccatggaaacttatggaatatgccaatatgcttttctatttcattggtttactagttttttttggaggcaggtgatctaaaataatctagttagtcccatattgctgctatttatatatttgcctttcatctcaaatttcagattggtagacctgtggtgttctcattggctgctgatggtgaggctggtgtgagaaaagtacttcaaatgcttcgtgatgagtttgaattaactatggcactaagtggttgtcgttcactcaaggagataactcgtgaccatgttctcacggagtgggatcgtgcaagattttctcccaagttataagatggcaggactccaccttgttcttctatattctaaaataggaggaattttagaataacctttgttcttatttcatgctttagtagaaatctttgttgttataccgagtcaggtgttagtcatccattagtaattgctacttctttattcactgtacaaaataagtttccacctgaactcatttcattgcacttggtgcgatttggtaaactctagaaacatgattgcctataaaatgtacttttttcttggccaaagattaagttttatgatcatcgatctcccatttaggtgcgacaactttgacttgataagttgcttgatgtcttaggattgaaaatgttccgaagaccatgtaaaagatgtgatggttatcatgagatggagaacaaaacacatttcgtacaaaagatgcctaagaaccacaagacactcagggctaaggtggtgctcttaaaatgtttggtacaccgctcttgaccaagtgagagtgatttaccttatcaccttttatctttaaccaagccatttgccacgtttttttttggccttcacatgaaaattgcatcctcttaaaagaacctgatgctttcttaattagccttactcaaaaatagctaaaagcaacctaccacactcaaaggcgtcttgtcattgcttttctaccccaaaaggaaccaattgattgtctcatctacaaacacaatacattttattttctcccaccttttgactctaaaccactgtaaatgcaaaccatgaaactttacaaagctaggagccaaccatgaacaaaagccatgatgaacacacacagacctccatcaaaagaaaatacccacaacatagtgttagatacaacatcttgtgcatttatgaagataaaacaaatcacatcaaaactaacgaaataaatcactgtaaatgcaaatcaacttcgacgcaacagaaaaccaacatgcaaatagccaagataggaaaaaaccaagtgtcatagcaagatcttccccgtgtgtcgtgcttctttgagaaccatgattgatccattatccatctgttcatcttcaagtaacttggataagagatttttcattttcacatgcatcacccattaacactccaacaactaatatattgaaaaagtcattaagatgatgtcacatcatcacttaattgattacaaattcaatacaaaacttttaatatatcaaaaagaatagagactcaggaacaataaaaaaaatttgagaaactcaaaacaaatattgaatatatatcatgcatctcaaaacatatttaaatctctaatctataattcttttctcctttcaaatccatcacgaaacaatgtgtcaaccttatcaagcatggtctagtaacttaggatgacagaagcaagttttttctttaaaaaaccaaaaatattcttacggtaaaaaaattcatctgtcttgctccaagcaagctttttctttttctgagatttagcaagtgggaagagaagatttgcatgggatagggtcttctttgaacaaaaataagccaaattattggtccttgtcgacgcatcaagtatgataccacttttcccaaatgcccagcaaaagttaccgtccttgagatcgaattctttgagcattgcaggcagagtgaccttagctctatcagtgcttcaagctttacctactacctagctacattatgcaaaacattgttacctaaatctgtttgccagtctttttgaagtcttaatcaccaactttgtgtggaatgggaatatttaccgtacatggcataccatttcttggaatctgtatgatgctaataaagctatgatcatgaaatcattccccagaaacctaatgggttcgtgttctaagagcaaagtaccattgtggaaataacattatttcccaatgtcagcaaaaggcaaatgtttggagaagcatttgaactgtttgggatgatgttaatggactgttccgttgcgaaatctatctggaatgttttgttgaactcacaaagacatagggatttctttgtaacagaccttaatagattgataaggaagaatatgactactaagaagcatgtgattcgagagtggcaagtgatatttagtgcagtgtgttttctaagaaaatctgggagcttgcactgttttgatggcagaactcagtgctatattgtctgctctgctcttgaattggcatggcagagaaggaactcggtggcagattggatggcttcacagggtcatagcttacctttgaggaaccttctatgattttgtagggatcaaattcccacctagagtttccttgtagttggcttaggccacccctttaaatcaaaaatgtatacttatcattttgtcactatgcaatttctttattattttccttttgtgtttctttggcttattgatatgctttctgacactttttctggttcctttttagcatcatcgtattcctcacctcggcagcgtgttttccctctcaatttagtatctgattttaatttcacgtgatttgcagtcgtgcgtaacatatttgatcataaatttttatcatactaattgattcaagactgtgttttgacaggattctaaccaacatgttttatatataattctaaaatgaatcagtgaacttcagatatattcatgcttccatttattgacatttcttagcatctttgcattggaatgcatttgatatgatttcgtggtatttaatcactacacttcaaactcactttcagcagatcctgcggacatcgtaagtaaatcttatgaacatggagatgatagctaatatgttatgacaaagccagtcaacactgacaaatttacatggtgttaatcctgttatggcctatcaaaaatgtaacatggaatagcaaggaagaaagaatggtgtgaagatatgatttaattaatcataatcttcaagttggagaattgttggaagcgaaatgcggaagtgcggaagtgcggatgtcccacattgctgggtcttcctttgagtttttactttgttgctataaaaggaaccttagtagtcccatgtttagcatctcaaacattttcttctcccttcttttatttactaggttaccaagagatataaattaatttcttcttttagattctcttcgtagatgttgtaatttttttcacttggttaaattttttccttgtccattgtaattttagatgctcttttctcatctctaattttagttgagttattatcttggtatccaacacgaagaacccataatgtattgtagttaattataacttgcattacacgaatctggccaaaatgttcaatcctaataagtaatgaaagctcggcttatatgtacaaatgatatatagctaggtagttcagttcctcaaatgctatcctcatattctccaagagttatgtttcgtttgcaaccatggttcccaaacgtcattttcaagagatatgtcactgtcactttgaaatagaaccaaagattcccatatgttcaaggttcacgaaaaatatactaccccaatccattggttggtttatggattttgggttagtgacactgacataatgatgcgattcagcacgtctttcttgtacttacaaatgcaatttcttttgtaatatcccaaatcatggaatctcttttaatgggtattgaaattcatatatacaatttaaatttggtatatatggtggaaagaagagagacggataaaaaatgaaagaaaaaaagatggagatgaaagcaaaaaaaagtgaatgtatgataatatttatattttttactattttataatataactatgaaaattaatgactgtccttaaaacaagcaataaaaaataaaaatataacatttaatattatgcatgtctttgttaaaaaacatcaatatatttaagacattaaaattgacctacatacaataaaaatttctgagtttgaacctaaaatttcatgtaaattatttcatatttttttgtttctcttttttttattatattgcttaacacatatggcactttatctttctctttttttcttcttctaaatttctctctctctctctttcttcttctatgtacactcaaaatgtaggtatgtgttcattttcctaatgctttttgtttaatttggaatagaaacatagtagaaagaaaataacagaataagaaggataaaaataaaagaaaaataagataaaaaaaaaagtattgtttgaatggttagaaataataagaaaatgagttgtggaaaaattagttctacatccacaagtttggatgattgaaaaagagtcataagaaataaataaattatatgataccatgatgaacctgtgatgaaaatacctccatcggaagaaaataaatacccacaacgtagccaaagatgaaaaaaaaaaaaaaaacaacagagagtgtcccgagattctctcntttttacatgcctcacaagttaacaaactccaccgatctctttcctcattatctatgataaataattttcctttaaacatcccgacacaacgagccaaccttatcaagcatgcatggttgagtaacttaggaagacaacagcaagttttttttttattaaaaaagtaaataattttttggtaaaaatattcgtctgtcatgctccaagcaaagcttttgtttttttttttctttctttctttctgtgatttaggtaagagaagacacatatatttgcatagttgcatgggatagggtattagggtcaaaagaatgctgaatattaaatgatggtagttgcatcattactagttacaaactaataacaaaactttttctatcagtactatttaacacaactatgtatttaaaactcaaatatgaaactattactagttaaccgaaataatattcatatccattcacttgtgttttaatctcattttattcaaaatctgattatttatattgaaactggtattcaggttgaacaacgaagagcctataatatattctagttatagggcttatagcttaattagtactaacgaatctagccatatcgttcaatcgatcctaatgagcaatggtcaatgaaagctaagcatatatgtacaaacaaatgataggtagttctgttcctcaaatgctatcctctttctgaaggtagtacgtcaaattaaagttgtgtttcatattattggagccttggttcccaaacgtcattttcaagagatgttccattttggaaccatggttccccattcatttattgtgtatggattttcgacaattgggaaaatatctatagattgctgagtaagaagaatggacaatgatattttaatgtagtagcatggtgcaattttaaaaaaacgttttattgctgtttgattacaaaggttctgcaagtctttcgcctacacttcttattaattgcttcctatataagtttccttattaaaaggattaatatattatttatacaattattttataatatttttttatcttatttttatttctttttattatatatatatatataacttatgaaaaattgtacaaattcataattaaaggtcacaaatcatggtatctctttttataataaaattatgaaaaaaagtattaacgaataccttggggcaagcaataaaaatccaaaactgttttttataaaaacttataacatttcatattatgaatatacctttgttataactgtacgtacactccaaaatataatgtatatatgttctcatttccctctnatacctttgttataactgtacgtacactccaaaatataatgtatatatgttctcatttccctctacatatacactttttcttgcggagcggaagatgtgatcgatttgaagcttctaaactcgaaagtacttatcagctcatttaaattactttttgtgtttcacatactacagataaaggaaacaagcaaggtatatatacgttcaaaggagagagaagtagtgggatgaaaagaatcgatcataagaaaatgataggaaaggaaagaaaagtgattacgaaattaaaagaatgaatactaaatatgtctattttaagtcaatataaaaaaattacttataaattattcttttataaatggcatatattttttttagtatttattcttttaaatttttaaaccgtaaataaaattaacattttgcacaataaaaggggaaaaacaaacaggccaggtcagtaacctgtgtatatatattcacattgcttctaattttgcacttgtgtatactttttccttgatgttttctttccttgtttatatatataaaaaaaattctttcatatatcacactgttagtgttacactaacgaccgattaaaatttattaaaaataataatttttgagttttacattatatttaatgtttttttcttcttattttataatttattaaaaagaatatgttgttaatatctctcttattttctatcatcaatactagcactatatattatcatgacaattttataatctagagttaatgttggagatgacagtgagacaaaatacacacatgtaatagctaattgttgttaggggtggataaacgtactcaggtccatgaattgatcacagaccaatattttttaagaattcatgattatacaagattgtgcgggtttggataacaggattcgtgggttggccctcaaatccacaaccaccagccaagttcaatccaattaatcctaaacacacaacacaacagcgctaaacactgcaaaacaaaaaacaaaacggcacaacagcgcctcactcccttcctctatgtcatttcttctcctcaatccctctaagtcgcacgccacacctcacggccacagccaccgcgacgctgacccgtttacccatccctccttgttgcccgttccgttagatagaaattcatacacttgagtacctgtttaaaaactacatttggatttatatatatatgtgtgtgtgtgtgtgtgactatgtgtatctataaatatccataaatacttccaaaaaagaataatcaacaaaactattttgtgagcttcaggcaaactgcaggcgcggcaaatatcactttgaattttttaattaaagaattaaaagatatcactttaattatttttccaattattagtagccacgtgcacacacccacacgtacatccactaaacatgtgcattggcacgtgtgtgctcacaaacatgagaaattaacttattccaaattaaattgtttatgtttaacttaaactttttagtataactctttgatttgaaaaatcaagttaaataaatcagttatacaaaatttcatataatttataaattatttcatattttcattaattaattttattttaaacatataatatatttttcaaaatataaaaaatattaactataagactatatacaactataaatattcaatttattcaaaatttaacacacacacatatatatatatatatatatatatatattattacatgctttaaaagcatatgaaaacacttacaataagttaatccctccttcatatgtgtgtagacactaaagatactctctatttgattaaaaaatatgttaagaaaaattagtattcatgatacacataatggaataaaaaacgaatctattttgggattaaaatatattagtgcaaaaatcaaatgaataggatataagctattggattataaagttcaatattatgaagactttatgtgtaaaaaatcaatatatgttatcaattcttttgataagtgaaattctaaagaataaattctctttatactttttaggtctaaaattaagcttgaacttttctagtttttgtttagtacattttgcttttatgtagatgtttttatttataatgttaaaaatatgtgaatttgggtcatttttcaaagaaaaaatgaaagattttatttaaaaataatttcatatctctttatctttataaaaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtccgaaattaaaacataataaataatttgttaattactatgataatttcctgtcaaatgctattatatttcttcttgagaaattactatttacatatcaaggtaatattaattgtaaaaaattttcaattgagtaagctcaatgataacattcacatgtacatcatctatatatgcattttaataaatgagatatattatttatccaataaagaccattatatatattgatctatccggattatcgatatcatattcacaataatcatacgattaaaaacaatttagattaaattataagagacttatttctcatttttataatcaatgataaaaaaatctttaattttaatcaaagacattatcaagttaactattttatcaaacaatataaaaatgataaaaaaataatattttatttattggaattagaattaattcgatcatgtattaaatcttagacatacattattattctcaacaaaatgtatgttcaagaattcatcggattaaagtgttctattttttggtatagataaactagataaagtgcttttttgtcatttgaaaaaagcccattagctaaatcttcaagcaccccctctccccaatacagtatacacaaacacgcgcataagaaaccatatatattaacgaataaattgtatgagtttcgatcatagccgcacttaatttacaagcccttgatccacaaactgtattgggcaaaaaggcatttcattcatccatagtcttgcaacaagctagccaattaacaaccaagccaaattaattttcatttgtttccccttgattttgatgatttaacttaattaattagctagtgatggtatggggatgtttcttggacacgatttttcctcttctggagaaacctctgcaatgatcttttcatggaaagtccagtgctggggctatacatgttataatgaggtgattgcagtaatattggcgaagatggttctgacccagttggtgtcatcacccttctctccgtctctttatttgcgagcattaatatggatctggcctggatgcaatatacatgaccccacttacaactctttttcataatccaaataattgacctaacgactcatgcaccatgtgaatattctgtgccttaattaaattaatatatagtgagactacgtggctactaactatcgactcatttattatttttctttatttataaagtactagtatgaaataattaaggtgacttgataaaaagaaaacctcgagaaaaacatgcaacaaaagtgccgatcggttctacagttgtgtctaatttttttaggtcaaataatgagtctttgctttgatagcgcgaaacttcttggaaccccaattctaactaagcagtcaaatagtcataaatacgaccttctaccttttatatctttcgttgtcttgtaccctaaatattaccaacttgtctgcaaagactttaccctagataaatatctttattctctctcagggtagtcaatattctattttgttacagtagttactcatcatattataaattgaatcaagtctaataaagtaattagtggtaatcataactctcagtatcatctgagatacagtaggaaactaagtcaaattatatactacagtcacaataatttggagagttttttatactattagtttttaaccaatcaaattatatgacatttttattaattatttatttttgtttttaaattagtcattgattataaaaattcttattattatttcttaaacataggttctataaaagtattgaaagtcactaaaaaaattagaattcaaatttctaaagttatttttaattatattttctaatttaaaaagttacaattttaaaaaataataatcaagaactaaaagattaatttgaaaaaaaatttaataaaaagataacatataatttgtttgactaaaaaattaacaatatcaaaatctcctaaattattagagactccatagaaactcttcagagatgatggatgatttccaatagtttaattaatttcggaaatgataattagacacctctttattttaaaaattctatgaatattatctcatattttcttctatatctttttatcacattcaatcatttattatatttttctttttcttttttctctatcacgggatgttaactagcacttgggtgtcgaagtataatttcccaatcatttacccctgtgaatgtcatgttaaaaaaaatgttatgtggtaatagatagataaaagctacgtactttttttttttttaaannnnnnnnnnttttttttgtttgctattggctgcactgattgtgagttatgaccaatgatgatggaattaactacatatgcattttatttttaggcatgaacttctcctttttgaggccctacgtgaaggtttggaagaagaaatggagagggatccttgtgtatgtgtcatgggcgaagatgtaggtcactatggaggatcctacaaggtgactaaaggccttgccacaaagtttggggaccttagagttttggacacacctattgctgagaactccttcacaggcatgggcattggggctgccatgactggtctgaggccagttgttgagggcatgaacatgggannnnnnnnnncctcaagatatacacattgttaaaaaaagaataaaaaaatttctctatctttaagatctcaaaataaaatctactactaaaaaaagatggaagagatcttgagaaatattcaattttactgacactatgagatctaccaaaaagtgatataagatttcaatttaggatctattactaaaaatactcttaaaatattaccattaaaattataaataaaataaaatagacaattataaattttcactaatgatagtagacaaggaagaatatacttgtataacccaaacaacaactgaataatgatcctagaagtatatatatcatctagctaattttaagaaattaaaataaaaaataaaatacattaaaacaatatcatactattctaataatatatcttaacttgtttattcagcaagttctttaaccatttaggtttcaagacgttttttaccttcctagttcctagactatcttaaaagacatccaacaaatgtaaacattttatccaaacccaaacactcttcattttctttctctctttttttaattatcaaatcacatcaccaattatatagattatttatctcttatttctttttatttttttcaaggtttctacacccaacaagtattccaagattaatttctaaaaaatataaagaaagagagcaccttaattttgaaaaataaataaataaattacatggttgataaacaaaaagagcagatatatgtatacctgaagctctgtgacatctgagacacaaatcttgccatcatagaaaatggtcagcggatgttgcagttgctgttgatggtgggggtcctgttgttgtgggctctcactcacttctgcttccatccttcattcaaaacacaaaagaaaaaactcagaaccatgaattaatccaaattaagtacaagctttgtgcaaattatatatatagacaaatatcagaactcacaaagtaaaaccttaattaaaaagaagagagagagaaaaccactcacatgggacgaagatcggagagggagggaggaaaaaggcgaagttccaagttgcaattcttcctcatcttctatattctttgagagaattgaattctgtgacagagagaaaagtaaagataacgtgtaaacaagtaccacaaaggaaaaaaaatggaggatggtagatgtacatatatacatatatgattgaagaatttggaaaagcacccacaaatgaaacacgtaaagcacaacaaaaaaaaaaaatcggcttcggctggtaaacagtgttaaagtatgtttgaatttaaattaaaaatgcggtgtgtgcaattttataccaattcaaaagataaaaataagttaaaaataaaaataaaaataatgatatttttataaatatacgtttaccttaaatatacgatttgcaaactgcaaccttttattcaaagcacacttagttgtaggcagcaaaagcaaaagcacgttggagttgtaatatttattattaattataatttgagcacatgtttcacggttttttaatatttgcgacacaaggcgacggcgtgatgagttgagataagtgacgaatgaatgtattgatgatggcattgctgcgtgcggtgggcaacaccacaagacgaaattgtttctcacgctcgctttcccatgaaacgacacgtgctttcggccaaaccatttatcaaatataacatttttagtgatagatgttgtttaaatattttaaatttaaagatttgatttttattagatctctaaaagataaagtaatataaagaatgagtttttatgaaaaaattatctgtatattgttaaaaaaaataataaatctaagatctcaaaatgagatatattattaaaaaaaataatagagatattgaaattttcaatcttacttgtcattatcagatctattaaaaagtgatttaagatctcaatttgaaatctaacattaaaaatgctcggtattatactgttaataattttttttatggatttttcaaatttttatattaattaattttttaaattttttaatcaatatcttaaaaatattatttagcaaaatttatatttatatttaaactaatttatatataattgacacttaatactatatattaagtttttctttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttaaatatatttcatctaacaaaaaattatccaatgattatttatatatagaattagattggggtctctttagaatgtgaactatgaatgtaataccaggtcttttagtaagtataaaaaaaaaatataagatcttttagtgcatacatgagcatgtgtaaggattatgtatttctattggctcgttctcattcataagattcttattgaatgatctaccacttttagtgattgagacattttcaagtttatatttttgcttattaaatctctcaaagactattaatatatagtcttatgagacaactcaagcgaacaatgtgactcatctttgtgaattttccccacacagaactctcatttgtatctttcatgttaaagaacctaatcaacatttttatcatcgatcttatgcaaaggtggcaaactgagctactcgacctaatactagttaagttgatgtgggttgtgggccatagtgagttttgctgttaaagcccaaattcattttggacctataaaatgaagtccaataccatatgcatcttcatggatatagatcataaactcatcatcaataatagaccacctttatctaatagacaatcttatgggaatctagttaactaaatcaataggttgtagaaccttaaccttagcaggaagaacaatcacattttcaacttgaggatatattctctcaattggaacatgtgcttcaaagggacaatagaagcaacattgttgttagtgctaaggtagccgcaaagaaacaatctcaattaaataagcattagccttatatgatgggatgacaagattcgctacattaagctccaagaatttagtgtgcatggacttcacaaccctagtgtccttgttaacacaaaatatcatatagcctttaccactttttagatatcacttggaaaaaaaaatgactagtcgatcattaggatttttaaactcctttggatattctactgacacttatagatgtgttgtcctctctcaacaggggcagacccaaactccaattagaggaggccaacaaaagaaaataaaattcgtactacaatatatattatcattttttatacaaaatattaataatttgtctctaattaaatcattaatctattatgaatactatagtgtatttatatatacaactagtcaattatatttattatatataaatttataatactaaaacctcaattataaagtataaaaattaaaaataattttctttcgtgcgatgccatgcattttagtcttgacctcttgttaatgtcataactctagtttccaaaatatgaaaattacattacaacaatttctgaccagtctaatgaaactggtttatgagattttaaaaacaataactcctttagttgcaagaaaaatagagtttaacaaaactcaagaaacataaaaatgactatataataactaaaatttgataaaatatttagataagatttcttttaaaaaaagataaaattattatttgttttatattttaaaaaataggagataacaattgattaaataataattaaaatttaataaaatacaatattcaactaagatttcttttaaaaaaataaaattactaatactattataattttgaaaaaattcaatagtaaaaactaaattccttccaacttccttactgccaccataaattatacgtataaaaaacaaattagcatctatagttaataattgcaatccctgcataatgcatggttaattatgtgcaacatttgtctaatcctaaatttctttaacatattgtaaccaattagttagctaacacaaatctcatcagtaaaatatatccttacattagaaaaaataaataaaaagtgaggggggctatggcccccaacccaattcatgggtccgcctccatctctcaataataatttcttcatatatttcctaatatgcatatgatatataaaagtatttaatttacccgaactatatttaattatataaactttttatttaatttaatgtataaacttatggttacaattttgaatgggctctctcctatactgtgtattgaaatagctacattaaggacattttaagtattcaatttaaagtaattaaggacattttaaatagctaataaattaaacttaacaatgaacgcttgaaaaaaaaaacattaaggacattttaaatagctgtttgatatataccgacactcttgatccgtatgataattattgtaagacaaatttataaaatacttggtttgaatgctggtaacatcccaaaaaaaatagttgtatggtcattttttctaacttttcctgttatttatcttcttattttttttaatctagagcatttcttgttatggaggtgaatatgaatgactcaacatacagatatatatttaagaaattaatattaaaatagttaaaaaaaaacacacaattatctgtaaagcgtattatacataatacatgttgttacggaacccggtcactacatgatcccgttttatgcttgtggagctaatagtgtttctattcagccccgagtagtatgaatcaaacagtagaaaggacaattacgatgagataaggttatcggaatattagctacggattcaaccaaatcgtcattaagtttttcactaatacaacaaattaaggccacgtttaatgggggcatgcatgactttacacattaccctgcacagggattatgcaacgggtctatatccatgtgctgtttatgtaacacgtgataattaaagttcattgcagttgtatttttttttttataatcatgccatagttaatttattaaaataagtacacttattgaaagatattgtaacagtaaaaaggtagacgtctgacaaattttaaattactagtatttatttaatagtaaagtaacaaattttttttcctgtgatattaccctagaaaataagtaaaaatgtgtgaaagaattgtgctaattaggaatgttataggttttttctgtgatatctccataaattagaagagaccaactaagctaacaatttgattctatatttgaatttaaaacatccaaagagaatcatcttgattttgtgacttgggtctttaatttcttaactaaaaattaatgttccgttgctcgaatcagttaactttgaacatattctcaaaatgtcactaaaagtaggattttattagtattttgttttttgctggtacaattcattaagtattttattgatcttgttctccaaaagattatataaattactgaagtaaaactacaatttcaattaaaaaaacacacacaaataattaacatctaatcaggatttgtatctaagttttgtcctacaacaaactgcaaaattaatgaactttctggcacgatgtctagccaacacaattttatgtttgtttaaaaggtttaacttttcttttggtggtataaaattggatagggatcttctcctgttagagttttaaaatcagatgtcctgttaaactaatctcaaggatggaaattaaaacacttgaaacttaccgtttcattaaccaattaaagcaatacccgagagagcttgaagtaccacggcattcactgttagggtgttctagcagggaagatatcaagtctgcagaatgggaattttcgaactgatgctgtcagaaatacccgagaatcactctctcctgttaacaaggtgtgataaaattctcatgttaacaagcacttttattaaagactaggtgtttctgttttaaatttttgcgaattgattttaaaatgttgaatatgattatgtacaaaaattaatttgaatcaaaatattatattaatatgtgtgttatgatgtatggaatttatttgaaataaaatcaaactcccgttttaaaaaatatcattgttaatgattagcatttcctaataaccattattattaaatttacttgacctgtacgataacttagaaaacaaaaagacttattttctggagttttaaatatgaaaatatcttatttgcaagggaagtagtgtgttattcagacgctacattgagagatggaaagcacaaacaaggggaacaaatgtgcagtaatgaccaaaagaaaaaataaataaaggcatgcaatgtgaggtcccatgccttataaggcccatgtttcctgcacctcatataattttgaggatattggtccccaaagtataattcaataataaattaatcctaaaagatgaaaaatataaattaaatttttaaacgtacaaaaattatgataaattaattattccattaaatttgtgagatattttttcattaagttataatattcaggattaatttgacaataaattatatttttggaccaatttaatattatgttataaagttttaggaactaatttattaataaattgtttgttgtactaatttgtttatgtatattcagaaattaaatttgaatttttcatcttgtaatgaccaatttgtggatgcctagtacttttgggacaaatttgattatttattcttttaattaaaactgaaaatttcaaaaatatccggtgccactttttcttcttatttgcacagcgtaatctcattttcttcgtgcaaaaataccctgtgacagccaccaccctagccacttttttgttcgtccatatatattcaagatttctcacatctcggcctcattatttgttgagatccggatcagagaatccgtaagtgtttgtgtttattccggactgtgcgttccgtaacatggaggtgcatgccgaaattggtgaggtgcaggaagcaacgaccccattctaaacggggttaagtccaattagacaaggaaaatgcatcatcgaccacaagaaagaggtggtggtgggggcgatggaaactatgctcacaagtgacagagtagaaccaaaagattttagtaataactaacataagaaactaggtgaacgtaactgcacagacacaactactacataaatcttccttaatttctccgcccacttccctcctataaataaatctttcatcctctctcttctcttcatttcatttccatctttcttgggtgatccaatggcgacccttttccagggattgggagttgtgaacccatcattgtcttcttccaactccaacaatttcctgcttccttctcgtacttccctctcaggtttgcttcttaaatttctttcctttttattttttccttcaaattgcttattgagattttagtttcattctgtgtgcgataattgattggttcagagaggaaagatagcatatttgtagtcagatctgatgcaagggtaagcagccaggttctgaaggctggagctcgtaagcatgaattgttggttactaatgcagttgcagtaagttatctcatgactctcattccattcccttccctttttttgcagtttggtttgggatcaatgttgtcatcatgtttgtaatttgtgtttcttggttgtttatagacaaaggaaggcagttctgcggcttctacttcaaaatctgggtatgtctctttttgtaatcacttgctagttgctttttgtatttccatgttattcaaatttaagcattttaatttttttttaatgtgagatgaagctatgctgatatgttcaggttgttttctcttttgctgattgattgacttgattttagttaaaaactgtaaaccaatggttatgtttcacttttcctaatttggtattgtctacaaacaattggcctatggttggatgggtactggaaatgacaatgcatttcaacataatagaatctgcatacctttgcaatttcatatttttccttattcattccaattaagcataggtttagagtgtgtttggtatactatacatgcaaatggaagcatggtaaagaggagaaagtcaaaacagtgaaacttagcctaaattcccgtatttatggatgagtgaatagtgtggggaactggctgccgcttcatcccatcatcagcacatctttaccctttgataaatgagataaaagtaggtccagattgtagttataatgtaattagtttatttagtttatgttctgatttgtttataaatgcttcttgaaagtacaaaatgatgctgcacaattttattcctttccctttatgctcttaattttgtgatgaataagaggacatattccatcagaaaacaatacggcactgaagcaaaagaacagacatgctctatagaattgactatacaaacctttccctgtatgccgtattactgaagacatcctattcctatgtgttaaaatatctagaggatttctcataatccatatcaaataggaaacaaatatgaaaaccactcgaaagagattatcctagatactttaagatattctatgataatgatgttatgagatgtatcctagatattgttacatgtttatgtcaaacctttcatgtgcttcacccagcaacataagcttttggggcaattacatgatatcaaaacttctttgcaagtgacgagtttgattcttttttctaagtataatttaattttcagtgcaaggtagggtggccagctttgaacaatatcattcacgtgttcttacccaatattttaagcttttggaatagttgtgtacttgtcactttacaattccttgtaaggcaacaactcgttgtcccatgatacccacaatacttcttattcttgctaagattagtaacaatatccatacaatgtttatctttgttcttaagagtcaagagtcttaccctttttctttcactataccaaatgtccataaaaggtaatcaaattataaggcgccacctctcagttgagagacaggttttgacttaccaaaactaggaactgacaaacaaaaataaaaagaaatgagatagacgaaaaaatagtctggactcccttatttaaggaccaaaacagataagaatgcaacaaaggattatattttagatagattaatggatgaacagcctcaaaaaaagattgtttgtgattggtggtcccttgatgtggtacttcaaaacttttgtgtagaaagccttaggaaaactccttgtagagtgtagaccaaggatcagattaccttgttacggtcaaaatttagggatgacaacttctttaggtctgaaagaatattgcagtaacaaaaaagagttaaggtgacgatggttgaaaactttcaggatgttatagtgacatgtaattcagagttgctaaaaaacatttttttttgtttgctattggctgcactgattgtgagttatgaccaatgatgatggaattaactacatatgcattttatttttaggcatgaacttctcctttttgaggccctacgtgaaggtttggaagaagaaatggagagggatccttgtgtatgtgtcatgggcgaagatgtaggtcactatggaggatcctacaaggtgactaaaggccttgccacaaagtttggggaccttagagttttggacacacctattgctgagaactccttcacaggcatgggcattggggctgccatgactggtctgaggccagttgttgagggcatgaacatgggatttctacttctggcatttaaccagatctctaacaattgtggcatgctccattacacatctggaggccagtttaagataccaattgtcatccgtggacctggtggagttgggcggcaacttggagcagagcactcgcagcgattggagtcatattttcagtcaatccctggaatccagatggtggcttgctcaaccccttacaatgccaagggcttgatgaaagctgcaatccggagtgagaaccctgtgattcttttcgagcatgttttgctttataatctcaaggagagaattccagatgaagagtatgtattgtcacttgaagaagctgagatggttaggcctggggaacatgttacaatattaacgtattccagaatgaggtatcatgtcatgcaagctgctaagacactggtgaacaaggggtatgaccctgaagtaattgatatcaggtctttgaaaccatttgatcttcacgcaattgggaactcggtgaagaagacacatcgtgtcctaattgtggaagagtgtatgaggacgggtggaattggtgctagtttgactgctgctattactgaaaatttccatgactatttggatgcccctatagtatgtttatcctctcaggatgtgccaactccttatgctggcacattggaggaatggacagtggttcaacctgctcaaattgtgactgcagttgagcagctctgcaagtgattgctacaaagcactagcaattaggatatggtttttggtaaagctattgtgcttgttaaattaagcttgaattttcatcatgattttctcttttccttttatttctgaagtctaaagcccataactttaaattgttctattttcgatttatcattgggttcatctaccaccgaccccaattaatttgggttaaaggtgctgttgatgttgatgttgatgttgatttagaactttagaactgccaacccaatccaaatctttctctgcttgttcatctgcatcatttgtgtggtgtgtgtaagagttaggcaaagccttataactagcgagatatttgtagtcagtgctgaactgctgaagccagcaaatatctgttacagattttgaatatgctattcaatcctagtgttaggcttctgagttctcgtgttctaattggaagttttcgtgtcagtttcatatatatagtttagttagtaatagccgtgggattgcactactgctaaatattcacctgcacggaacagctgaaatttttgtattcacctaatatctttgtaatttaatgcctatacattgtcagttagtcaatcacaaataaccgtttaaattactttaagataattattttaaacatcaataacttatcatacatgggattgtaaccggatgactgtaaaacttttacattgtcaatgcatattcttctttctcatatctttatgcatatttatcatcttgacgataacatttgaggaaatttggtatatgttattaagcttcaatttttcttactattgctgcaactactaacttttagcacttcatctggtatacgtgcatgagaattttatcgtccaatgtactaaattcctattacatagcagctcaatgctccccaccaatgacaaaataaaacaatcattgaagaacacgagttgtgttagaattaagggacttttctgtgaacatggtaatgtaattgtatgccaggttgtctcaaagcccatatgtttttggtattgactatagaccatagatattttctggtataaataattttgtttgaagcaggtagaactattatgaataacaaatttttttctgtgtatttaaagtggcttagaacccgaattggtgatctctaattaagctagaagatattgtatgtctgataacgttttgtgttttcttcgagaaggctattgaacttgacagcttttataggaatactgtaacaaaatgcgttgttgggttttgaaagtcattgatcattttgtaagtggagggtgaccgggggatccttccacattgagttacacgctttctctagttctctaattagttgtcaagtagggataacaatgggtatgatcccacggtatatgttttcatatccccattttaaacaaatctccatatttggtcacatatatgtgtggatactaattttaattttcatctccatacccgttatatatctataaacacattcgcattcacaacccgcattttagttatacataaagttaataaatcaataaaaaaaattagttaaaccaattactacaactaaattaaaaatacagtcttaaatttaaaaaatataacattaaaaacattcatacttaatattaaaaacaaacaagcatagattagtttaaattcaggttataaataagtaacattacaaagataatcatctaatatagtaattcttaaagttaatattctaataacttaacaaaaactctaattaaacttggatgttatgtagtgacagaaactctttaagatctgacaaaaaagaatatattgaaactaattaacttataatcatatactataaaatttatataaaaaacacaaatgaataagatatttgacctcatcatcataatcaacttctccatattttttcaaacatttatctcctaagtctatatattgctttggtccactaataacaatagaaactagaacattacaagaagacaagagattagactatcaaaacaataattaaaactatcaataaaagattagtcacaaataaatgaattagatttagagtttcactccactattctaaatctctattactatcagagtattagttacaaaattttaaaaaatacattattattttttcacaaaagatattatatatatatatatatatatatatatatatatatatgacatatgcaagacaagacgagatgagtattataatacctgcacccgcatccatacctgcataaatttgcgaataaatattcgtccctgtatacaatcacaatatgtggatagttatccttcacacttatggatatttttatggataattatcaatcagtaaagtggaaccttgaatcagaatcaagcttcaatgtttttgcctttcctttccttttgtagtataaaaaatttaaatataagacatgtgaaccaaaactatgaaaaccatttctaagaatgaggggaaagtacgtagatagttaactgtatattttgggaaatgtcttattgtatgtggcaattaattatttgactgaagtactgagagttggcccaactttgatgaggttttgttaccacttgttgctactttaattgaatatcagatcattagatttggaataataatctcatcaaacaattgttataacatagtagttagaaagaagccttggggtgtcaaagctatattttacttgaaaagtacctttgcaatgggcatcgttgaacaacgttatataaagagttaacatatcaattctttacgcacaaaagtttgaagcccatgttcagtccaagttctggaggcctacatggcctatgggctttgatatagatgatgcacttcaatgataagctatgtgattgtgatttgcgattgggaggtaattgaggaagagtaataattctttcttatgtagcctgagcctccatcaaaggatcaaaattaaatttttttttatctttaaaattttaattttgcttctagtattttactatgcatgtcttttaatgaaagctattacttatccttgggcttctaaaaagtggttcatcttattaaggtgtactatattatataatattaattagaatcatttttggataacatcattttatattaaattaaagaaatgatactgaaataatatgattttaaaatccgtgaaccatgcaatatagtttggtttagactgcacatcattttatgttaattccatttgtgattcctctcaaagttaaaaataaaaataaaaatagtattagtaaaattttacctgaatactgagtcgttttttttacataattcgcttagaaattgtcaaaatgatttaattccgtataaacactatatatataatggtgctttctattatgttgatctaggttaagtgagcctcaggcctagggtttatttatggcacacatgtacataacttattctgctctgctttcaataataataataatattcttattatcattattattattatattgacatgacaactgagattattattattattgtgattattttgggcaaaaagtgcctgaaactacagacttaaaaagcttcctgtgtgactagagcaatagtgacaactaagctgatgaggtttgattacaattaatgtttctaaacatttgtatgcagccacacaaattggttttcttttattttgtagtgcactttgagtcaaattcaaagggatatgtttttcttttactttttttttggtttaaaaaataaaaatcagcgtaaaaagaaggcaaataaatttgtacaaagaagaaaaaaaatatcctggaaattgtacgttattatatatattcttcatatcttctcctcctgtcggggtttctcttataaagaattggttttcttgtttctttggtggcactgatcgatcaatatatagtccttttattaattttttgacatccaacaaactgaattccaacacaaaagggaggacatgaaaataattctttttaacctacatgtgaaaagtacattgataaataatacattgcagcgaaaacctgagtctgaatcgagggcatggccgagacatgctgaaacatgttgtcgtggattttgtaaatgtgcatgcatgtggtctaaatataattggagcattgctggttattaaatatacaactgggccaaaataattaatatgcatgacacatcagggtcttggtggtctattaatcaactgaaatagtagttaatatcttgaagccaaagatggctacccttttccattttattggcaactgctttctgctaggtgggcattcaaatctaaccatgtggaaaaaatgatggaataatatcatgatgtgatttgagttgtagcagtataggtttggttttgatatgtctttttggataaatttttaatattcatattatcaatgaagcatcattttctggcaattgtgtgttccattctgggccacaagtatcgcttaacaggtaaatagtctcactccacaatatgatctttggagattctcgtcttggaattggaattcaatctcctcgcaaagaaacaaaaaggaattggatttgaatctagttacttagattacaaatgtttctataccgtggttttctgtggaattcatgttctgaattctccaagtggaatttcccccccttctttttttaaaagcatttgcacaactaggctaaaactgaagtaaaatatatagcattgtgatatgcaatatctatcagtaggtgcagaatattaaatactcaaaaaaaaaaaatggatcaaatttcatttaattttcgcggctccaaacatgcttcatgatgtgtttaggtccatgaccacattcaccaccatattaaaagaatctgcttatcaagcatttattcagttacatgcgtagaatgacatgctggcgcgggcagcaacagaatttcgacctagatctttgtaggtaacttttcctaacgttattatatatgtagccaagcgagttaaggaaaatatataataagaaaggtgagacaaagttaatctaataaattttggccacacaatcatacatgaatagtgaaaatcatttcctccctctctcaatatatatgtatttagtgagaaaacttttttttatgagaatgaaaaaaataatattaattattaagttttatcatgaatttgacaaaattaaatatttaacttttctaattgattatctgatttcctttttgaaaattttatcatttatatatattctcattttaaaattatacgagaactataaactaagtcatacaaccataatggttatgataattaaaatgtactagtaattagtactcacataactatttaaaacagttaagtagtgtagttatcttttaatctcgatattttgagtgttagtgaaacgggattatatgcgttcctattgatctgcccaatttttttataggaacaatttttgtgaatccaacccaatttaattaagacatgataaatatgagattagactacgtgtttggcatcatatattaatcttaacggtatatatagttaaattataaaattaaagaagtatagattacaatatatattttatgataaataatatcaatataaatataacattattttagacaaatataatttattaagttaagaagatatataattaatacataattattttaaaaaatatattcttaaaaagaatatatgacatatacattgagttgggacgtcccaaaataaaagtcgaactctcgtccttaaaatacattaggtctaatttcttatattcgaaatcatcaaaagttccttctaactaatttgaatcattaacaccttcatcttgataattaaaatataatctaataatttttatctattgttttttctcacattaacaagatttttcactcgatatgttctctaaattaatcttaattaacgagggtgtgtgggcttagaacccctccctgcttggctttgaacttctcttataatgagctcgtaaatggttatgttcttaaaaatcttgagtttagtcattaagcggaattagataaattggtgcaactattcacttcacatatgcaacataatgtatcttgctcatcaatcatcttcactatatgaagttatcatgaaatagttttgcacgtgccttctaatagcaagggtaatgatacagtgttgttgattcgcaaaagttaacacgcgttactagatttatcatgtacgtaactttcatataaaataataatgaaattaacggcttccaacataaaatcctttcagatatgatttgtctcccttcttgtcctagtgcggctcgaaagttaatcagtctcttcatgtggaaaacatgtgtggttctatctaacattcatgttgatgcattatcatttctcaagcaaattatcaaaatccggtctttcattgtttcatataacttccatttactcatggtgtaacaccccggacgtgttatcattaataatatcataagtgcgctatcagcgttatctaaatgcggtgcggaagcgatagaatcgattttcttgattacattatgcatggaatataaaacataacacaaagcatcataaacaagcctctgaggatccagttaactcaaacataaaacaacataggcagagaacatataagtctaaacagagataatcaggaggaaacataattcatacatatacatagcctgtacatatacatacaactcatagttctaccacatctgtggttatacaacataaatatgtacagataacgggtgtacgctcacaccctatactatacagaatacaagacagagataaaaataaaagctcttctaatcttcatctgcagcccatgatcactccagcaccctcagctagggcctcctgccctgtagtaacttctctcctctagaagtacctgaaaaccacaaactccacacagggtgagacagacatctcagtaaactcagggttttgggagatcctctctttccctggtccacccccacgcacacacacaaacagataacagagctaaggacaccatcccagctcacaacataaagcctaggaccttagcctagctttcacacaatcccagctgtctgggtcatcaactgatgatctcagcatcagaggtatcccacctcatactggctctcaagccatctcagactagtctcacaaaggtacataacataagtgtcaaccactagacacttctcataccagagaggcaccgcctcctgaaccatataaaccatgcctgaggactctcactcaggactttactcatccagatatggcttatctaagaggctctaggctctcatcccctcgggaagccctctcttagagatgcaacatatctgtctgttgcctggcctctccaggactttcataacacatgcctgggcaagaacatccatatgggcaatcaactccaggactttcacagcacatgcctgagagagatcatctcacaacggaggcactcgatcactcaggacttcatatcacatgcctgagagagatcatctcacacaggaggcactcgatcccttaggactttccactgcctgtgagagactatccactcagggagctttcaatcccacaggacttccaatcacggtctgagagagactatccactccgggagctctcaatccctcagactatcaagccgccacctgagagagactatccacacagggagctctcaatccctcaggactttaacatacactggcctgggaaagaacctcctttacagggcaatcacatccaggacttatcaacatcatggcctaaggaggaacatccatatagggcaatccatccttaggactttaggcggagagcagtggcacctcccatggaatctcagctattccaaggagtcctcaaactcttcctctggctagggaacctcaactagcccgatactagtctagtatcctgtagattccatcactgaccatctcatgatcttcatctcaatcacagaaaactctcacagtgttcatcaatctcgaggcccaaggccccacacctgaaccacaggtgtcaaaacaccctcacaccatctcggtgtctatcctagggttcatcatatattcatatatctcaaacggtctgagtatcccaccaagatccgttcatctagcccttcgggcttcaattacatactaatatcaataacaggccttattggcctttcattctacagcatgcatataacatatataatctaacatagcatgcatcaatcacccgcttgagtggcaaacaagaaaaatggactgatccccagagcgatgagcttacctgatagttgtgcctgcaacaccaacctctgaaacaatggtctgctcctctgacacctcgtgtcaagccctatcaaggcaaccaaatgcatatcacagaccattcaagcacagaataactataagctcatcaggcagtccttaactgtctcagagaaaggaacctcggtccttatcatcaacccaagttatctaacttaaggtttctcaggctcatcctctacaagcctttccatagaccctcaatggtctattacagatcaccacagactcaacacaagccaacaacagtgagcatcaaagctctctcaacccacactctcagggtttctcagagcttggacggtctatctcgccagacaccgtctccatggcctatcaggcatctcaagcccatcacaaaggctcttgcatgtctcaaatcaagtgactcagtccaagtcacacaagcacaacctagagccaaaaccaacattcgccaaatcacaaactgaaagctaatcctttctcctctcatcaatctaaacacttctctcaactagaccaagagctaattctagttctatcacatatgggtcactattcacaggaaacccccaaatccaaaatcaatcggagaaactcgagtttcttacctcagaactgatgaggaaggcctctgtgctactctccctagccttggtgccgtggaaacaccgccgttcctcgtccaactcgagctctacaacctctttctgagaaagggcttttttggggtttcaaggagaatggaagaaggattttagctaaaacttggtttatgagagttttgataggcttaggaaatgttttgggccataaaacatagtcatggaagcttgggaacctcagccatggaggttgggacgctggaggaagaaggataagagagaaatgctaagattttcgcgttttgggccttttataggctcagacgtgactcccacgcctccagcgtgggctggcagagaaataacatttctgggctgcttcccacgccccaggcgtggactccacgccccaagcgtgagactccagaggaaattgattttctgagttgtttcccacgtccctggcgtggacccccacgccccaagcgtggaacctcagaaaaccaaaaaaataaaactttaaacgcatggttataacacatggtgcccattgctccaatgtggttctgatgacttgtcgttttcaaaatgtaatcaaagcaattcgattggtcttatcatgcattcatgcgtagacagattttgagtatatttgacacattcaaatgaaatacaaaaagaaagtgcaacattaagagctcattactcatcagatttagtttgcaggttaaccaaccagttcatagacttgaacagtttacttaaaaaatatattattatacactatgtcctttcctttttaaccgtctttgtcttttaaaattgttatgtaaaaatcaagaaatgtaataaatcacttacaagtggttatatgcataaatcactcagcagaaaatagccgatcctatccaacaaattgttctgggtctgtctacagctaggtaatatagtttcttgtctctatttttttaaaaataaaaaatggcaaaaaaagttggtaatcgttactatcggtatatgatattattcaagcatcggtaacaataagtctctagaagcatgcttcagacaaatctcaacgattttggctgcctagctagctttgcatcatgtggaagatttatggaatcatatcgcaagctggctttagatatttggataattaaattaatatatatattctgttccttgttacactcatcaactagagttaccatgtgctagctactttaattccctttgtcaatgaatctctgctaattggattcacaaattatccttagacaaaattgtcttttaagaaatttgtcatgaaaaaaacatggggtgtctaatactctaatttatgtctgatatcatggagtatctttctgtctaacaagctgtataccgaaatttataggatcagcacaggttctaaaaatatatatagggttagatgattaattaattaatatatactagttattttgtgccttgggggtaataactaaattcgttaaaaagtctacaacttcagtttatatttttttcccgtgtaaaaccaatggttgctcatggggaccattagttgtgtctgtgcatcacatggaaggcactgcacgggcatgttacactgggaaactatagttgatgcattgaaaggaacccgcaaccatctatgttttgatatagttgtgatcgatgactatttccttggtcgtgggatacacataattgaaatgttggctcttccaaagatagctagattgagtaccgtcaattgatatcattgtatttatttgtttgttttttggatataagcacaagaaaatggggaaattttgttgatgaaaaggataaacatgatatgacaaccaaacataagcgacgtgaaaacattggatggtgacccttgggagaaaggctcatcctgcaaattctaatcatcatatgcatgatttaagtaaaatatacctaacatgttaggaagcatgcaatccatagaaaggcttaattattcccatgatcattaaatagacttaacacagttgggaaatgcattaattttgagaaataactattttttaaaagatttttaagaaaataaacaaaatagtttttaaataaattataccaagaataaaacaagtttatttggcactttcttttacataatatctttccataatttttttccataatcatcactggtctctgaatacggcaaaatgttgaaaccaaaattcttatcaataggtatttttcattcacataaattttaaaattaaaccaataccctacgctcaaagaattaaaatacattttactcaggacaatatatatatatataaatatatatatatatatcagtagtcttaatcttaatattactttagttaattagctagggtggttgtagagaacaaatttaaattacatggactctgggtgaacttaagagccaactacttataaacacattaatgtaaaacatttaattaatgtaaaacatttaataacaggttgcatggagccaaccaaatttaattctacattccattagactgtggctcaacctttctttgatcgaagaggcaaactagctaacttcatgattgctgagatcgaatgcctgcctcctttctttacctaaatttttgtatgcaattaggtcatcctcagttgtcattcggcaattagctacatatccttgactcccactttacaggaacatttgagcttcaacacactacaactttctcttgtactttttatttatatttgttggatcagcaacgtaagatgagatatggtgcttacattagagaattactgtcatatgtgtttctcactatatatgaacgctggcgacctcgtaaataacatgtctcttatatgtttttattcaatcaggatatatattttgataattctaaaaaaaatgtattttttgagagagtatatggtgtcattttttttataaattagacttttttttttttactttaatattttagtaatgaagtataaggtatgaaccaacttgtgcattttgacctaccgtttcataagctaannnnnnnnnnnnnnagtacaaagaatactctaatccttaaaaaaaaaaaaaaaacactatctttcagccaatagaagacatgatacattgaattggacagctagctacaccatgcatgtagaaaaataaagtctaggaatttcaaattagcaaataaaacctaaccttaatcaagtaaaaaatgtaaacaaaatcaataaaacaatctctttaaaaaatacattaattctcaacaacaaaaggctcaaaactgtagaatgctagaacaccacaccatccaatcctttctttctttttttctttttcttttctttaccttagttagaacctctaaataatcctctatatgttgattaatataatattcatcaggggcactggctatactttgtatgtggacctatatatttgatttttaattcaagatcgcttaaccgtagcaagagcacgaaaaattgagctttcttatatactttgtatctggacctatttgattttaacttgatcccacgaacatatggttttaattttggtttatactcattattattagttttataaattaacctttattatgaagggtaattaattacgctgaatgtactgcatacgaattgcataaatgatagtatacgtgtatatctaaactgcaggacacgtgcatgttatgtgcaatgtccgcttgttttcactctccaaagcacgggactatcggttctgcaacgtagcaaaggcaaaatcctgccagctacgagctaataaacgtttgcatgcatgcaagtgaattaccaatgggctgaatttaaaacgttacttgaacacactagagtacaacaccgtttacttcaggattttttttttcaagaagttaaaaaaaatagtaatggaattatgtttaattagctttaattaatattatatttattggaaattaagccagaatattttctttacaaataattttggaggcatcgtttctgaaaataatggcacaaaatattttcagtaatggatttctcttcttgttccttcattatttagttccgtttctttttcctgtcaagtatatcctccaatatcctttaaatttgcctttcaaatcaacttacccttcaaccaggttttcttgcatacagtgcgttccgatcttgaaccgtccccaagaatatcggttggaaaattatgtatgggacactattatatactagtcgatatttaatgacaagaaaagaaaagataggaaagtgtgataaatgttactactataatttagaaaaaatatagatattaataaatgttataatgttaaaatgttcacatatatagtagtaattatccatttcggtttcagtttaagttactttttgctaatggcagttgactcttcaataaatctattgactcaaagtatgtgtcattttgtataatcatttgtcagttaaagtggaacaactataacatcttataaaggatgtatttggtttaaaaaataaaaatgaaaaagataaatttgaattaaaataaaatgtaaaagatgtggatttcataaataaataaaaaaaaactatttttcttcaatatttaggagactttcaattttcttcaccgcagggaagcctctagaacattccgtagtggatgatgacacaagcatgagaaagcggtgccatatatttatatattttagaaatagaaaataggaagtaatcaaatatttttaaataaatttaatttaaaaatatattaacagtgtaaaaaacataatatcgaaaatgataaacataaattaaaggtgttggaaacaccaggaaaattaatgtgactaaacttaagggcatataatagaatgcaagaagctggataactgtgacgactgtgccaaagatgaagggatgatgtggataattaagatgagaatgatttaggtgatgaaaaaggtggtagttcattagttcgtagacattatcatcatttagctatgcaacagaatcatcccgtgtaaatatattcctgtactctatgaaaaaataagattgtcgacacaaccaaacatatcatcataatgtgtcttatccttaataactaatatataagtatcctcctatctcaaactcataactgataggtaactatttatctcactaactcatgtacaccaatattataaataagagggatacagcaggtaacggtatcttctaactatataaattatttatttattaacttaagcgttagaggaattttacaaataccacatggctaggagcagcttagctgttacaccttggtggaagtgctttaactcaaaatgttaaaaaaaataaaatataatgaaaaattataagactgacgtaattgaaaatttcaaacaaatttttatgtgaccccaataccacattggacaagatatttacccgttaagccaacttccttggcatataatattattttacaccagttaattatctaaaccctataacaaattttgtttcttatgcatgtataaccaatgggataaagcacttaatgggatggatgagactttattataattactaatattatttgaccgaccagagtgtgcaacttttggacattctttttagttaatataatccttggtgtttcgtcaatgccccttaatccaaggtacatataatatttacaaagttatgcattgacttcagagtttaatgtgttaatgatataaaataattttatattattatttaattataaattattgttaatatgatttacaagataattttattagagttaataaatttatcatgaataattatttttttattaattgatagcgtaaaataattttatattattaattattaatctttttatcttgatatagaaaataaattatttattaactatttaactagtcgaggacacttttcttctaattatccttagaagaaaatattaaagttaaaaatcagcctagctaccaaccattggacgtgtgatatgtctttttggacaattaattttaaaagtatttttaaatctattatatagaaatcaatctaaaatgtcgtattactaaaatctcatcatcttacatatcacatccattgtctactatccgatataagtttctaaagtaaaaaacgtttttttaagaagtgttggtgtatataattaagataaaactgaataagataaaactttagattaacgtggtaagtgagaacaaaggcagtagcatagcatcccatcaaaatcaacttgtctcggaaaggatcaaggaaaagcacaagaataacaatgagtgaaaatttggctttttggggtccatcattgaagaggtcttttaggcagcattagaagaaaatacgactttctttgactacaaacctacgataaaggcaagtgggacttcttgtccccattgtcttctgtcattagacatgtaactttcaatgtcttaataaaccttttgcaaagttatggccaatattgcttcttcggcaaaatgaataataagtttattttaattataatagaatagatgtaacaaataatattattaatactacattgtcaccattttcctcttgcttctgcagcatatatgctctctaattattgtcagaaagagtcacgttttgatgcgttttttttctttttttctttttccattttcttacaaacattttgatgctattgaaacacgaactttttgtgtggtaaagatcacgcttaaagggagggaatcttgacaaataaaatttacctaattcaaacaagcagacaaacaatatttaagactttgtggttttgtaactttctccaaatacgtactagcatatggaagaaattggaaaatgatatgcagaaagcattggtaaaatttttcttattaattaatccagtgaagataattaaaataatcaaagtaatgtagggtttgctggtgtttgtttttctttcatggaagagatatgatattttaacttttttaggacactttagttttagacgaaacatcaactacaatagaaggatgaagacagaagaaggaaaatgtgagagcaaagttataataaagaagtgtagtttgagggtattaaaattttaggggatggcattaaaaatggagatgcaggaaacaattgtctcgatgacctctaaaatgaaattcaagtctaataaaagtctaatttttaaagcttttgatggattttgcaagctaaacctgtatcggactattttttaatcttaattttatnnnnnnnnnnnnnnnnnnnnnnnnnnnnnnnnnnnnnnnnnnnnnnnnnnnnnatatatatatatatatatatatatatatatatatatatatatattaaatccctagtttaaatgttgttcctttatttcctgaatttaatgaaatggaaaaatggtccttcaatttgtaacctgttttgtcaagttagtcattctgttaagtattatgttttaactttaacaaaacatcatattacaatccacgtgtgttaggactattttgaagagtttaagggttagatgggaaaagttgtaaaccatcatgttagtctttgaattttttttggtctcttcttttatgaaacccttctttatttcttacgtgtttaagggaaggttaagtcacaatcttagtaatatttcttagcgcatccacattggaacaacttataatagttacttccaatgagacccgtgtatacatattatttatttttattttttctaatacaagtaactttaaataacaaatttttacagtgaagtaattctctttagttcttctaatgggttccactaataatacatttatttcaaggtaatgttttatgagtgacaagcaacttaaaataattatatatatatatatatatttttattttattaatttaataatgtaaagcaatgttgctttagctagcaattgtaccaaggaagcaacccgtccgtacgcgactacaaaggtagttgcttttgtagcaatattgctttcagtatcctatcacttcccaaccatgtgatggccttagttttatgatacaatgtcaacatgtgatatttttttaagaaattctaaattcctcaaataatttttatttatttggcttaaaatgaactttaggggacaaaaatatagtatgatttcaatatttggagtgtttatgatacaatgtcaacatgtgatatttttttaagaaattctaaattcctcaaataaattttatttatttgccttaaaatgaactttaggggacaaaaatatagtatgatttcaatatttggagtgtttatgatacaatgccaacatgtgatatttttttaagaaattctaaattcctcaaataaactttatttatttgccttaaaatgaactttaggggacaaaaatatagtatgatttcaacatttggaggggattaaaatcaaggaaaaatgtcttacaaggtctaaaatcaaaattgataaaaaataatttttaattttataagatgaaaaacaatgaaaacattttataggaaccaagatcaaaactcactttttataaagattaaaaatatatttaataaagtggtggtaaaattgagttgaatatactaatattaaatattaatagaaaaattaaccttacagtgcgtgacgtaaattggtccccgtctagtgatgtaatcacgtagcttaacacgtgggctaccaggttttgaccaccgtatagttcatattcataggttagattttcaagttaacaaatcgcaaattcgcaataatccatatgattaatttagtagtaatccagtatcagttttaaaataagtgtcaaaccaatcttttaagtaattggataatcatacactgccacagtaccacttaagaagagcataaaaggaaacgaaactaaccgctcgtttatattaaatgttgcaataatagattatgcagttgggtacagacaatctaattgcttacaaagttgtttagactcacttaaacattgattcatgagataaaatgagatgataagcggttagttgacgttccaaatgcagacaacactttgacggatgacaaaggactcagaaagacaacaagtatatgattctgttcattcagaaacattttttttctctcaattttatagaaatattttttataaaagaataaaatcgtgaggaagaataaaaatggactgcagaacagatcaaattgcagaagcaaaagccaaacagaaagtgaattatttcttttaaataaattaaatttatatatttctattagaaagaaagaaagagaaagcagctgagcttacatggtccaaagctacaagctgattcccgaaagcatgtttatgtttattcacccacactggctcgctcactacaaacaaggtaaggtagaaaaggcacataataatatgaacatagcaagaaaatgtttgttaaaaaaaatctgaaatccttttaatgaaaagtggagctggagtcactggggcaaatccttagcctccacaaaggtgccgtgaaagccatagggcactctggaaggcagcatgatggtggcctccaacttcaaatcaacggcattcagaatctgcaactcggactgccacgtcacctcgtcatgcacaaaagccatcacgtacccttcatcctcattcccattccctccactgggcaaaaagaatggctctcctccgaaccttctctctccgtactcgtgcctcttcacttccccactctccaggtccaccttcgcgaaacccgacaccttcggccacggttccgccatgcacaagtacgcgaaccgggtttttctccccagccggttccggttcaccatccccgcctcaaggttcatttcctcaaccaccactcgccgcgtcgacttcccgcttctcaggttaagccttatttctgttaacacgcttttcagactctcttcggtgtcgttgaagattgaatccggtggcgtcatgcaggaaccaattaccactacttcgtctgtgtcgcgttcctcccacgcgttccagaagtggaagaagaacgtgtctggcgactccacccacacgatcctcgacgcgtcggaggcgtacttcggaagaattccgaaccgcgatttcttctcgccgtcatagatcaccggcgagcctccttttatcatttcgccgagcttgaacaccacctgctggtccgggatcacgacgaaattctcggtgatcgcgaagtcgtgcgtcatcgtcggagcgccgagtgggatttccacgtccggcgacttcttctcctcctccgccgagaaacggaagtatttgaggtacttgctcgtgacgtcgtagcttagagtgaaaagctcgccggagattggatccaccttcggatgcgcgatcatggaggaattgagctggtcgtggaagctgtagcggccgatcgtttccaggtcgccggaggcggtgatttggagctcgtaggggaggtcgtcctccgacatggcgaggagttttccgttgaagaagaccaggccggcgttggcggcgccggcgccattgcggtggtcgacgatgccgcacaagcctctcgcgtagaacagcatcagcctcgcgatgccggaatggccatggagctcgccgattgctttcggaaacaccggttttcccaattcgcgctcctgcatgagacgctgcgtttcggtgaagcggcaggcgtagctggcggtgccgtgattgattttaacggcgtggaccattccgtcgccgtcgaagaggtggtgaccggctttgggatggaacaatgggttggcgccgttacggagataaacgccgttaactgcgtctgggattgtgccaataacggggagggaatgttggacggggtgttccggaacgggggcgaagttaccggcaatttggacgcgtgggtcagtggttttggggaggggttggttgagctcgcgtgagagcaacgcgctctcgaacatgtccagggccttggctgcggctttttggaatgggttccactgaggcctttccgcggggagggaggtgggttctttggtaatttggggtattttggtgtagggttggtttggaaaatggatcactgggggggagtgtagagcacaatccaccacctttctaatgggcttcttctgaaatctaatggggaagcccaagtctgttaataataatgaatagaaagaggagaaggaggaggaggaagaagagagagggagagggaattgaggtttggcccaagtgcttgaattgagtgctgccatgatcatgatcatggagattgaatatcaagggggagggggagaagtgtggtttgaactttgatgtgtgtttttatttttattttattttattatatatattttatgagaaaaaagacaaggaaaggaaggcaaagagattgaaagtgaagaggggttttggagggggagaaagggagaaggaaaattgggtataaatagagtggggaaggggaaaataaaagaagtgttatttttaattttattttggggagggaaagggagtttgttttggaggtccacctcagacatgtaagagaagaccacgtggtggatttgtctgtgacttccaaattgtacgtgcgtgtggggaacctatcgcgacaccaaaacccttacgcaggcacaatgcagacttgattaagtcactcattcttatgagagatcaaattcaatcaactctccgggtattgaaatactacttcttcaaaggttattttcgtaaattcaattgcattcaaacaaattaataaatatatgcataaaaattattactaccatttaattacattcagttccagtaacaattgtgttggtgtttagattgagatttttatactaatatttattatttattccttattatcaccaattactttaaatatcacactgaattaatgattgagattattactaccatttatgtacaattaataaatttaaaataaaataattaatgattgattttaattacattcagttccagtaacaattattttggtatttagattgggatttttatacaaatttttatttatttagttatttcttattaaaattaaatgaattactttaaatatcacagtgtattaatcttcctacaactaaacttttggaatacaaaagtttatccaattgaaaaggaatcgttttacttcttaaaaacagaatatgtgagacgacatgcttaaaaaaaagtctcaatgaaattgcttttttttttagaagaatgaaattaatttttctacctctctgttaaaatattatatcaaataagataaaatttatatcttatcatgaagttttccaattatcatattatagtatgaaaaaattatatttataaagttggagttgattttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgtcagaaattaataatagatatttccaattagcatttatctgccaactaattttaaattagagtgattgctaattgaaacgtatagaatttgcatgtcatttagcattttttaattagcaccattagattataatcgggaccattcaaattatattatatatatagatatattacatcctaattttttctacattaaattttattgttcttcgtataatccctttatttatatttgagttaactatgtttttggtccctgaatttttttttgagtttttatttttagttcaaaaaaaattaacttatctcagtctgtcatgtttttcaaaatacatattccaaaataatttcaattaattaagtggaagattaagcaatgtttgaattaccgtaatttatttcttcatttgcatgtctataatagcctattgattgcgaatttctgtaattttccctacatcctagctttctcgaatataggcacagtagtgatcagagtcaaataaaaccggagaggcgcaatggtgcccataaaagtaagatgaaaatgagatacataggcacatgcagttaataagtactctttcatttcgtgtagtgcattttatttattttcatatatttcagtttatctgatagatcagttgttcatcgcgaatagggggggatcaagaagcgtaggaatatgtgtgctatttcttttcgaccacgtttcttagtcacatcattaataactgcatgctatagttagttacccaataatgcacagacactttaattgccatcgatcccactgtttcttccttctcctgatactttatacaaagctatggtgtggcccatgcaaatggattactacgtcttaatgtatctggccccctgctgttttcttcagctcagggacattcagaattccttaaccgaaactgtataattaccagtaggtatttaataattagggtggaaatcgttaaattactcaaattacactttattagaccaggatttaacttcttcttttttaaaaaaaatttaagatgcccgtactgataaaaaaaattaatataggagtcatatttatttattaaatatacacgtcttcttttaagatctaacggttttaaaactttattttgatatttttttaaaagtctaaactaatcttaaagtttatttcattaaaattttgcttgtaataaaatctttcaatagactaacaaacctatggatctaaatttatgtctaagctaatcagtttaatagactattaaatacataaactcaaaacagtatattataataataatattttatttatttaattttgcatgatagactttaattaaaaaaaatcttaaatgtgttagcatggctaatttgaataaataaacccttaaatatatctcaatttgacttacaaataaatttcatataacctagacctaatatgagctagctacgtcataggtttttgagtgacatatccctttctcatcccaaattattgaaattctcacaaaaaaatcccaaattatttgtatagaaggtatgatttattggaacgttcaattactttttgtgtatcattttcttacatctaggatttagttatacgtttatagtcttttataaaaatctccacccaaacctgcgagaatcatcaacattatgtgtaaacttctatgaaattaatttgttcgctaaaatcagcccctgattcgttaacattatttttcttttgatggaaatatttttgcatggccacagtctatcattaataaagttattataatgatctatgacatactcatcatcactttctcttcaaaaaaaatgacacactcacgtaaaaattgttattggtcctgacatggtgtgaaaggaaaccatcgtagtcgtagttagcgatggattcacgactcttcccacctcataattttattttccttaattgttttggttagaaaaactttaggagaaagaacgatacctcaatccaagggagcaaaaaccgtgaatgtaaatttaagaagggttattattttctctgagtaattatgagaaatacttttgcatggccacactctatcgataaatttcttattcaagggttatgaaaaattatgacaattaaaataaatttaagaaggaatacatttacttcaaaaaaaaaaagaagaatacatttacttgtattaaagtactccagactatactttcagtttcattttctctcttgttaataatttttgcgtaaatgttttttttagaatgctaaaaggaacataaaataaatccaagtgatttgtgtcctagaactagatatccagcttgttattgttgctgatcaaatcatatattgatattagttgagtccaagaattagattagtcatttgcatatgtttattagtgtagattttatttaacaggaattaaactattagaatagacatttcaagtctgtaataatatgattcacatataatacatattaaatcttattaataaggacaataacaactagcttttagtatataataaatatttctttttagtactgatatggcgtaatatcaaataattttggttaagaagtcaatatcaggccttgcctgccaaattatccgttacataattaattcaaaaaattttgatatacaacaaaacacgaatgaaagtaacaaaaacatgtatgttgaccttttagtagaggtcccccacaaatggtcgtgtataagtgtgtgaagaagcgaattcaagcggttgaattgaaagagagacgccattaatgccctcatatatataacggatggggcgggtaattggtttaattcccgttttggagttttgtgggcacatcctgttgaggattctggatgccattcaaggacaaattagccattggagccattttcaagggccattggacaaactagtatgatagcgaacaatgatatatgtatggctgttgccttaccacctttgtttcttcaagtttcctttcgaaaacgaaccccattcaactagatattgtagtgcacatggaatggaagacaccggcctctactttttattagctaggattgcaaatgctataccttgttgtctctagtattttgtttttgcttgtacaatttttcagatcgaatattactattctacagttggagtacttattagcttgttaagagggccacaacctactactacgtacctacaaattatagtataatagattttattaagaattgtgatatttcaacacctgcttatttcatatatcacatcaataattcttatttatttttataatttttatcacattatattatttattatatttatatttttcattctcttttaggtgtcaagtaggtcttgggtgtcaaaaatcttgttccttttactaaattaaaaagatgaatttcttttcttttctttttttctttacttcgttgtcatggaatatcagggaaattaatcgagaaggacacacttgacaaatgatgggtaactttgttcgcttcttatctgtgctaccaaaaagttagctcaaagtctgaaaatcttattgcgaacaaagtatccggagaaagctagctatctgattctctgattcgagaaacattttttcttctattttttatacataatttttcgtaagtatcttaactgctattgtgatgggcaggcaagtgtatcgtttgatacatttacaaatatttaagtatattataataaaacagcttaattcgtccatatttcatattgtcattttcgttagcaaattatcaagtgaagatatttctctgtccaatagcattctcggtataagaatatcttattgttaagaaatattcaacgtttttattttgatattttaaaaagaaacttgtctgttcttgcagttattgacaacaaaccataacaactgatcatactcaaagtgatttcgattgtttgattgatggtcactgactatataagcaagtaaaattcatttaaaagaaacgtaattggaattctgcaataccaggtctttccaaaggtgttcacacagttaataaactcgagaggataattaaataataatactacagtaacttatttatttgatgatttcataaaatttcttgtaatttaagagggagataccaagagaagagagaaaagtgtagaataagatagcttatgttagaaaagagagcgaaaaagaagtgttataaaaaatactataaaaatttgttgtgatatttcagtatcaataaagaataatgctattgctatggacttttttgaaaggtgtgtgtacaaaaggaggtcaaactatagcctctcaattttataaaagtgttgaagatagcacacatgaagagtgtgtagctgatataaacgcaatatttatcaaaataaatggaaggaaagagaatgacagctagtaaccaaaagagattaaaagagcatatatatactccggtcacaacagtgagaacttcaccaaactagattatgatttttatttatcctagtcttcgctctcaacaagtaataattatatataatttcttttataatatatacaagctaatattgaagtgagaattaagaacataagctcaacacactcgtatcattttgaaaagtttacaacaatcggttggtgtttcaatactcactaacacttaagaatgaaatttgctttcatcacaatgcaagagcctagttgagatcacaataaagcatggtatcatgtaacaagcaaggctgttaactaggtttgtgaaaccccatatcagaggcataaccgcttgtattttcattaattatgcagtagtgtactaaattgtgttctgttaatttcactgtattttgtggtcggttgcttttactggttgtttattgtataaatatccaaaactttatctagcttattcttagcacaacttctgttcaatgttatccatcttttaatattcaaaatttcaaatacatgttttgcctacaaaattaatttggtcgacaaaaccaaatcaaaccaagtgtaattaaatatggcgattggttgaggtgtcgaattgattgaattgttatgattagggtgaaggtagtttttttctagatatgttaatatcttaatccaggtattagagtgtcttgcttacaattagaggaggaattaccggggttagggtgcaccaccactcttcctaaaaaaaattaataaaaaaatgaaaattaaaggaaagaaaaaatattaaaaaaagataaaagggaaaaggaaaatatatataaagaaaacgtagtaaaaaaaagaaaagaaaagaaaagaaaagaatattaaaacaataaaaaggaaaaaatataaaaaaagaaaagaaaatataataaaaataaaatgggaaagagagataaaaaaaaaaagaaaggaagatgataaaatgaaaaaaataataataaaaaggaaaagattaaagaggaagagagagaaagaacacaagggagaggtctggacacaaaggaaaaaaaagaaacacaaatttcaagcgaatataaggagtcaaaacaattgtttcatttggtaaaccgaaaagagttttaggtatcttctcattcctttctttttccctcattttctctttcttcttcatgttgttattcttctaaagatttgcaactaaagtctcaagatattgtaccttatgcactggcggaggcagaaattttattgagaggggacgaacataaaaaaatatatatcataaataaaagtactccgaagacaatacaaatctaatacacaaaaaaattttaaaaaaatatattacagaaattaagatcacttcacttgttgactcttactctacgtgttttcatattgttaaaatcatctataattgaatatgtgttaaaactcaaaacaatttctttttcaacttatgtaattaaagaatcatcaagaaattggtctttgattctatttcaaagtctagtcttaattatcttcatagttgagaaagatctttaagtaattattgtagaaaatagaagagtgaatacaagtctaatcactttataaataagagggtaaatgatggactttctaggtcttgctagcccttgagtaaataacaatttattttattttaaaagattaacaacaacaataatgagaaataagagaagaaagaagaaaaagggaaaaaaaagaatgaaggaatacctgaaacccttctctttcattaattgcattaccaaatgacacaactttttttgacgctttctgttctcttgggatttgtatcttctttttctcttatgtgtatttatgtgttcagatctctcccttttataatgttctttctccctcttcctctttattttttccctttttattattattgttttttgttttatcatcttcctttcctttttccttttcctgttatctctctttccctttttatttttattatattttctttcccttttttttatatattttttccctcttttatgttttctttcctttttattgttctaattttttttaccacgttttctttatacttttttctttcccctttcacctttttttaatattttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttcatttttgttttatttttatttttttattaattttttaatatatatatatatatatatattttcaaatttttaaattttagggggggcgatggcccatcctagcccccctaattttgcctttgaccttatgaaggaaattatgggtataactaaagtcttttgtcaagctttgcgacgaaagtctcaagatatttcaaatattttacatttggtttcaactacaaaagagttacttcagtaattaagagagacaggttaggatgctttctttgttcatgttcaagaattttgcataaaacatgacattgacattccagatatgagtgcaaaatatgttggaaggagaggtcgtgctcaaaatgaacaagttgatttttctattgaaaaattttatagggtaaatatcttttgtgctacaattgattatcaattgcaagaattaaatagcaagttcaatgataatactgttgaattacttgctttgaccatgactttagattcaagaaacaagtacaagtcatttaacagtgcaaacttgttgataaattttattcaagagatttcacagaacaggaaaaattgcatttgaagatggaattacaacattttcagcttgacattcctaaacatccaaatttaattaatttatcaactacatctgaattatgtcaagggctagcaagaactggaaagtccatcatttaccctcttattgatagagtgattagacttgtacttactcttccagtttctataacaactactgaaagatctttctcagctatgaagataatcaagatcagacttcgaaataaaatagaaaaccaatttcttgataattctttgattacatacattgaaaaagaaattgttttaagttgtagcacgaattcaattatagatgattttaacaatatgaaaacacgtagagtaagagtcaagtgaagtgattttaatttctgtaatagtttttttatattaggtttgtattgtattcaaagtacttttatttatgatatagtttttgttatgttcgccccctctcgataaaattccagcctccgccaatgcttacaacgtagactaggactaaccttctctggtttctttaataaggatgatgctgaggatgcctttgaattaatggagagacaaacatagaaagtttttcttaactctggtctaataggatacgtggtatggataaagccacctttagccaaacaaatgacttatttcattctttgttccattacaaaaatgttttccttttgaagcaaatgaaagaaagggaatttctagttagctgacattgagataaatcaagcttgtcacttcagttgttgtacctctttaatggttcgaatatttctcatctcaagtatggatttgcactttctagttttacctctattagtctttcaaataacacataaaacctaaatatttcccaattttcactcaaaaagtgcaattcttaagacttaggctcatattgtgcaaccttgattgctaaaagaatttgacgaggtcataaatatgatcttcttgagtgcttttgatgatcatatcgttaatgtaaatctcaaacatctttcaaatctactacataaacgatttgttcatcatttggggtacgttgcttcaacattgtttagacggaaagacattactttgtaacaataaattgtcttttcatgtcattaaatgttttttctctttgtctaatataatgtattttaatttgattgtgcactaagtaagcatccataaaggtagtgatgaatctttaatgacaagctctttaaaagcctatagacattttataaaaacctatcttttgacatctctaatgataagcttaagcatatataggtgaacaacttctcggtagtttggggtttattcttgacatgtcaacaaacatctatgcaaacattgacaagattgtactttggttagaatttactcacaagttattgattaacctctgctttagttcatcttaggtgtcgttaaaccttagtagaattgactaaaaccattttagggttgttcctcaagtgttagaaaaaaggctccacatatttttaggggagatcaatgggggcttttttttcgttaattaccatttagggatcggttttgaattattataaaaaaatggataagtcgtaacatttattatgactttcgaattgaaaatcgtaaatgatgttataacttctaatttatttatttatttaaatgatattttacgacttatagttaattattttcaaaatttatgactttaaagtcattggatttttttaaaactagtttaatttttttaaaatttatgactttaaagtggttcgatttttttttactatttgaaagttgtcaattttttttatgacttcaaagtcgttaaagttttttttttacgattcaaagttgtaaagtttttattttattttattttttcaaatatttataaaaaaaattataaataatttttaatttaattatttaataaataaatttacttttactttgtttactttttttaattttttaatattttttatatggtttcatttaatattttctatattttttaatattattttatttaacacatttttatatggttttattaatatttttaaattcttggtatattgatttataaaatatggaccccaatattgaggtaatttattttcgtttacaagggaatgaaagtgattctaataaactttgtaaatatttttcaatttgtatatatggtcaacaaagtcagcttaatttaaattacaagaagcacacgctcacttgcaagcgagtaagaaattcgaaatgcatgattgattacgactttagtctttttaaatttaagtcttttgcattattttttaatttactaaacaaataataattcttaacattagtaaaaaaaaatatagataatatattagataaaaaaatatactaaataaattaatatactcaaaattaagaaaatattaaataaaataatataaaaatagagaaaatatattaaataaaagaatactaaaaaaatatagaaatattaaataaaatcatataaaaaatatattaaatattaaataaaactaaaaagttaaaatatatttatttgttaaataattaaattgaaaattatttacaatttttaaaaaattatttgaaaaaaataaaaaaaaatttatgactttgaagtcgtaaaaaaatcctatgattttaaagtcgtaaatttttttaaaattaaactgaagtcataaaatattttacgattttggttttaaaaaaattagtgaaattgtaatatattttatgacttcactttaaaaaaatagaaatcataatatcgattattcctttcaattcagaaatggtaacaaatgttgcgatttattctttttttttaataatttaaaatcgactttcatacaataaaaaaaaaaatctccattgatagtttcccccattgttaggtctcttacacccatgagcatgcatgagcaaagatttgaagatgtccaagtgctccagactctccaaagggtcatttatgtcattgtattaatctaggacttgctctacatttgtttggcacttgaaacttgaaactacggtctaacaagggttgattagttaccaaaactacctctacgtacgtcatataagatgggttcaaaattgggttcctttttcgttgagattaggggatagaactaacatatactaggtggacgatggtgtgccttctacaaggaaagcatgcacccaataactttgagtggtaaattatttataattattatttaatttgttgcagtagttttaggtttaaaattttatggattgcaacattctttttattcctacattgctgttcaagtaggaatttctaaaaaattaataataaataaattagcattagcttagtcgacataaaaaaaaacattaattttctgcatgaaaaaaacctttaaaatagtatatcacattttatttgtcacatcattaattaacagagttacatataaaaatcaatcaaaaaatgttagctaacattttataaataatttatatagtgacataaatagatactattttataaatatatataacatatttaagtttatctaattttatttttatgtatattatgtgcattctcttgcaagatgatgtcatccttaagtttaacaaaatgatacataatttcctaattttcttgacatttggaggtttttattaatacacatgtatttaataatttatttttgtaagatcaatttaagcctacggaatattttaaaatagcttctaagaaaaaatatcctagttttcaaatcgaatggattgatgtgttaagtatgctattctatttgaactaatgattataaaaattatgtttaaattttcatttaattttaaaaattgtaaagaaaattataaaatactttttattttatttaataaaaaatatatctttacagttattaaaataatatatcaattctaatttgagaaaatacatcatatatatatatatatattgatggtaattttattgattatcataataactatcttaaaaaaatattaattatgatttctaattagttaacaatataaaaatagaatatttgaactctattttttattaagagagagagaacccaaaacaaccctattaatttagtgctgaaattgaaaatgtttcctttttctctttggtcctgatcagtgatcagctagaaagatgcgtgctttatatggtcggagctttatacggctgaattgattaattcttgaactcaaaggcaaaaatgaatcacatgtacttaatattttagtcaaagatgatcagtaaacttagtgtaggtcctttagggagcatcaattgatatatacaccgacacaccatcgtgttcatgcctaaccagaccctaaacccacgtttccttgtgtaatgacaaagctctacctcattttggaatgaattttggtaaaaaagagggatagagaaaaaggaagaaaatgtaaaaaaataataatagaaaaaagatagatttgataactgatgtgatgataaaaagaagacataaataagcaaaaaagaacaaaaaaatgagatagaaaacaaaattgatatatatgttgagtattttctttgagacccacgctgatgctgaacccagtattaaagaagtatggaccataattaccactagtgaatgatatagtacgtttcaatgcatgcccttccaaagaagtaattaacaaaagaagtcatctaaaataattactgcgagtttataaatgatgcaaggttaactaattaaaggggcatatcatcattatgtacttacccgagagatataagatgagttggtatgattaatcaaaaagaaaaggaaaaaaaatatgaatttattttttctgctaaaaaaattaataattaatatttattgataaaaaaaaatattacatacttactaattgacatgaggaaaagttataaaatatcatatgatatgcaagtgattgagtgaaactaattcttttaatatataataaaagaagaggatgggggtttattcttaattattttaccccaaaggttttaagcctccctgatcatgtttcacctgaaataaaagaaaattcctgttgtattttttcttttaatttgttctttttcgtttattttgacctcatctagtattcttgaatggttttcaaattttctttttcttttcccttccggtttcatatctttctgtggttccaaatgattcgtaagggtctttagccatgtttgttaacttcatcattatgttaggagtagagattaattagatatgtaatattataattgtaaaaaaatatcatataaaagtattatgaaagtttgaaattaatttaattattatataaattcattgaaatataaaacactttataatttgcaggagtgaagaatatgtaaaattttatatcaaaaagaagataatatgtgatgaaaaaataaaacttagataaagtatataattttttaatcttaatttgatcatccaaaccaaattaattcaataatttagttcaaactacgtacctcataaatatctgtagggattaatgatgatcgtatacctaaaaatgtagattatagtatatcatattgttttctaaaccaactaattcaagatgtgtttagatatgcactagaatcatgttgaatggagaaattatacttttcaaaacaattatgttataactttcatctgaaagttcattatcattgaatttaacttgttctcaaacacacattaaatcaagccaaaatagagtcatgatcaatttgattaagcataaataaaaaatcatcttttaaagaagctagcttgagaaggtttatataaatttatacatttaagttaattttaacttataaacatttattttatttgtctttttattttttcttataattaattaggaagaagattatccaaacagattaattgtatatacagtggatcctgtaagaatcgatcaactagacttttaaggagcaaaaaccactataatatttaaggagtaatgtaactaaactaaaatatttatatatagtatataaaaataatatattatatatctttatgaaacataaacacgtgcatataagatgtatgaagattcaattcctcattattttggacaccttgtcaaaaaagcatggaagcattacatccattcccgtcaacttcttttctttcaacccatatatcactttgcaatggagacaaataaagtttgcaataggttaacgtttgaaattaggtaggtctaaaaatatatgccagatgtccttttaacacgatgacataaataatcccattttggaccacttatttgggaatataattcttaaaagttatttatttcatcgaaaaactctaattcataaaagttatttgcacacaccattttaacattgacttagatgtatattaaatttttttcatgataatattaatgtggagcatttaccaatttaattgattattaatctttgttaaaaatttgaatgattgatcatttttagtaagattaccctttccaatcatattattttcatccacaaggtttgaatctaagaccttatttaagaagatgaaacttagggaaattcagaccaataacttattaatagatgtacattaatttaatcaaacatataattaaccctttaataattatagattaccaacaattttaaatcataatttccttaccacaaacatttagattataaaaaagttatacataattaattcaaaataaataaatttaaataaaaaaaactaattgataacatgtgtgactacttaaagagagttaaattaaatgattaagtcgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatgatattattttactcatgaaataaagggaagtaattaactttaatttaaacttgagttttaaaaatagactttgggaagaaaaggaacacttacactctgtttggtaagaataaaatgagtgaaaatggataagttagagtggaaatagagaggatgtttaaaattagggttgtttagtagaaagaaataatgagaaaaaaatgtaaatcttgtggattctgttattaaaatatttcatgtacgctctccaaggatggaattgataaaaaaaaaaaatgaagctaacccattccgttttgttattttacctaaaataacctttttttctcactcttactgcataattaatttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctattatttttttatatttttattaattatttttttaaccattacactattttataatgttaattttaatattttaacattatacttcaagatatcgataatgatagcttataggtttattttattatatttttccattattttttgaacatttttcatactaaacaattatttaaatcatttcaagatattttaccttgactctaattaatataatgaaagttaatatcaatttaactacatactgtttctattttatattaaatttgattaaaaatgttttaagatataaaataattaagtttaattaaaaatatttttatgttaattgaaactaaaaatgtaattaaaataattgatcaataaaaaatacatgaatttaaaactaatttaaaaaactaaattataaataactccaaaatgtattttatggaaaaataaaaatatcatataaatatatgtatgttcatttttatcttttaatatttatggtttagtttaatatataattatatcaaatacttataattaataataactttcacctatcacttttagttaatttttaatttttagttacttttatcaaacataaaaaaaatacatgtaaatatattttaattacttatatgaaaaacaaaacaaagtttactttaattactaataattggtcaaatattaggcccactatgtaacatccttgtttttcaacttctcgattactctcacactatgacactttactcaacatccttattggtcagaatcttctacagtttagaatccttcgtaagtaacccttttcgagacctcaaaaatcaactatgtctgctttcaggatcagtgattgtctctcacaaaccaacacatgacttttcagcatactttgtcttcactcacatgtttttcaggaaacttttcaaaagatcattcatctcatagctactccaagtcaaacaactaaattatggagttcttaagtgttaggctaccaaaaagtatatgcatcttattggtataggtagtagcagttaatttttttaagttattctcagttgtacaatctcatacttgcacaaccattggatctctctcattctggtgtgattcgatctgggtgttacatgtccaccagctttcgtcaggtccgtcctcgaaccacaccgtattgggagagaggtttgctcttatactgtttgtaacatttctaattttcaacattttagcggctctcacactacgacatttcactcaacatccttattggtaaaaaccccttataggtagtccttttcgagacctcaaaaattaattatgcttgttttcaggatcaatgattgtccctacaaataaacacaaaattttttagcatgttttgtcctcactcacgtttttcgaaaatttttccagaagattatccatctcataactatttcaagtcaaatacgtttaacgtagagttcttaagtgataaactactaaaaaatatatgtatcttattgatattgataatatcaattgatttttttaagtcattctcagttgttcaatcccataattgtacttccttttttatatctctttcattttgatgtgattcaatccaaatattagagactccacatttatacatgaatggcatttaacatcaacatcacatcatattatcttattatcttaggtcagtttttcttcttcatgaatacaacttaatggttgacactttcttatgaacaaaattgagaaggcgttataaagagagagaaaaacaaaagagtagtcatctaatgttaatgatataatttttaaggttaaattcctaatttttttatccgtcattttggtctttatattatttttagcaattttggtaccattttaaaaaaaatataattttagtctaatccttaattttatattgcttttagtctaattgaaccctaaatataacatattcacttaaaatatcataaaaacaatttaattaattaaaatttagaaaataaataaatatatgtaaaattgagagatatcgattttttgaaatataaggatcaaaattaaaaaaatacaaaaactgtagatcgagaactatactaaaaattaatatttagtctgtgtttaaattatttaaattactaaaattttattaaaataacactcgtataaatataaagtcaaataaaaatatcagtatttgcacaaatttataataagattatacataaataaatcatcatcaccaagtatatgagtttgttataattattatgaaattgttttagtttaattaaaagttttgaattcaaatcttagacatgtagttacatttaacgctgacaagtgacgttagacttaacctttgaaaattaactttaagaaaattcctatatctcactaattaaacattataacatttttcccaaatatctccccaatgctatgctagctcgtgacccggtcacgaaaacagacgaaagtcaatttagtacccaaccattataacattcccttttggggcttgggtgcccctcacctcatgccatcatgaccccatcgcttttattcaaaagcaaaccagatagctagaattagtacagaatatataagttttttgttgaacttccaatatcctcccctcaattatttatgtactttcaggtaaagctaaatctagaatctagatatatggctttattgtccgcagagcccaaacttctgtcttcttactcaaatcctctattaaattaaccaaaagatctcccaagtatatatgtgttgtgtggttattcggatgcaaatcatacatatattgttgatggtcctcttctgcaatagctttcatttactataatggatccaaaagatatcagggacataaattgtattttatacgtaaaataatttacagaatccttaactgattctttcaaccaggaaaagaagaaaatgaaaaaatattaaattacatgaatgaaaaatatatttaagtattaaattacatcaatgaaaaatatatttaagtcttatttatataatgcttttctctattattcttcattattttaattagtgtttttcctttttnaaccaggaaaagaaaaacaaaaaaaaaaaacaaaaaaacaaaactaccaactgtcgagaaccaccaataatttcgttgcgagtaatgtatggtacaagtaatatgctttcctattgggaaaaaataaatagtatgaaggccttttccttctttttctattttttttttacttttacttattttatagttatattatgtataattttagatacattttttattcttataatttagtattcttttcattttcgtccctgaaaaaaattgttttagtttcgtacatatatttttccttaaaacactttatataaaagtattttaaggaaaaacaaaaaataaatacattttataaagactaaaacaaaaataattgtaaggacgaaaatgaaaaaatattaaattacatgaataaaaaatatatttaagtattaaattacatcaatgaaacatatatttaagtcttatttatataatgcttttctctattattcttcattattttaattagtgtttttccttttttatttttctccttaattaatatatatgttgaaagaaaggaagtataatttttattttattttaagtttgtatcctcctctgggcgggccctctgcatagtccaagggtgtgaccatccaagactcataactaaaaagagtccaaaaaaaatataaaatataataattgtgtagtaacaaaaatttatattattttcgtaagtaagttgaaattattatttttttttgttttatatctctttttattcagattaaaacatgacatgtaagtaaaaagtaaaaagaaatatttttttctaataagttataatcataaattcatctaaataacaaataagtgtgaaagattaacgtgtaataaagctgttataataatttaaattgtttattttattctaacaaattatgaaacacatgcaacaatttaaattataaaaaattaaaactaaaagttagtattataataaataataataatatatgatgtgaagaaaatagaaaagagaaatagagagaaaaagaaaatgaagaggattttaagaaataaaattgcctaaaaaattatatatacatattgtgtataacttttttctttaaaacgtgatctcatatataaatatttgtgtgcctataattttttatgacataaattgaataaagattatatgcatcttactcgttgagatttattagaactattttgtttgttaaatgtaatcaaatgtataatttttaatgcattcgtgtgtttatttttatgtaaaatatgtttacatcttaaaatacttatatataagatgaattaggattgattttcttaaacaaagtttcaggtctaaccttaaatggaagaaaaaaaacatgattgaaaaaaatacactattaaagataattagttagatttttttttataatttttttaattataaaatcaatatatacttcatacaaataacataatttatcaatctattacatcaaccctaaaatgtcaaaagtgaccttactatgtcttctaaagctgagctactcttcggattcctttcagtgtcgcgcatgcaatctcataaaagaaggccaaattcaccaacaaaatgaaatcaagcaatcaacaaaaaaagaattaggtaacaaaagaatgaatttgacaatagcagaaattggtatttgaaaaaaaataaaaaactaatcgagtttggtcaatatgtgccgattgaaaggagtgcaaataagagtaacagaggatatttgtattaagattttgcacatggcatgcaaacgtatgtggacactctttgaagtggttggatatgtgctatctcgaaagtggggcatcttttttcaaggacatgctggccagagactctgcataattagaatttgttgattgtttatcattctgtttccctttagttcttaattacgtgcttggattagaccacacgcagaatatgtattccatttggaaatcgtaagttatctatgtagtgaatagtcacattaataaatcttttgtccctttagacattaattataatataacaccgcatttaattattgggtgcaacttttcatttattacgaattaaattttttaaagtcctttcttaacaaaaggagttgatcatattcacttctcctctacgccgttgatgggaatgttgcacattttccttttctttcatattaatatatcgtcattgagattgtcactgagtgtttttatcgtccagatacatgaaccggacatattaattaacttttaagcaccgggagacatccttttgactaaaatttccttccatttcatgtccttaattaattgctcaagtattatatatacattttcttttatgatataattatatataccttgataaatatggcaagaacttaattatatgcatttaaagtgcaatttgcgtttgattcacgacatcctaaaacaataaagtaaatgttatattcttcaataaaatacagtaagaaatattatcactataagcccaaatgagttatttactatcatttaaaataaatgaatttggtatggattagaatagaagtcgtgcatggtaggggtttttcatcaatatggagtaatttacttttaaaatttctaaattagtttagtttattgctttagaaaattgtggaacaaagtacaacttaattatcccgttccttttttcatgtaatcaatttactgtcacaaatctttaataattttaaaagaaaattatcttagtttaattttaaaaaatcccgtggcaatgtttgttaatagttttaaattgctctcttttatatttctcgtcaaaaagctttacagagctccaaaaaattcaaaaagttttctagttctttttaaactgaatcttctagaaatttttaatgcagttgaccaatctatgtaattaattctaatgagtacatggatagtatgtcacgaattagatgcgggtcaacctatcctgctgccgtgtctaataattattttgtaatagaagtcaatgttaatacttttttgttgctgaataagtcaatgatataaaactaatcaacgggggaaaatgggcaattcgatgcttattttgcaattgaaacgatgatcaacgtgaagaaaaaaaatgtgattagtgtcgcgacaataataatgtacgttgacataatattcaaacttgacataataaatatggatactatgtacacacaaaagaagctttgaatatatactacattcgtataattaagaagattattcacgagtatctttcccacaaatatcaaaatccaccacgtaattaattccttagtgacttagttaatctttaaacacatgggagccataacgaattaagcataattaaaaatgacatactacaaaatatcttaatcatatttgtgataatgttttcccagtctcaacattgagcctagacacaaagaaaactttttttttaagttaaaagtttaggtgaatcaaactccaatagtatattaaaataaaaataaatttcaagactcaataaatttaaatgaatatttactaattagtcaaaatccttaatgaactgaccaaccttcgttgatactgttattcgtcattattatgacaattgcaagacatgcaaacacaaatatttatataatactgtgtagctgtagttagaacttgacatcaacagttgccatataatataatatagcactttgctaacaaatggttattatgagttctgccataatttgacagaattaaaaaagaaaaaaaaaaaaaaaagatgtgacagtgctgctggtgccacctgttgatcgatgttagttacatagaacagatttgcgtgtggtataatttcaatggggtgcgatcgaggtattctgaagaagcaatttgagttatgcatcgcttacaattacatcaaaaccaagcatccatatcaacagctttttgtggcagaaaagcatatctatctaaaattgatggtagacacaacacaaaccaaagagtacaaactacaaagcgaccactcatccgagtgccatatcacaatccaaaatgagttcagctcaatgcataatgtctcgtatgtgctttaggtataattatgttttataattcttattttggcacaatttcatatttaattttaaatttggagtaagttttacgaagttgtgaattacacttatgactttattgagtcagtgaaaaaatttaagaggtcacaattataatatatgatttatcgtaaaaaagagcatgataaattactgaagttgtgtataacatgcatatatattagtttaaaaattgtagtaaattaaaaaattagtttaaaatttaaatatattttgtctctacgaatatgatttctttaatttaaattataatgttaaagattaaaaatacattattttataattttaaaaattaaaattatgctattttttacaaaaatttccttgcttaaattattggctgacagtacggataacctcactggtcactgcaacatacatataaaattaattcaatgctaaccagttcaaattcaaggaacaggttacaaccctcgaaagttcgaacatagaaatcattgtggtacttaccccccaaaaaaaaaagtcattaatatattgtggctaaattacagcatatatatgcttgaatgttgttacaagtatcatgtatatatgtacgttatataccaatgaggtatagttcattgactgaaaaagatgtgagttataatagatcttcaatatatgtcttttgatttttatggataatatatatatatatatatatattgtacaataatatatagcttgtcagtccggttgaacgttcattgttgtgaacttgaactaaaaaaacacttacctttacattattttaaaaactttaatgtggatttattggaaaaatgtggatcctgaactcaaattcaaacaagctataagtcacgttgcacatcaaaggcaaataatcttgtctgtagttgttgggattgatatatatcgtgtttagtttatcgtttacttttcattggatccacatatatctatctcgaagcaacacttaatatttgttgcttctgcattatcttgatatttcgacgtgcaaaaggtggttgaattgaagacacgtacaactacaagacgtcgaagtaaacacgcggtgagagaggtatgcatcatgcccccaccccaactcagattattcgtttcaactttctttcaggtttatttatttctgaccaaatttaagcgtggaaaggtaaatgaaaacgaaagcatagcttagttaatagttagtggcttcaaagtactgactttttgggctggggaggtgccagactaccgtttgattcatgaaacctacctgaaggctgaagcttgtcattatcatgattgatatagcgcatacggaagagaaagcaatgagacttagtgggtattagtgtagtttgcgtgaaagctataccaagctaactcaagcatgccatctcagaagaatgttcctatgcattcacggtatacgacgaatttatgttctattatgtaaggatacgaattctaaaggtttggagcaaagccaccttcataatttgctctaaactcagataccattttaattatcacgttcacccaaattagctataggatttaaccaaagtatgatcccaaatgtattttttttcttttacaaagcagacaagtctacatgcatgttaaataactcagataatcttgttcaagtcgaatacaatcattaatcatgcatgttaaatatgacaagggtgtcacaaataaagaaataaataaaaaaacttactggcatttgatttcttcattcctatataaattccaagtctttatggaacttttcaaagatttggaggagatcttatcaaaatggttttataacatttaacaatagagtctgagataaatggtgaaggaaaaatatggttaggtcacattagataatggggttttgaacatactcttagaaatttgcatcatcctttgctcaaatcattttggaataagttactgcctttgaaggtcaacacttatcttgaaaagtcgtgttggaaaggagaccaactaaagagaatttaactaaaaaaagctgtaattgacccaataaatgaattttgtattatctgtggtccaattctaaaaggcaaggacagtttttcttctgatgtgaaaaatctttgaagatgtgaaatattagttgtaatgtttagattatatgccacatttcaaaagttgagaaaagagcatcactttcaatttgtggactccctatctttgattctaaatcatgagcagtgttgaatttaattatgcacacaagtttatggtccattattaattggcttcttttaagtcaaaacattcaattctactactctagtaatactttagacttggtataaagtttagattatggtagcggattctatcaattaaaccaaatttctgatttttcaaaatcgaatgtttgaagggttatactgcaatgacattttacttctctctctttttggtcaattaaacaaaaattttaaaagggagtttaatctttgatacagtggtggagtggagttaggttttgatttatgacctatatatgatctaccaaaatctctttaccaggagtgaacttgtataagtctacgttgtcctcccatttctcgcatcctgttatcccatgtccagttaaattccaactagacttcaacataggcaagagtcaaaacacaacttcaactttattaatagtattgttagggacgtagagagtgaaatggaacagaaacgaaaaatgaaagtcgttctgagaaataaatagtacataatactaacattttcgttattttttaatatacatgactttagttgagcccaactgggatgagcaagttttgtgttaagttatcgacatgtttcaaatcaaaccaatgatttggtaggacaattgttatatccactctctctctttgcttagacactccccttttaatttgttatccaaaaatattctctttcaaaagatacactcccctattaatattaaaccagtaggatatagcacaaggagtacccccatccagtttcagaataatacaaacatcaaaatcaataggaactacttccaggaactatctggtttatccacctctgtttttctttttttataaaccaaacgaatttcatttacagttatgaaatatccaaggcctcacccctacataaaatatagcagcaaaaaacatgttctccctctagttatatggttctcaaaccctgcgccattgtcccctgcactcctattatcgagccatgcatctcccctacccatataaagtctagtgctgttatttcttcatagaatcagaaggatgccttctttcacctagctgaatcataaaaagttgctgtgaaatctacctttttagctttaaccctagaccagaccttagattgacagatttcaaaatgtgttgcatattatctttattgcctcttggtttatttcgaaactgtcaacagtcaacatgggagtgtatttttttttaaaaggaaacatttttggaaaacaaattagaaagaggattgtctaagggaaaagagagagtagatatggcaactggttttgttggatatctgaaattgactcatctaaagtttgggccgaacatttttttctaaagtagtctcttattctcttttttggagcttgtctatttttgttatacgttgtaagttgtaactgtgtgagaatgctttcgtgagagaacattcagtatatttttctgaaaagcaaatttaatatcattgataaagagcatttaggatattaattaggaagtgtgtaaatgacacataaattaaagaggtggcaacattgttgtaacattgatgcgaccatgtaaaataagaaatcatatcaagagaaagcgaaatttaaattaaaacagtaatggcaagaacttaaagatattatgtattccatttgttgttttccatagtcacaataatatgaacagcaaaagagtaattaggaaaagaactttaacaaaaataaggaaaggaagttcactcaatcaatatagtacaatcacacactgtacaactgcagctaatcaccaaaagacccttccaacaaaggctactcacttatcgtcatgccccaatcttaatgcaatcattactttaataattttaaacccttgtatttactaatgcaacaaataagaaaaaaaaaatacttttgtgataaaattgggaacaaaaacgattaattctttagagttactcaaataataaaacctatgtaattatgagaagaaaaaacaataaaaataaaaaaattatattatagttgaatagtaaattaaaaaataaatgcacgactttaagtggtaatgtgactaataacttctaatatttatcattaaattttatccaaatgtttgagtatgggtttgggtcagtaacttttaattggaagaaaatagtaaaacttaaaagagaataaacatgctttataattacagtacagttcccgtcaatgaaagggtggaaaatattaaaaaggaatcgttcatgcttactgtacatatgacaagggattaaacatcaaaccctctcccatgtcatttacaaaagaaaatttaaatgttaaataaagcagaaaatgttatgcgaggtaattgtatatttgaggattgctcttgtccctctctagatactccctgtcaatgaggctttcaatcctttttttcaaatcagcaggttttattgggaatttcagctgtacaaaaaacaataaatacctaaagtaagtattatatccccgaaaatcacacaaaagtagcatcaagtgtgtggtttttatttaatcaaaatagaagggatcatgatgcattttacatcgttttcagtagtaaatcggtacaaagtggcttcctnnnnnnnnnnaaataaatgcacgactttaagtggtaatgtgactaataacttctaatatttatcattaaattttatccaaatgtttgagtatgggtttgggtcagtaacttttaattggaagaaaatagtaaaacttaaaagagaataaacatgctttataattacagtacagttcccgtcaatgaaagggtggaaaatattaaaaaggaatcgttcatgcttactgtacatatgacaagggattaaacatcaaaccctctcccatgtcatttacaaaagaaaatttaaatgttaaataaagcagaaaatgttatgcgaggtaattgtatatttgaggattgctcttgtccctctctagatactccctgtcaatgaggctttcaatcctttttttcaaatcagcaggttttattgggaatttcagctgtacaaaaaacaataaatacctaaagtaagtattatatccccgaaaatcacacaaaagtagcatcaagtgtgtggtttttatttaatcaaaatagaagggatcatgatgcattttacatcgttttcagtagtaaatcggtacaaagtggcttcctctaaaactaagccatcagagtagcaggaacacattattttgaaatcgaaatattaggagttgacaaagatacaatttgaattaagaaatgaaagataagaattgagttcacctgttggaagagttcagtaataagaagggtgtgactaagcacttttctagtcttcattatcctcacaatagcagcatcaatctgaaccatgacaataatgaaattttttgttacagatgataaccagttttaagaagagttggttacataaacatttgatcttggatacactataccaggacatcctggacctaagataagtataacaggtttcttgtgtttggcattacattgttagatgtccaagcataagtcattgagatatatgtgtacatatataaagacaaggtggaaacatcgcaacttcaaaattagttatcattgtaaccaaaaaaaaaatgaatataactattattctgatacactaaaaaaaaattattattctgatattcatattttgtaaaataaaattaatgaaaatatatttggtaattaaaacttcctccaatcctatttataagacccaattatctaattcatcaagattaagaaaaatgattaatttagttgataacaataaatgtttaaattttttttcaaaattaccattttcattaatactcctctctattttctaattgtttgccatcacaacctctatttaattagggatattttcgtcttaaaaaattaatgcaaggccattatggattagtcttataaaaaggagcaagcaccggttgtaattttggtcctataaataggactggagagagtatatataatatcccatgcctatgcatcttagattctcatgaatttgaaagggtaccaaatgtcagacaagatagcactgcaccaaacaaacaccttgattctatgagcatcttgtaaggttgtgtcggataggggtgagtttttttttttgggtgaattcggataggggtgagtgaaattgaataaatgaattctaacgaaataaagcgaaatggaaaaaagaccacttccatctcattcccccaaataaatagaaacggaagaaaaagaggtattggatggaaatcatggaataaaatggaatgcattctatttctatcaagttccatttcactccatttcatccccttttactaatccaaacattacctaaaccacagcatcaattccaaaaaagtggggaacatttgaagggaaagaacattaacctgatactgacggtcttggaaaactctttcggtggtgcttgtgttctcctcgactgtctccttcaattgaattgcattcacctgcacttcataacttccaaattagtatgaaaaaaacctgattaaagacaaatttataccaaacttttaactttgaggtagaattaaaacacaaagttcagattcctccaatatgagaccaagtgttcaaaagcaatgagaaatacctttatacggtaaagaggagctgtaaacccatcattaaaaacaaatgagtcatcatcctccacatctcttcctttgggcatctgttgcatgttcattaaaggggaaaatattgagaaatatacggagaccataattacaaataaaaattgtatattggaaattatacaaatgattacaaacacaccttttgtaggacacgaactttaccacaagctagtgattgcagagtccttctgagttccttatcctcaataccagtagcatctttgatatcttgaagacttagcttctcagcatcattgaataacattacaacaacagtctggaggacagccaggcatgcagattaatattaaaaaaaatggaaatttatgcaataaaagatgctaagataaactgcaaaaataaatggagattttaacattttaaatgatggtttttgaaaacctgatatagggacacagccaactcctttcttcctttgggaaactctgccttcaagacacagtgacctagtgaattttgccacatcagacgtcttccactgtatttgcttagatagaactctttgaaaatatcctgaagacccaatagaggaaagaaaggaccatgtcaagggaatcactcaaactaccaagaccacagttaaaagagaaatcagtcactagcacgtgcagaacctggtaaacattcaattcatgaggaagtctaacatccatgggcggatatgttggccagtacctgcactcatccaactccagttagattctccagaaatctttctatcgacacacacacacatatatatgatgagaagacacaacgcttaccctgtggttaaaacatgaacactcatttcaatccctgatgcaagttttgacctcgcctgtgatgactgtttgaatgactcatttatttcttttgataattcaatgtcctgatttacaaaaatatgagatgtagttgacagaagctgtgatgttaataagaactataacaattcatgaagtttgtcagatcatcatcattcaaaagatcatcacacaaaataataaaaccaagcatatgatatataaatgtacttttcatcaacaaacgtactggaatctatgtttatgcagaatgtttaaaatttacatgtctgatataaatacttcatatcaatcaaacaaacaaaaacgccactatgatcttgctgcacattactgctagggaacatattctatacacacagaagtatacaccataaaagggggtaacaaatgaactaatatcataacatcttcccatgcaaattttattacatttaattaaatgaataaatgacttgagtatttgtctatatgaccatttcccacaactagatatttaaatcaaagggtgtttggttattcattggaaagttgtttcacacatgcaaagaaaaaatcatggaaggaaaaattttatgttgatttatatgtccattaggttctattccaacaaaaagacaaacacacatcagatactgagtttgattttgattcctctagaatattttttgagaaattaaaataatcttctctatatcaaaatgaagtaatgcacacctacatttaaagcctactaaaatcctccattaaggcattaaccattaaaaacaattacaaaaataaccccaatttagtacctttttttaaagaatttgaccaatatcatacgactctagtactgttttcagttaaagaaaaaagatcaatgggttatttgtagtgatttctttttaaattgtatagggatgcttttgaaggtattgaaaaataggggaaatatgtgggcaatttcaggcaaatgctgggttagtgggataaactgtctaaatgttgaaaaaaatattggacctttcaaaataggcaacaacaacagaagctctgatctaaccctttgagaaaggggttgaaaagggtttctcaatggatttgaattccctgtaaattggcaggccaaagaaaagtgaaagtgataggtaggagaaagaaaagcccagttgatgattgccatcaatcagtcattgccacccaagcatggaagtgacaaaaattataagaaaacatctattgaacagtagtccacaatttgaatcaaatctttaaattaaaaattgactccaagaagaatcatgtataccttaaacatcccttccagtttgtttgtgaactggctgccacactcagtcttcaactgtattaatgaaagaaaactattaacattactaataatattgctaagaaaccatctattgatttcagatgttaaaataggggaagagaaaccttgaccttggagatcatagatttctcagcgtcaatagaagcactctttcctaaaagcagtcttttagcaagatctttcttatagaatgcttcaaatacatccttgccctaacaataaaaaatcaataatgccaatatcagcatggagagaaagaccaataggaatgcctgattatggcagaagcctgaataaaaaattcagaaacaattaattatttgctattccaataaaacattgagcatacctgaatgaacctgaataacaccaggactttatcaagtgtagcctccagttcctcttcagaagtacccttattacctgcacgaagcttctcatccaaaaactttgcaatcaactctgcaggtcgattctgtcatatgaaaatagcataacagtgagttgattgcaagtcacgtcatacaccaaacatcccaatttgagtgtaaatggttacttgacataaaaagtttaactagctaatgacaaaatggtacgtgttagctatatgtcctttcctactactaactaccgtaaaaaaagttttggtgctaattgttcagttccttgactaacattatgttagtggtgatatactatggaacaaggaaagactagcacaaaggtcaacccaaaacatatcagttcaagctttctatcttgaggaatttccacatgttagtatggaaacaacaccacacaaaagctataaatcataacggaaaaatacataatacctgacgaagattgataagatactcaaatgcatctttaattgaattgctgaaagcttcattcttgaaaaagctttcttcccatattgtgtcaagagaagccttaaattcaagaagggatgagaccatatctttatctttctcctcatccataacaatgccctgcccagttctcctgatgtatgaactaagggcctgcttcagtgattcaagagcattgacccttgaaaagagtgagtgcattctctgaaggtcttcaatacgattcccatccataagcatagtaaaaccctgtaaaagaagacaaaaataaagtaaagaaggggaggggggggggagttgcaaaggaaattttaccagacaaaaatccaaaaattgtttttagaaccttgtcaagaatggcaggtatatgacgttcaagaagttgcttttcagcagtcgctatcaatggtttcctagtgcttgcatccaagtacaacaaacatctttcatgttcctcttgcaatcttgtctataaaatgagtatccaaaaacatacccacagtaaatacaatgtggaacaaggatgggattgaaattaaaaagaaagataacttgtatggtcaaacaaaaatatttaaagtgaaaagttttggcatgatccattagttaaaaaatacaaaagcagcatataggaatgtcaatgattaaagctaaaattataatacacaaaagtaagggaaaagaagcacctcaacatgcttcaagtaatctggagcatctgattgctgcatgtatttcataccttcagcagcataaaattcggatgtgcattcaaggaatggcttctcgaaggtttctgcataaattcccagagcagtaaacatcttcaaaagatgatttagaagagttctatccactgattcacctgatctgaaaaatcagacaaaattgaaaatgtaagacttagagtatgttgaagaattatatgccctaattcatatacagatggatcagctagtcaactccctgcagtaagagtgaaaattactggccaagtcacataattattgtggaagatgagaaacaaaaattttctgaatatgcttgattgtgttttctacccagcagaatggcctgtttatattcagatactactactacttcctaaaatgcattgaacctagctaaaccaagcatctaggccacaatgccacaatgaaaaacaaacaataaagaagctctaatatcataaaatactcccatttccaacaattatcacaataggaatctctgtatggtgtttattatatatcactattctgaaattattactttaattatacactgatggacccattttttggcaagatatagattctcaggtcacaaggcagcacctttaacattttaccaagtctctccatcctgcccaacatattcaataataaaaaagtggagatatgattgactacaacagtaggcaattggtggaagatgggtttacaggtagttcaaggattatttctttcaaaaataattatgaaaaaagcccatctctaacaagaaatccattccaaacccattcagaaatctcgattctagttccctcatgtcagagtgatgattcctgattttacagaataaaaagcagagtggtaacttaaggtctcaccaaacaaatggtcactctgcttggaatattaagaaaattggatggccaataaggtaattgccacaaggaagggaatgggaattaaaaggggtaaacacacatgggtgaggaggacagaataaaaaataaagggaatattcacgctgttaagttttctgcataaccaagagctggattgacaaggaatagtgggaggtcccggaggtggaaaataattagggaaaaacaaaaaaaaatatgattgaaaaatatgtagtgcatagaaggcacgaactgagggcaaaaaggcaatgggcttgggctagaggtttagtatatctgcattttgcaaaattctagatttatcttttattctgcacttctgttcttgtaaagaagtagtttttgttggctttatcagtaacaactggttcccatcacatgaattcaagaatgcatatacaaaatacatgcagaagaacctgcacatacactgttctagtcattttcaaaactgagattgcaaaatataaattacctttcacttctgatcatacgaagaagaccagtaacagttttatgttctacttctggagatagagaaagatgtttgcggaaaagttgcaaacccatgtcccataatgactgtacatttgttgtttgtttcacatacgtcctatccagaaacaaggctataccacgaatcatcaacatttggtcacaaagatcctgccaacatctctcaactagcgatagaaaaacaatcaaatctgggctttggcctactaaagactgcagtgctgcagatatatgtgcttcacactcctttttaattcgttgataaagatttccccccattttgtaaaggcaaagatcattcacagcctatggaaaagaattgagttcccataaaactctaatgagctaatgtgtggcgaatattcactgggctaaattaaacccactacctgataaaataaaaaggttttccatgattacctgataaagattctccaagtcacaagaaacaggttgcttcaagaatatagcaccaatagctgacttcaattttgcccatgtatcctcctcaaaattttggggcaatgttggtataccttcataagaaaaaacaaagtataaaaaaaatgtagtagtcatccaattcaattcattaaaaagagggtgattcattggacaagattcccaccaagtgtggtctagggaaggtagacacatgcagcctaactacctcaagaggggacgctgtttccaagatttaaaaccatggcctccaactcacaagacagcaaccttatctatgtgccaagcctcacccccaatcatcccattcataagataaatatttaatatttgctatatattactgtatcaatgaattaagaaaaaaaaatgaaactaagaataaagttcaaagaaggaaatgaaaacgagctctctagagttcaaatttcactttccaaagactaatacgactaaaaacgaaagaagagcgctgtgcagctgttgaagtataaacatcggagaagagcacgaagcaaaaaagcaagaaactaaaatgcagcttacaagtgaactaacaaagtaataaacacaaatcgatgaattcaaatattgaatccggcatctgaagagagcaagaattgaggaaacagaagagtaatcgattggtcaatagtgaagtacctttgtgaaacttaatgagaagcttcttgggggggtggggaggagtggcttttttgcgagacaaattggcggcgacgagagcgggcgcattggggtcatcggaggcggcggcgggggattccaaaacggcgtcgtcgccgttcttagagtcgatggatttcgccttcttcataggcggtgagagtttcgtattagacatcaacaacaacaacgcattgagtgagtgaagctaaacagaagaagaggtcgagggaggggtgtgagagagagattgagttgagacgatgatgagaagaagattacaaaatcagactagcacaaagttctcatttttaaatctatttttatatatttattttccctttttttcttttattttcatttaaattaaaatataaaaaggttcaatgaaaatcatttcagaacttttttcttgtatatcaacaattgtttaacagaaaaatggatatgtaatatttacatagttataatcataatttatcatgtaattttgttggcttttaaaaattttattttgaaattatttaaacaataatttttataattaaataatagtataaaattgttttatatatttagacgttaaaatcttaatttaatatataaaaatattagggaaaaaatagtatatgctttcataatcaataagaaagtaagaaattatatcatttataatagcattatgttaaaagttatacttatattatttttaattaattggtaatataaaatattttataatatcttacataaaaattaatcttaaaaatatcaaaataaaggaataaaaagtaactactaataatttcaagaaatttgagataatgaaatatttaaaaaaataaaataaacttaaggtaagattgaatttaacgaatagatatacgattaggaatgacaaattatatcaaaatcttattgatattgacaaaaatattcataaatgaattaaatattaatcctacaagtatataggatacaaataaaaacataactactcataaaaaatttaatatatagaatttaaacataactacgtatataaaatatattacaagccatatcaaaatacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgattaaataagtctttttttgtctttgttctgtcttcatgcatatttttcaattttttgaacaaaaaattaattttgttagtagattgtcattcatctaagataattttatacataaaaaaattaaatacaattttttcactgaataaatcattttcatgtgaaagtaatgggtcttacaccagtacattatttttttcttcttctttataaacctaacttagaaagcatgaagtgagacaaaattgttacttattttataaaagaaaatattcaaataagaatgtgataatagtattccattgtactgtcactttcaaaatttaatatttttgtaaaattgtttatgtggaaatattatttaataataatatccttgatgatattattttatatttaacaaattttatttcttcgttatctcgatgaattaaaattttgttatgaatttcaattaaaaaatcaattatgttattttattatgtattatatcttagtatgtttgattaatagaatattcattgttaatttcctcatctgttttttgaataacttgttaatttcctcatcaaagattactaattttttagtcttactcactttgaggtatgagtgacaaataaaacttgacccagcaatctacttggtatgtcccattttgcctaccaaaaaacgagcttaaaaaagggcgagataagttagcttactaggtccattttttattttttaaaataaataaaatatagtacaagaatttggattttagtttcattttatataaaggggatgacgtaataatttaaattagagatgattaataattaaaagtaaatatttctcaattaattgtttttttattaatgtcggtattggagacaaagcaattgcataagttagatgaaataatacgactaaaaactagataaacaagtgtaattttaactttatactggtatcagtttacgtcagtaatattgtttcaacaatatcatttttttaaaaagtaattccttataggcacactaaaatattaaacaattaatatcatttttaatttattatattttataattattttatttgatacattaaattttaaaattttcacgttaattttttaagtttttataaagtatttaattttaatcctttcttctaaaaacattaaaaataaataaaataattaattgaatataataataattaaaaatcatcgttatctttattttattttaaaaaatataaaagaccctaatttctaacctttattcttcccctgacaccaatagagagttggtttttctaattagcgaagcctcaaacccaggagtcgttgttttgaatatgcataagaagaacactttcgccaccaataatgcaagtagcagattctttgtcataaacccaaatctggctgagtccgtccatgtacacttcccccgaatcgctaccactagagaaaaatcgtaacacaaggaagcaaaccacaaaagggacgggcagtgttgcaaaaaacaagcaagcgattcaaaaggggcgaaggatctaggtggtggtccggtgctggtggtggtgttggtgttggtgttcgccggtgtgttgtgtttttgtgtgtctgtgaggaagatgacgaggacgaagggaatggactgggacaaatctgctggctttttttttttggaaaaaacacagtgaagatttttaacccttatcantggctttttttttttttttggagaaaacacactgaagatttttaaccctttttattttaaaatttaacagaattattaatgttgttaacggaaataggaaaaaagattaaaatcagacactttgtaattaaaagatcaaaataaaatttttgtattaaaataaaaaaattaagaaacataataaattaaaaattacattaaactaatattaaatatgaatgtttctcttacttaacaatacttaaattaaatgtgagaacaattacttaatttagtccactttacctaccctcaatagttgttaagaaaaacctgctaaaaagtagtttgaaataatttgcgtaagaacttagactgaagtcttcttattgccattatacatattttaaaaaatagttattgaaaaatgctagtaatttgatattatggaacactattttgtacaaaagaagagagaaattaaaaacaaaataagagaaaatgtggagatatagttatgattaatgtaattgataaaataaagaaaaaataatttataaagttaaatattttatataaataaatggtacatgatcattaatgtgctatgcgacacctaaaaaaagggagaaaaaagagtggaaaatacaagaaataaattttatataatgatgtgataagaagagaaaaagagattgttggggctctcggtaaaattttctaagcgtaaagatctgtcatatttaaaaaattggctaattcgatttgttatgaaaaatactgctttttcaattggtgatttgaagatgagtatattatgacaggatggaaagcaattttatgtgagttgatgttgtgattaagtatcgacattagaattaagtgcatatatattgtttagtaagatttgaaagccattcgattacatgaacataagaggatttaattgtcaatttgaaagaaagtttactagaggtgtaatgactaatgttaatttaattggaaaattcagggttgatcctgaaaatttttggcctgagacaaagtgaaaaaaatgggtccataatacacattttttttaaatacaaataatattaattaagggatggaaaaaatggacattaacatacaaattttttgaaatacaaataatattaaaattaagggatgaaaaaaataggcccttaacacacaaattttttaaatacaaataatattaaaattaagggatgaaaaaatgggtctctaacacacaaaaaatggaccctaacatacaaattttttgaaatacaaataatattaaatctcagggatagaaaaaatgggtctctaatacacaatttttttaaaatataaataatattaaaattaagagatggataaaatgaacccctaacacacaaaatggacctctaatataaattttatttttttaataaaaaattttacttaaaccacccacacaaaaatttttaggccttgggcggacgctctgcttgccctgccccagggccgagtctgggaaaatcaaaaagaagtttgatggaagtgtaatgctcatttccatggataatcaaaatgtgaaagttgataaagaaaaaaaaacttacaagaagtgtattgctcatttagatggataattcaacagtttagtaaaaaaactataaataggcaagttggtagcctttcttttaggcagaacatttgcacaagtattattttttctagggaagaggctaccaattatatagcaatgtgtatgtttaaattcatattttaatgcaatttatcttttctattattcattttcttttgatcaaacatctctttttctccatttattctccaaactcttactcttttattttcttcatttcatactgcatttcgaatacccaaacaattatacttttaattatgcacacttttcttattgtaaatgtaatcgaagaacttttgttttgattttattaacgatatatctttattttttaaaatattagtttcacataattttctgattgtggacataattaaagaatttttgttttaatttgatcagtgtgatatatcttttctaaaagatatttgtttcacataattctctgattgtaaatataattgaaggttttttttttcaatttcataaacaattatatctttatttttgaagatattttaactttatataacattttttatgcattattagttgttcaaatattttttttaattaatcttattattctcctagttgaaagttaaaacaatactagtttaaccaaaaaaaattataattgtgattcagtcttattaaataaaataagttatttgtgattgatgataattatttaataaattttcatcataaacaaaaatattagaaggatgtttaaaataacgaaatatctctatatcattaatttttttataaataacataactgatagttcttttatgtattttaatttgtcggcttgtaaatttcattttcaaacgaaccacatgtatgataatcaaagaacaatcaagttgaccacattccaagttgggtgcttttgacttggcatggacaagacatcgtaacaatttatatagtcccttaagactgccaagttcaaagcctcacacgagtactagccctggtggacgcacctcaactacacctataaaacacccacatatcctcatgcactttttcaaccctcacactctccaattcagcatttctcacaagattgaagaattagcaaagttatagctagcagagaagctaaagggtacctaacttattactaggcttcagattctattcagcaacaagctcactgcatcacacaacatcatgacgagtggaccaaagatagtgcacatcgaaacacggtacgtggaaaccgacgctatacacttcagagatgtggttcagcacctcacagggaagaactcctcaacaacaaattgggtaggaaatggtgcctcattctcatccgtggcatgttcttcagattataataaaagaggaattgcaaatggtggtgtcagtgccaagccacatgaagatagcaccaatgatggtaaaaagaatagtgttgcatcttccatgctactcatgaacgtgtccttcaaagactttgagggtttgttgtctgatatgcctcccatggaggagttgctcatgttgtaggtggaggaacaccttttttttcctactagttttcgaattttctctattttatgtcggtattgctgaaaatcatttaattataatttattatatataataaatttattaatttttaaaatatttatcttaaattaatatttcaaatagaaatttgtaattgaatgagagtataaaatacataaacattacactctatacataatgtcgagtttgtacaagtagaacagtttgatgcgtttaactgctgaggatgagactttactagatgcataactgttctgtgcaaattttttcatcttaattcgaaatcaaataaaggaaaataaaaaataaagataaaataaaggaatacttttgagttaatatatatggaactaccatatttttatttcttcaagtcatgaaacgataaattttgaagactgcattccagaaaattgcgcaaactgcctgttgcagaagttttattgattgtggggacatgaaaaattaggagttgtcccctctatgaaaaggaaactctgtacgacggaaacttgaccatatatttttattcataggtcaattgtacagactcgcgagaggatcgatctaatctaagagacttttatactgtttaaataacatgtggtagtaggaccgtatatattaaatggaaaatgatgggtggaaatccagttgctattttataaaaagaaaaaagaaatagagataaaaaatgacacattgaaagagataaagatatattgttttaggattactatttgaaagtgtgatttattatcacttaggtccgacaaatataagaattttaaaaagatttttaaaagtataatttatctttcattttaatttaatcattaatttttttttaagttaacatctgtgtttacttgatatgttatctgcttacgtgataattgataatacatacatgaatgacatgtgataattcgatatatatatatatatgcaactaacctaataatatacatgtatgtgctagtttaaccaatgataaaaaatgataataactgttaactagtcatttatgtgtacaaagtcaattattacgtatgtatcatcaactgaaataagtatgcatcaccaagtgacacaaatattaacttaaacaaaaatattttaatggtaaggttaaagtgacaaataaaatacagggatttttttcaatttttattaatttccagacatttaaatgatggtgggttacactataccaaaattgatatttatcctgtcggtttaagatttaatatataattgggtcttaaaattagatctttgaagctggtttatgactgcttaaaaaaaaagggaattatacaactccggccatgtattggacagtcaccacactaattaatattacgttaatgtttaaggacaacttttgcagtaatacgaaattacggaaaccgttagtagaaaaagaattgcaattgtgttattagtataatctaaagaagacgccaaaagcttcctttttgcatgccttctagacatgtattctagtccttttcttggtttcaaattatttttcttattttccttttttattagctccttatttactcgtatggaaaaagaagaggttatttatatttttcaatggtaatattttaatatttttttcattattattattattattaaggacaaaatcataattacatgtcatctaacattaaaacagataatatcttgaatatggtgaccttaaaaatatttaacaaatttgaagttaaaataatattaaaaaagacttaaatcactcttgaccctaaccttgcctgagagcttgttctataatgttaaaagtttcatatcttaatgttaaaaagtaaatactgataaatttgtgataaattggaataataattcttctttctttcattcattcactccattctcttctatgttttccctcaacatgatgttcttatataagagagaaattcaacaaaatgctaataatacgggataataacaaactaaacaaactataacaacctaacaaatcctaacaataatttgaaatttaaattatacaattcaacactccccctcaagttggtacatgaatatcggtcatgcccaacttgtcaattgcttcttcagacacactagacatttttctaggaatgactttgatcagcaataggttcaagaggtgcttcaggtgcttcaggatagtccacgtgcttcgattatgtgaggtagaaagaaaattgaaatacgagaagtgattcggaacaataacatgttcatgtcaataaatttcagggatggtctatgaagattcagaacaatacaactgacttcacatcaatgaccttcaaatagaatacgtgcatggagaattgagatacgagaatggatttggaacaatcacatgttcatgtcaataaacttcggggtggtctatgaagaactcagaacaatgcaacgagcttcacattaatgaccttcaaatggatacgagaaggattcaaaacggaaccaaaaattgtaaaggttatgcctgacaaaaatgaaatttgtgataataataatcataatttgtaaaggaatcaaagaaggtgaaagttgaggagataaatagttgcatataaatggaatacattgaagataagataaaaagacagaagaaaataaatatacttttgggggatgtgaataagaaagactctgattcatgaaagaatcatgactctcattcatggaggaaaccatggctctgatatcattaaaaagtaaatactgataaattggaataataattcctctttcattcattccattctcttctatatttttcctcgacatgatgttcttatataagaggaaattcaacaaaatgttaataatacgggataataacaaactaaacaaactataacaacctaacaaatcctaacaataatttgaaatttaaattatacaattcaatacttacaaaatattgtaaccctagcgatttcaacaaacgtaaggtcagattattattattatttatattttattatcttttgaggagatatcatttgattccgtactaattggtttagcttctatctatttcatgtgctcgaatgttgaatgttcttaatcttcttatggtcaacgttttcattagccttgatgttaaccctgttggtttaaatttcatccttcatttgaaattgtgttggggttctggtcatagtaactataccgctctcttcgaataaaacaaaacacggctcgttcattgtgtgcagttgagacacgtcttaatacagcataagattcaacgaattgcaagttgcaactgtaatccaatcaccgcaaacttcttttgacatattttcttctgtaattgtatataaaattaaaattacttagctcatgtgcatttaagagaatgagatattttacgtaatcttactcttagcaatgcaaaaattttgtttttggattcaaacctttcttctgtaattatatataagtaaaaaaaattaacttgtatcttagatttaaatataagtaaattcaactatttttatttttatttaactatattattcttaaaacatcatttattttgttgtgccaagaagaagaagatcaaacacactctcacagaagtgtatcactcaagcttgatcagaaaaaaaatctcagagaaaagataaagaacacaagatcaaagagaagacagatttatatgagcaatgtgctcatgtttcaacaagctatattctcttattcctgaggaggaaaactctcaatgataacaatcgttcatctaagacagagatacagattttttttttcatcctggcagagatccttctctcttagcttcttttacactgcactctaggctatatacaaggaatagaagaactattctgatttcctagctaataaccaacttaactgtcacaacagaaagttaattaggaacagctttccaaaagtaactaactagtcatgattgtttgagaaccagcaaacaacatatttaattgcaaattgcaatccattttcaattattctttttatttataataataaattctaataaagaatattttatgaacaattttatattttacttaaaattattaaaactaaatagcatcaactaactttttaaattagtgtaaaattaattatttttacttatatacaaataaaaagaaatataatcttaaattttacaaagacttccaaaggcaaatgacatactatgaatacatcaaaattgagtagctcattaagttagaataacaagcatttatataaaagtataacaaataaatataaatatacagtttggactccagaaatctcttagaggatggctgcaatgatttatcctttgaatcttagatacaatgtgtgtgtgttgagagagagagagagagagaggaagcatgggctcaaagccagaatggcatacaccatcactgtcgccagaaaagcaaatcatggaaaaaatatcatttaaaaataaatcacctaaatttccagttttgcaattggccaagtacatatagcattcctgacagctttagattaccatatagagaaaaccaagccctctgaagatttcagatataaaaccgaaataattttgttgttggcatttcatagtgtttgtcactttaatcctatcattaaaatttcagagccgctctcttgaccaggttggtctggttctaaaattggacactgacattgtttttcaatttctctaattatttttttgccagatattgcataaaacatatcatacatatacttgataacccttgtcaggacagtatataacctccaaccgcacaccataaaatggagaaggaataaggggggttcaagaatttgcgcaagcttcgcaattttcttatattggaatgctaagaaacctttaatataatctgcaccaacaagtatgtgtaaagttgtttccattccatcatggaagaatgaaatatgaatgagataattaaaagaagacaggcaggcactcattagaaatttgattgtctaaatgtataaaattaaaccatcaactacaaatacaattttatcataatttagattaattgaagctaattatcgatgtggaacaatcatccagacgggggcatggttgacagaagattaagaaatgagaaacacgaaattcaattcaatggacagatagactaattcttatttggcatactcttctagcttgccagaattatggctttcggcaatcttcagaatcaaggacttgtatgttatttccgggtttaccaaaaaaatagttgagtgtcttagaaaaactaaatacctttgagcccaatctaaattgggccacccatattatgcccttgtgtaacaagatggattctgttattaccaccccttcttttgcttttttctctccatattttgtttgttattttttttcataccactaatcttaccccttcatccttgtctggctcttacacgaaattgagactaaaagctataggtctggctaattcactatcacaattaaacaatgtagtggcagaaaaaggaacatgaagatctataaatataagtcaattataggagctcacaagttattgttgcaagagttgggtattctctttctaaatatgagcgagacacaatgttttacttctttgatatccaagaaattaaagaggatacaaggaaaatacataggctggttatggattttcttgtagtggggtatgatacccaagtttaggaccaaagggtgtaattatgaagattatggaaaggataatccttgatgtagcaatggattctttgtaggctaaataaatagaagtttgcaatgttcgagtaataatcgagttaatccgcaataccattgcttagccagacattcttttcttagaaatgggcgttgcttggagtgtccacctattaattgcaatggtatctcactgattatgatttctctaaagtgtctttatttgagatctggtgttacttttaatgggtctagactatagtttcttccatagcaactactaccaaacaaagaatttatttatttattgaaattgaagtgaatttggcatctaaacataaaagcctcaaatcaattattatcctaatttgaataaaatgttattagataagaataagatatatatatatcttatcttattattttctattgtatttgattttatataaacaaccatcatattatcaatcaagcaaattgcaatctacagcatttagtatatcaatttatttatagattttgttttaataattttactttcttaaacttaattaaaataaacaagtgagaaaataaatcattaatcagatattttctacacttattttcattgaatgcgagcttataacttctttgttgtataccgcattttaaagaactttttatattaaattaaatattttgtttgtcttcctttcaaaaacaaaatactctctttgtctttaaatattagttatcagatcaaaatagttttaaaattattttaatcaacatttaattttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgttaactctctcggttagatatttttaacttttttttttcccgcttttttcatggaaggtttattccacacactatcactaaaaaatatctctcttaactatttgaaatacggctctgttattattattctactgctaactatcgttctgttatctttacatgtatacttgatatcttcattaatattttatctttttttacattcttgcttatcttaacttttcatatcttttaatatgctattttcatctttatttcaaacttcaattcaataaattttaaaaactatcaataactacaacaaattgataatagtaacttattgagcagaaacaaaaccctaataagagactcaccaatacccttccctatataaataaagacccgcaccttattctctgaaagaaaccaaagtcttctttgcttctgaggctcccctcccctctctctgaaatccccaaattggttgtgaatggtagaaaccctagtcattcgatttgatgctctctcccttttgacatcaagggtgagcgcattcggttcttgcaagcaagcctggtactaccgatgcctcggcctcgacccctgaatttgaacaattcataaccacctttcttcattcattctcgattttccttttcgactcgatttgttgttgtttccttgacgaatcatgacgatgagcaagcagaagaagaaccagaacgcgaggaggctgttgataaccatcaatgtgctggggagcgcggggcccattaggttagtggtgaacgaggaggagtttgtggcggcggtcatcgacaccgcactcaagtgctacgcgcgtgaggggaggcttcccgtcctgggaaacaacaacaccggtttcgtgctttattgtccccatcttagatctaatggtacctttttcaatttctcaatccaaccctctctgtttatttatttggattgccattttttttaaatcttaaactgaattggagaaattggtgcgttgtttgtggttgcgagatgttttcagaaattgaattggacagattgttctgttgtggttgcaagatattttcagaaaattgaattggagagattactgtaaccgtctggagtcatgaaccatgctaataatctctgtctagtgacatttagttgttttattaaaaaaaaaatcatgaattgaatttttgttgtgtttgagacatgaattgaaattttcggtgaatttctatggtatgggcgtgttttaaaaaagaaaactatgagtttcttaggtgtttttggtggtattctcctattagattaatctttcatctaagcgatatttataaataaaggtctgtcttcatgttcaactatgttaccaaagtaaaattctgattagagaacaacaccaaaaacacataagggctaaggaattagtacacatctaagttttgtctttttaggtccttttaaaaatttggctttttgtattgggtttgttttgttctgaattgtgtgtgatggtgttgaagctttgagtccatgggagaaaattggatcgcatgggatgaggaatttcatgctgtgcaagaagccagaggagggtgtggcggatgtagatggaagtacagcactttctcgcagcagcagggggagtaggagctggaaggcttggttcaacaagttcctcaaactcaaggtttccacccactaatgaataaagctctctgggaattgaacatgatgccttttgtggttaatgccactaataatatcaataatatgtggtatttcttttggttgtttatgttctcgctagccggagaacccctctctttaggaaattgttcaactttgacatttagattttgattttgatggaatagaataagttttgattcctctcttccttccttgtcattttttattcaaataaattaaacttaagatagtgaatgcgagctaatattccaagtatattctcttctctttatgttgcactgaaacgtgtttgttttttatcctctcattggtgtatggcgctggttatggttttggcaattcaaaatgtatttgtagtcaacaaagtgtcagcgggaaactttcttattatttatcttagaacttagaaggtgctcatccacaatacgcggtgcaaggaaaatgcatttgagcagtaaccctgggtttgtaattttgcttgctggcaagttagagatgattttggaaaataaaaataaaaattgtagagttgacaaaaaaaaaaaaagccctgtttgtacaagattttaaaacaaacgaacctctaatttggcttccaaaagcaattttccgtgttcataaagttgccgaatattaataatttaatacaaagagtactctaaaacaaagtatccaccaaagaaaagctttcttagcttttgcttgaaagtggtttatttttaattcagaaccaacctaatgctaagttatgagataaattaatgataattaagataacaatgataagttaataataataaagatgttttataacctaatgctacattgatcggtgcatgttccctagatacatctatttttaattcagaaccagcctaatctaagttacgacgatgataagttaatgataattaagataataatgataagttaataataataaagatattttataacatatttttttgggaatcttttagaaatttgatagtatattatatttaaatttaaatttttagatattttaatatttaacgatctattatctttaattttaatggttattattaattattttcatgttttcataatgttcttatcttattcatattatatatatatatatatttaaaaatatgtaaatgcattttatgttattttatatttattaactaatttgacaaaaaaattatgaaacatttctatttcaacaaatatctttcagataatttttttattactttcagttaatttttcaattttaaacttattttttctttggtcaaacaccctcttagttgatttgttttgccgaatagatcaccgaattagagatgtatattttggtgctgctacattgatcggtgaagagaagataccactttttaaacaaattaacataaaatgtagagtttaataaacgcaaggctcaaattaaagaagagatggtttcagaaaaagatcaccccatgatttgagaatcaagaaagtgacgaggaccgtcctccagttgcaccaaaatgtatgttttaaatttgagttatatgcaaaataatgagtccttcttcgatattagtcatgtcttccacttgtagataacgaagttttggaattgaaagttcccacgcaaaggaagagtgggggctacgtgtgtggttatatattgctatcaaagtgtgtgcatgatcatatgattccattctactcaatttcactacggccatcccttttgcgaatgcatgcatgatgatacgcgaatctttgagattgttgttttcttttgtctatgcaagttacttcacctatagcagtatatatgcatggtctnnnnnnnnnnnnnnnnnnnntttttttttttttttttttttttgtgtgtgtgatagggaaaaacattcttttcttttaaaatgacatcatatcaaactatcgtagaaaaaattcatgatacaataactcgttttcttgcttattatctaacggaattctaacttcacagccaatattaatcgcatgtgatgaaacaagaatttttaaagaatgtaatactatatgaaagacgccttaagttgttttctttttttggtaatgattttttttatcggtagatattagtttgttaaaaatggtaataagtagattttttttttatcggaattctttttgatgttgcttgttagagtttgatgatgttgatgattagagtgattctgtacgtatattcagaattgtttttatttatttatttatttgatgaactgttttttgtttgatttccatgacataggattttagatggacattgatcagtggtgataggaggggaatggcaatggtgtgtggtgatgggtcgccggagacggtggaaccaccgaaaaggagaaagagctgctagaaagaaagtgagagaaaataaaattccctttgcacatcgtctaaatttgtatatattaattagtttttgtactttgttggctcaaaataaaactcccattgcaaaattcttaatgcaccctggtaccttcatccacgcgatcaaattatcaacatcaaacaacattttgatacgatacaaatttaatccagtgaaaaattggacggatattacttatttgtatacatctcatgttaatattgagtaaccatggctgtatacagctggctctgtaaatggtttaaggcacccatttgtgggctcttgcaccatggtgcaacttttttaaaaagttacaataatagtatattttttaaaaattataaaaatggacaaatcatactttaaactacgattttactagaaaaaaaatcgtacttcaaagcatgattttgttcgtcataaacttattacacgtatttgggtatattattttatttttattttattaaaagttgaaattatatgttaaaatgcattttaacatattttttaattattttagaaattatattttaatatacaatttcattagaaaaaagaaaaaatactaaaattgaaatttaacataaaagttcagttcttaaagaaaaaaatattttaaataaataagaggtgaaataatactttgatatataattttttttattgtgaaatcgtatatgaaagtaaaatttattcattttcatgaaaaattttaaaaaatattcattatgctaattttttttaaaaatcgatctattttcgtaattaaccctccatctgtgcatttctttattatatacaaatacctttttttctgattaaaaaaaaaaattgtagggtcaccaaccgaaagaaatcaaagaaaaagaagggtacggtacgcaaatcctttgtacctgaactcttcttatgtcgttatctgtatatgtactgttaatcttttgcaattgggggtcattttctttatttgataatgcgagacactcacaattcggaggatttttttttttttgttgaactattcggtggagtttgacacctcctttttgaaaaagaaaaatattctgttttctgattacctaatatattttgtttaaaaattcttctaaataaaataaacgccaaaaatcagacattgtttagaaatttagtgtcctgatggacaacacttttctctatttatagtatagacaataatgtcaaaataattgcagaaagtaaaagaatatcttgaatcaagtagcttttacatttctccaaaaacacacaatgatttcccacgcatatatatatatccaaatactaaatgtaattgaatgacttcgagtgatccaacgttaacaagaaataccaacacttgatgacaacgccggctcatcccttttggcaaaagcaagctttaggacacagcttgctgctagtactctattttcaagtcctacaaaccaaagacaccaaagaacaaaagagaatttattttagtaacacgtgtattacaacttgtaatgttaagaaatatgaacactgagcaattccaaaattcacattatatgttttattattattattatcaattcaacccaagttaaaccaattaatgacttgtatgtctcttaacaagttcaatttaaaaaattaaaaatactggactagagaatttaagaacatgcatgagaaaacacaaaataaggtgactagaaatatcaattaatgactggtgaatatgattatcgcaaaactgacgacctaaattgactagtgaataaagaatgccatcttcacgcctatattgagtttggtttcatttacaaaatgacttttcagctaggtttatatagcagccatactccatatagagtttcataaagctccattgaacttgcaccatagattttgctcaacttttacaatatgaccactagcctcttcaggaactgcccctacaattttatgctagcccttaaaaggaactcactagggcctcataaaaagtcaaaagaggttgtttgagaaggattatatgtgggaagaatcctgacagtatttgaacagcaaagctattgactaatctacaactccattatgtaccaatttaataggaaaaattacttttatatataacccctaagttgtacaaactttatcttgtaatcttacacgtaaaaatcatcattttcagtccatgtaaaagtacttttgaatttcttttagtctcgttacaaaatatcaaagattaaaagataaaatttatatatcgaaaggaaccaaaagagatttaaaagtatttaaaatttgtgtaaatgtaagaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatcccttagaaaaatgaatagtattattaaatacaaccatctcttaaatcatttaattcaatgagtgttttcgaaaatttaaatttataagattattaattagaattaattaatttaactattttaattagttaagatgaattagaattaattaatttaactattttaattaatttaatatcaaatatctatgtttacccaaaaagaatatcttttacgggtccatgcaaatgctagtacatgtcgtattcatcagacacatcagttttagcatatttcgagtattaaaaaattcagtaaatactttattaacaataaaaatgtaaatgttcaaaaaaaatattttttaattagtaaattatcattttaatgatgatttgtaaatattatatatatatatatatattttttttttcttgaagatgatagacttgaatacatttggatttgatgtgaacctcacacctgctgtgattggtggtgtcgtcttgttttgtgtttatgaattagggatctttaacttcaaagagatctaaaatgaaaataaaaaattgtttaaaaaaattcaaaattgaatcgaaatgattgcttctcaatttgtttgaattatttgtttctaaaactaattgatttgttttagtttgttttgtgtttatactaatatttatattattttagtcttatgcattttatatgtatataatttgagtctcatattatattgtagtgctaagtatataatatttatataatgtatatcattttttttaaagattttttttaaaatatgtttggtttaaaatggatacaaacttgctagatttttaatttgttattagtaatttttaaaatatattaaaagatgaaaaaaaaagtatatgaattttaataaaataatattttagtaaaaattatgaaattgaatcaaatcaaattgtaaaatattggtttggtttaaattttattttaaataaaaattgaatcaaatagaattacatatatttttttaatttgattcgaatgacaccaaattgaattaggaatgcccctattatgaatgtatgttgggtcttgccatgcttatttagttttttttggcttatcttatattcttattgatttgagatatttaacttttaggtccatgatccatgattaaatattcaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatataaaaagcaattctttatggaataatcaactactctttcagattctatttataagactcaatcaaaattaatgttttatcttttcataagataaatttataatgtttgttatattaatttattttataatatattatcctaaataaaagaaagattgtaatatagaaatgattaaaagagagagaaaatggagtattgttaacgataatagtagtaatttgaaagaaaaaaaatacaaattgaggacatatttattgatattaattaaattaataatttttgttaatgtaataaattagacaattaaatcttataaatacatgagaccacaaatagtatatggtttgataatcaaactatgagtttaatgatgatatagtaacaaaataaaatggttttacattttcaactaatcataaataaatgttgttatgatttttaaaatagttattataaaagtgaataaatttatcatatataatagattatgattgaatgactatgtaaaaatttttaaaatattatttactgcaaaaattaataacagggaaacacaaaatttaaaaaagaaccaatgatattttagtaaataaatattaattaaaaattatgaaaatatataaattgataaatatacaaaaataaattcgtactaaataggatttttcaaaactttttttacacttatttgtacatcacctattttctcgtcaattatggtgttcatatttgccgcctcaaattgtcttaagaactaaatattcgatttagaagcggcacaaatcgattgcctcattaacaaaagcctaaaaataacatattaagttactattttttgtgttacaaattttaacatatatatatatatataagtaaaattctttcattattatagtaatgtactataagaaaaacactgtctctgtatcttacacaaccaaaatcaactaaaaacttttattaaaattgtttttggaataattggactgaattttggaaaaagtttttacaatccaatttacccctcttggatttgcttgtcatttgtctaacaagcaggacatgacaacccaatgtcatgttgatggaacactatttacagactataggtcgataatggttaaggttgccaaacagagcaaggcctaaaaatgctacgtgacaaatgagaaagaagaaagaaatattttttttaagttaaatattaaaaataatacccctataataatttaagtaaaataaaagaaacgattgagatttttagtcttaaatttatgtataggttgctaataaggtcttaaatttttgtataaattactaatgtactacaactaaaaaagtttgaacatattagaaagtagcaacctctctctctaaatatatactaaaaaactgcatcacgattagttgaattagttagcagtgaaacagataacaaattaagtttaaatgatgggatgtgaaaagcatttgtgagtataagtgatgttgaacaatgtacagtgactatgtgtgttattacaggcgcttgatttttgggattgaagggagtcgcatgcatcatcaagaggcatcagagttaatgagttgaatatgggagtgaaatcattcaactagaaatttttattttacccttttaccattttatttaaacaattattgttggtacaacaagtgtaataactccagcttattcaatttttataatgataaatcaacggactaaaataattgagtttctatcctgcatcatgataagaatagaacgagttcagattataaatagttaatttgagattttgtgattgaaataaattgagttggatcactttggatgaaacaaaaacttcttgtttatattagatatgtgatgatcattattttaaattgcgattgcagttgcagtaagtcagaaaacttttgcagcattggaggcaattgctggaaaatgtggttgatgcaatagcaattgcagttggggtaagttgaaataccttaatgttatggccacaatttaaaacgataatgattaagggtgtgcagttgttggagggtcttgatgtttagggagtgtaagatcatcacccaaaaaggatttgaacaagttggccataatttatccactaaattagtagtgctggttttgtttataaggtatagggttatatagctctaatcaaaacaaccggttttggtttttatcatttcccgcttactgttttaccttgttaccctatctctatatgcatctatactaggcttaatttccatggacagattccttttaaaacaatattgtcttttgggcaaagggatacaggaatggaaaagttataaagtgtatcatgtgataaacaatattggaacttatatattaataatttgtcttaagagattaatcaattgatacaaaatgagtatgttcttccaattaatcagtgaaatctggatcaatgggacttgttgatactctctgtcggttgttttcagctaacaggataggaatctctttaaagtgatttaacaatttgttgatgatgtagttcactttctagataagggttatgaatattctttctttcctcaagattttgaagactatctctagtttgtaggttaagtttgcttgctttggctaatttatcatgtggaccagctactatctaattttgtggcagtggccggtttgtcaggttctgcagtagtttcttactttattattggagttactttgggtgtggtaatatccactgatctttcgaggttatagaaatattctatcccccaaatatgttccatttccctatcccaccagttagaattgatcgaacacttcacttgagatgttttttgacccacccatgtctatttagtaaaatgtgtatagttaagtgtgtttggtttatcattgaatgtgggaaaacaatcgatggaatgaaatgacatgttagctttctggttatgttctttggaaagtatgaattcatttttgcattaatgcaaacaagtttccaaacttgtatagatgcattttaattatgtcgaatatttgagagaaattaattatctattggtggaacaatctgagtgaaggtacaatgtaagtacaaattggactcttcataattttgaacttatctgttgtcctgttaacccaagacagtgggacactaattttgtatttataaaatggactcttcataacgttccatagcaaaaggcaagaaaaatcaaattaacttttttaactaagtgtataaaatcttactgatattaatacacagatcaatgtacgtatgaagaacatataaatataagttctaaaaatcatttgagatttagttattagagcatctcgtgctaacatgcacagctcactgatgttctgtccaagtgaaggtacattgtgatacacatcagttctaaaccaatagtttcgcatatggacttatgcaaaaaggttgccctaagaggaatggttattagcatgaaaagggtagtatccatgcctcgaaggttgtactataggctcccgattgcagcctttttagcattcattgctaaataaagagtgtttgttcaatgctcgtctcaattctggtttagttctatcaggttcctttccaacaaatgacaacattcttaatttggatatatatgatatctggacagtttctcgttagagtggttagcacttcccttttcagttaattcacacacaaataaaataaaatcgcttgatacatatgatgtgattaatataccttgatttcatcttggttttttacataaaaaataatatatgaacagaaagtgaataaaatctgtttcacagtgttacttattatgataagttagttaattttattacagatatcttaaaatttaaaagtgattaattaataatataaaaactttaatttcaaaatgctaataacatttaattagaatatttgttaatgatttttagagctaatgctttccttgacataagtctggaatttctttgtctattgagcatttgatagagcatagaacccgtttgttaaatccctaacgggttttgcagcgggcttcagatgtaatctttaggaacccaatacacattatttcaaaatctgatataaaccatactatataaaagatattatttgtgggctgtttgtggcctttttattcttaaagaccaaagaactataataagaggctgggagtggcccaaaaaaaatgaaggaaaaaaaatcatacttttttcagttaattaagtgtgttttttgtttgactttaaagaattaattttgcgtccagaaataattttaaattaaattttacatatcatgttacagaagattttaaaattaattctaagttgaagtttccttgagtaatttgtatgttaaatcaaaaaatttatactgaattttattcttaaattttactcttatcttgattctataatgaaacatccaaacataaatcaagtaatttcaaaattaattttaactaaaatcaattttaccaaatcaattataaatctcttgccttgtgatttcgctttagtcgagtccacctaagttgattcacatggctataattgattaccaatttgtatttattgctcttccttgcattaaattcgtattttttttgttttttactttcaagggcagtcttaggttncaagggcagtcttaggttttccattcaacaatagagataattgtacttgttctagttttttaaaaacactcaccacccctacgtaacattaaagaaggggtgtgaatgtcactttactaagtaaaataagggaaagtgagtgtctatttaaaaactaagagtgtctatcattttaaaagacttcaaagtgagtctaatctctcctaaattattttgtagaatgttgcatctttgtatttattttattcaaaaatgcattcagtatgcagaaccgtttaaatatggatgctaattgcttataaatgactacaatataagtgtgtgagttctctgcaaagcatcaatggggggacctgtagaaataatttggtcaagtgtacaaaatatcaccaaagttataattgatgaaatttaagttctgacctctgacttcctcaatgtttttacaagaaatcagtattacaatatggaaaggattctagggattggtgctgagttttggtttctgtgctaaatatagatactatatgaattttttgcatttatgatttataaagtgttgtggactggtctttcattctttaaatgtcttgttcgaaaaagaaccttggtccggttattgtgggacactcaactgtgaaacacatgttctgttcaatgttataaatgcctacagcaccacctatgtaactatgtctaaatggtgcatctggggttactagtccccctatagcgactgaagcatctggtaggacagaaacgtgtttctagtagtatgttagaatgttcttattttaatattattaggtaattgatgctacaaacaatggaatcaatgtgtatgaggaccaccatatgtgaatcacacacatttgttctcaatagtagatggaaggttgaatctggattgaaatttgaaagattctgctcagtcagtccctaagaagaaaatgaggctttaattttcaatgtgccataactctttgctgacagcgagtgtgaatgtgactccttctcaagtatgcatgtataatcatatttggaaaaacagctgttatgatcgtgattcgtgatatatatacatgcatgtatagcaaataatgaagttgtttaaattaaatcaattgattttctcgtagtgaatataaaattatgatgcagtctaaatccattaaaattttttcatcaactcgtataactacttaatttagatgagtctaaaaacatactattctgccatatataatataccttttgctttggattgtataggccaatgactgtaaactaggaagagtgaagagtgatttatgaatattgaataatgactatggcgactctttgaatttagttgttttactgtgcctcccaccccaaaacatgcaatgcatttcatagctaccagcacagtcatttgtactggagaccctcgtggcaaaacaaactgttgaatccagtggagaaattgttgttttgattctgttcagcaagttggaaatttattccttgtaaccattttttaaattgatccattcaaattatacctattcgactttcttaagttctgaaaccataattttgaggcctcaatgagtacaatgaacattgtaaagacatcaatgtttgatatgagtgatatcaaacatatgatatatatagacacaattgaacaagtttaccaactacctggtgaatgttattgcctcagtgactgtgactgattgtggttggttcttactttttactcccaagtgaataatgtaagttttatacactggatgcactgtggtctttgctgttgtgtgacagctgttttgattgaagtgtttccttcctttctaactaaaaattaacataatattaggtactattatgagcaccaacaggcttcagttgttgcatatgtgacctagaaattgtcatgtctggaccatgttcagttattttagtaaatgttctttaaaattgtctccctgctaaatttctcttcctctaacctcctaggtgttggctgcatcagcatggcaattagcatgaactgtcaagaggggtagtcatccatcttgtgtttttgtgcaccagaggacgtttggagatgtaggcacaagtcacttggtgttttaaaagtttttcacaccatagccatgtttggcttcgcgtatcagacatggtttttcacattccggatttgatttacagaaactaatagttatagcttctacatctcaaacgtaattataagatgatttgatggcgaaagaaaaagaattgtcaatgagttcaaatttttctactaacaagaaactattaactaacatttattaataaaagaatatcttaaaggtaatttctttattctcaaaatgtttccataaatgctaaaagttacgttggtagttgcgtcaatccatcactcccagtattttactgggccaaagagcaatacatgttccactaataaatcttatatcttatatacagactacgtgcaaagctttatgtatgcacatttttttatatataaatgtcgatttgagtgtaaaagtagtattcttatatcataatggggtaatttaaaaaaaaaattattataaaatttttaaaaattacaaaaataaataaatcttactttgaaatatggttttattatgaagaaatcttgtttcaaagcacaattttattggttaaaaaatcattagactgaaatcatatatctacatataatgtcagttttttattttattataaggtggaatctattttaacatacaattttaacatttttttaattattttaaaaatcatattttaacttgtgattttaacatattttataattgttttaaaaatcatattttaacatatgatttcattaaaaaaactaaaattatattttaatatacgatttcagattttagagaaaaaaatattttaaacaaatgaaatatgaaattatattttaatatatgatttcttcgttgtgaaattgtatattaaagtatgattttcataatttttaaaaaaaatatacattatgataaaaaaaaattaaaatctatccatttccttaattaaccagtcaaagtagctttaaagataattccacctttatcgtcgaattggaccagcagagtcctcatctcacagatatacatctagtaaccttaccaatcatttgagctccactagatcataaaaaatcaaaatgttaaaatatgtcttttttaactcataactataaaaatgtatttaaaaaaataaattttttagtatggttttattctcaaaattaaaatgtattatttttttttacaaaaagtattgaatattcaaattcaaactacatccattactttattttatcaattatatgtataacgaatataaaaaaacatcaaatttacaaatttcaattttatgagcaccaaaaatatactaaatttttaaccaaagaaaaaaaataatattttaaccaaagaaaaattactctttacaagctctgctaatttcccttccaatagttttaagaaacgatgtatttttaagataatatatggttttatggtatttttgctcttcccaattgtcaaatgtcaataggaccactttgtcaatttcaatattattaacccaaatgaccttgatgatagatcgaagaatcaagaagaattagctataggagatataaaattagttatttatgtgaagactattttttgatagattttatattgttatttaagattgaaaatttttaaaatttcttttatttttctttagtaataaatattattttgaaattttaaagaaagaaagaaaaaaaattattttttaaataatatatagatattgagactcttttataagaattcattcttaatatttgatattttatgaaaaatctagtgaaaatcaaattttaagttcaaaaattttattcaaaatttagcattaaaaatattctaaattgattaaaagaataattgcagatccaatcgttctcgctaacaataattaaaattaagaaataatatttgtcaattgtcaatataaaaaaatccggtcttaaccagatccgaaagtacttcatgttattgttctcatcaccgatggactagggaatagggatgtctctcatctgtagaactataattgcacttacaaattttgtatagatttagcgtacacataattaatcaaagatcaaaatgccacgtagtacattgaaactttgtacttttgagtgtacaaatgtaaagtgtgtttgataagttattaataatttatttaactaatttatgaatttgttcaactaaaatagaaatgtttggtacaaatttgttgtactagcttaattatagcctttttcatataaaatagagtttaaatttatgacattattattattattattctttcatttttttatctccaatacttttataaatgtcctcgcttagcatctcatttcatagaacattatttattttaaattttttaatacaatatttgatcattaaacaaaaattacaaaagttttatataaaaaatgataagagttcaaaatagttttaaacattgtcaatcttataatttaaaaagaaaaggttaacttaaaaggttatgagctaaggatgcggagagtgcatgggctttactcttgagctcttatcataggtttataatgtattcagttaataaaaatatttcgaatgaatatttttctttaatgtagtacgagttcgacagatatttatgaatatgtatgggtacttgtgaatatctattagtttattaaaaaataaaagaaatgtaaagaatattttaaaaaaacaaattattggaaaaaattataatagtaagtactaattaaatttttaatattaattaaattaattttttgcaggaaaattaaattttatttaaatagttaaaagtattttaagtaatataacgtgttggttatttattgtacgggtatttcattatccagtctcatcttgtttaataaatgagtgtaaaagtaaaacacatgctttctctaggaaggtggaaaataaacttcccaaattcattctatatatagttttatttatcggatatagataattaattgtgacatccactcatcctcacatactagaaaaatggggaatgcatatttttatgctaaaatttcacatcacattgtcacgcnnnnnnnnnntcattctatatatagttttatttatggatatagataattaattgtgacatccactcatcctaacatactagaaaaatggggaatgcatatttttatgctaaaatttcacatcacattgtcacgcgaaaattctagatttaacttctttaaaataaaattgtataaaaaagtcagaatttatctcagaaactcaacttaatttaaatcatcagcaaacaagtcatttcttctcactttatgtatctccttcctttagaagagtttagttgaagcatttggtttatctataattcccccttcagaaacattaaataggtcaggtgctatcaaatttatgaagaaagataaacataaaactttcatacgacaaagtgatatagaatttattaatgaaaccctgcaggaaattaaacagcgagagtggcaaaattttgcattaaggacaacacattcttcatgtttcaagcacaattcatttctatatttttttatccgctaacgaaacgtggcattctttaattttattcctgcgtccccaaaataatataacgaatgcacactacaaggaagtttagaataggaaacaagtatccgttcgtacttcgtacaatgaagtggataaggatgaacaaggtctcccatgaaaataaaatagccatctgggtatgtatggatggtgataaaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctgggtatgtatggatggtgataaaaaaaaaaaaaaaaagtgggctatatatggattttaggaaactcataaagaaaaggaaaaccaagagaagcaaaaacgtggaagaatgggagatagatagggtgagaggtccaagcgatgttatggtcaaacaaagctcaaagggcatgcacaaacaattcagcattgagcaaggtcacattcaggtcccccacatgcttaactgttctaaccacacgagtgattcagacattgtccatcataaccaatgtgactctccacacacctaactcccacacacatttatgctgaggcaccgccgctttatcattcaccatcttaagttccaataatccatcttgtttaacaaacaccttgacttctatatacatctatgtatgtagcactaagcgcgtttatcaactgatacgagattattttaacttaacttgtagtcttgaattcgaatttgaattctcagcatgcaactgttttatcaagagaaaattttattgtttaataatttaataggctcaaacagaattgactttaaatggaaaatagatgtgatttatatgtatgtcctggttgtcaaccacagcttccacaatttgaagaattcgcataccaataatgtctttgactaagttaacccctcactcaattttttgcataattagttccatgatccaagagaaggccccagcaagcagcaattttggtttcacttggcttctctaattaccactcactcataattgttaaaaagattttatggagataccttttttttttctccatcttttttccttttaaaatattgtggctgatgtgtgtaactgaaagagacctcatattttctcgtcggtagaaaagggcgaggagaaaaagataataaaagcaacagccgcatgtggagaattaaaataggtaactgatgtgagcagctacagaaaactttttaagatcactcaacagtggaaatgctattagaataagaaaaggtgggggcccgaccaagtaggaagtaacatgtgtatatagtatatggttcattatttataccattagaaggtggcaaacatataccaagtaagatggcccaatacgtagaaaccaatatcaatatgagcgtgagtgctacatatagatctttcattcactgactcgtctactggcctgcaaaataaaaacataattaaatgatccatgctgatgaggcagtctcttttggttcatatgattgttccttctcaccctggtgggcatggagggaagtgtcaccttattgcatttttaagttttgtgcttgttatcactcaattattgttcaatttaaaatttttcctaactttaatcaatttgtagtttgtgatatgacatgggtcagctaaattaacatttgagtggttagaagcaatctatgtaggaatgaaatgaagatattctcttatcatttagttttattctaatggactgagtgcccggccaactgggaggggttaggctatagatactgatcaaatacgttactagttggaggaaattggaattgcaaattcacagagtctacacctgagaatgcttaggtcatttattgttttggtttaattactacactagaatataatagagtaagtagagtattccatgcgatattgatggttcattctgcacttgccagactgttcagatttaaatttgagggaaaataatttaaaatattagagaggggataagtctagagaaaggcaggaaaaaatttgcaggtttcctctgacagatgatctcaggaactcgagattcctggaaagtccaatactatactaatattctgcagctggctaagtacaatcaaagttatcactgagttaataaaggaattagccaatggtgattttgattcttgccttgaccaatgatcttatgctgctttatttaagatactttcttggttaggtatttaggggatattaataaacagcaaagttatgtacaagaccagttatcaccatcatcaatatacagaaaatcagatcatactatggaataaacccagatgattttgatataaccggcaaaggagagaaagtactgaaacttgaaaaggtggaaaaagtatggcaatcaatctgtaggacaataattacaagggaataaccattaaaagtgaaactttttaagggggggatagcattaggaagatcttggacattaaaaaagtgggtgatcctttttgtttttgaattataatttaatttaatttaaatttttcactttctgatgactgaactttgtctgacacaaaaggggtctcggctgagattgcagtaattttgttatgcaaaatacatgcgtttgcagttacagttccatccactttgatgctgtgtatcactcaactcttgaaatatatgccgcacaaggcaaggtgctttatccgtgctaatgcaatgcaacaagccgcggattctccattttggttacttgtctgtcataccaattcaatcaaagctggccggctccatggcccagacagagggctaccatcattcttaatttgacaatgatggctcatacccatcccattcatcaaaaaatcacttgcttcaaataaaaggaaacactaaaaatagattctaatttattatatcaccagcaagctacataatactactaatatattaattaaaccatgatcaataaatacacattaagccttttgatttcccaaccctgaaaaattacaagagatttccacccaacccatcccaaaagaaagccaagtaaaataaaatcaaggtttacaaatgaaaaccctaaggcaaatccaaaataagtaaattaagggttggacagagagacataagttggggcaggaaaatagataatggtgggtctcagtctcatgcaatcagtgctcacagctcaacatagcacatttacaaactgccctctcatccccacaagttcctttttctttttttctttttttttcggtgggcatgattagaaattaatttaaaaaataaaataaaataaaaaagctggttgaggaatcggcgagtcgactcagtgagcagcaaccaccggttttgcagcgagttgccacacggaggtggcaatcaagggcctagtgtgccatcccaacatgagacacccattgttctcttccactctatacccatccccacccccgaaaagcgcgagcaacatgctagcctgcttgtacgcgttcgaacccaagtgaaccggagaaaacccggtcgaaccgaaccgattccgccactggttcagcgtctcgtgcctttccacacggtccattccctcgcacgccaccacgttgcagatttgcttccctaagtaaacctccgacatggccttgtcgttcgggttcacaggcgaaccctccagcgagtcgaatagagttgaataatagtgcagtgactcggtgaaccggtcgacaaaactcagtccgttgtggttcgcttcttgctcgacgacggtgaggatctccggccgaatctgccgaacgacggagaggactttctccaccgcgccggggcgggcgaggagcttgtgaaactcgaagacggagttcaccgctacggactcgtcttctcggagatcgagcatggaagcgtcgagatcggcgaggctgtttgcgacgaagccgcggtactcgaactgcacgtggatcgtctccgccagctgcgcgagcttccaacctacctcctggaggtggtcggagttgtccgccgccggcggtccgattccggttagccggaaaaccggaggaccgtcgttgcgaagcgcaagggcttgcatcagcgccggccactgcatcccctggttgattccgaaatcaatcacgtggacgcggtttttcccttggaacgcttcgagaatcgccaggttcgcggtgaagtgcgcgaacttgaggtaaggacaagtttcgtagaagtgaatctgtagagaatccgagagagagtgctgcagagggacgactctgtagattcgcctcgcgagcgcttcggcgaagtaggttgcgactttcctcatagctccgacctgcgacaaggctaggaagccgatctgtttcaccagcgcctccgccacggcgaggttgttgttctccaccgcctccgcgcacgccatgaggctgtgcacgaggcggattccgttctcctgcaagtcaacgaccaccaccgcgcgcgttgactcgtctgttctcacgcgcttagggtttggttgcgcgtcgctaccacctccatatattgctttccccggaatagccttgagatcgtagtccgacgaggcggaatccttctcgggctcttcggaggggagagggtcaaaattggaaagcatggtttggagccagttggagatgtcggaagggttgtaatgaacggcgtcgtttgaaagctccgtgaggtcatcttggacatttcccatggcttcctcaagacgctccagcttctgcgccacttccgccatgtccgatgacctcaccttgtaacccaccaccgcaagaagctcgtccatgcctccttcttcctcccaaagattcgattttccgcttgaataaccgcagcttgaggtccctgcgttggaaccaagctgctcgcgctccctcttcatcctttctgtttgctaactcaccaaaccctctcttttcctttctcttctattctctgtttcctttctctactgtaactagttctactgcatctccctcacttctcacatgactcgcacccaaatatcaatcaattattatatagttataaaatagtagtatatgtgtctataagtacaatcctttctttttttaaaatgtcctcggaataaaaatatttaacctggaaaaaattataaaatatttcacaaaacgaaaaaggagaaaacgctcgtgaccgagctcgaaccccaatgaaactccacgcaacctcctctaacagataagatccaaaaaaatgcatatttgtgttttactttgtttccatttctgtgtttcacttaatttaacaaataagtttttattgctgcttgtaaaaaaaaataactacttgtttgattaagtttaataactatttgaaatattgaataatgtaataatatctaattaagattaaattatttatttgagttgacggtataccagtctttttttatattttgcgaaggataatagtataacatattaacatttcccaaagagaaaaaggattcaatatcgggaaaatatgtttggactttgtgagtttattttattttataccactgcgcgccgctaatacttcattgttacttccgttaaaagcttaaattaagtacacgcaatacagctatggaaattgtatagactctacattactctatttctaggcgatgatgagatagaccttataggtgaatttggctacatggtaaggaccatgagtatcttcattaattgctaattaacattccgtagatatgcttagaaaaatggaaaaatagtagtgtttagttatagatgtttatttctttaattcatttatgatcttagttttcatatttttttaaaggtaaataagctttattttaacattaaagtgaatttgctctcgttgttattttatgataaaagtgttcttctaacctttgtcacaactataggaaagtctatcgaaatgtactttaatacaattaacacgcacatggtcaatttgtttatctttggctcaaaattaatttgagatcattggaaatttttggctcaacttgtgtatggtataatatataatacaagggagggggatttccatctcttatgtacctcacgagtggatgttctaattacattatcaaaactggttctttatcaatccatattttggtaattaagcataaaggggcagtgacagatagtcaaatttcaaccgacattaccacgaaagtaattatccttggaaatcaagctttattaaccgccaccgtctaagtaaagtcacacggaaatcagctagtagttacaaaggggaaaaaaaaagcttctactgattcaaaaagtcataaatctaggaagagtaaatcataaagcaataagttgaatgcaataatcaaagagaatgtccctacaaaaattgttagtcgagattcagttaccattattaactacaatcggatcacaccaatacatgacaacttctaccacgcatgatgactatgggcattctaatacaagtagactctcatgtaagaatcataaaagaatcgtgtgaaaagtgcaactaaaggaaagaccttttagggctgagctcctacacatattgtctacggcagcaggtcatggaatgcacaccacactagcatatgttatttgagattattgattgttggaaagttttggctcaatggtatatgttataataaataatatgagggacaaaggtctccatctctcatataccttgagtagatgttatggtcacattactaacacatcttacttgagattattgattgttggaaagttttggctcaatggtatctattataatatataatacgaggaagggggtctccatctcatatgtatctcacgtggatgttatagttacattacattactagagcttgtcctttaccaatccatatttcgataattaaacataaagtggcaatggcaagggtagaaattcaaacttccacggacactactatgacataattttccctggaatccaggctttattaaccgccaccgtctcagtaaattcgcacaaaaataagctagtagttacaagaaaaaaatgatagttttcaccaattcaaaaagccagaacaatcaggatatttagtgatatattttaaattagaattttagatcattttttttgtgaatgtgagtgtcaattagaattaaaaaaaattacttttttaaatggtaaatctcattttaaaatattaaaaaaagagaaaaaattacttttttgaatgtatatatcttcatggttgttttccaaaaagtcattattcatgttgaatatctttttacttggaaaccatgattttttttccaaaaattcattattcatgttgaatatctttttacttgaaagatctagtaaagattatatctaaaattcaagatctaatactaaaattacttaaaaaacaacaaattcgatatactaaccaaaaaaaaatatccctacaaaatttgttagacataatttaccattattaaccataaagggtcacaccaatactggcgacctctaccacatatgatgattatggacattctaatacaagtagactctcatataaaaaggacaataaaagatttgtgtgaaaagtgtaattaaaggaaaaaccttttaggactggactcctacatagatgcctaaggaagcaagtcatggaatgcacaccacactagcacatcttatttgaggccataaagaggtcaatgacaaagtcaaacttcaaccgacgttatcataaaaaagttctcccaaaaaaattacgccttcttaattgttactatctcgataaattcacatgaaaataagctagcagttacgagagaaaaagaaaaggaaagttttcaccgattaaaaaaaccataaatctatggagattaaagcggaaataataaatccaatgtcgaaggagaatatccatacaaaatttgttgaacatgattcgattactattattaactacattgggttgtcattaagtgacaacttctaccactattgatgactatgcacatcccaatatagacaaattctcatgtaagaatgacaagaaaagaatttgtgcggaaaatacgactcgggaaaaaccttgtagggccaagctcttatatatgcaaatgtccaatggaatgcatctgtgacattatatagaaatagtactcgttgatatcacatataggctaacagattacctcaaaattaggtctttgtgctaaaaaaattattatatcaaacattataatcttgcacaacttggtctttgcattaggaaaaaaaaagttgttatgctcatttaaaatctttttatcattcttctttgatattctccttgcttagcgcattgaatttattatcttccaattcattttttttagtatgctttcccattctctctctctctctctctctctctctctctctctctatatatatatatatatatatatatatattctctgtgatattctactaaataattgtggtataaacgttgcgggtaagagatcgtagaagctttcttttttatcagtagaagctttctaaataaataaataaacatcgctaaagtattatagcttaattattttcttgggttataggagacatgtcgaaggtgattattatgggtctcattcaagaagttactgctaataaatgtataccaagtattcgtaaaattatttttacaaagacgataataaattttaaattacatacaaattatttaaattttattttttaaaattcaacgggactaaaaatccggaaaaattatttaaactttcaccactgtaccaactctactgcattaaatagtaatgcgttaaataaattttatttagttatcttttgtgtataatgagtgcaccaaaatttaaatttataattacatgcatattagtcccaatcccccgccactatannnnnnnnnnatatcacatataggctaacagattacctcaaaattaggtctttgtgctaaaaaaattattatatcaaacattataatcttgcacaacttggtctttgcattaggaaaaaaaaagttgttatgctcatttaaaatctttttatcattcttctttgatattctccttgcttagcgcattgaatttattatcttccaattcattttttttagtatgctttcccattctctctctctctctctctctctctctctctctctctatatatatatatatatatatatatatattctctgtgatattctactaaataattgtggtataaacgttgcgggtaagagatcgtagaagctttcttttttatcagtagaagctttctaaataaataaataaacatcgctaaagtattatagcttaattattttcttgggttataggagacatgtcgaaggtgattattatgggtctcattcaagaagttactgctaataaatgtataccaagtattcgtaaaattatttttacaaagacgataataaattttaaattacatacaaattatttaaattttattttttaaaattcaacgggactaaaaatccggaaaaattatttaaactttcaccactgtaccaactctactgcattaaatagtaatgcgttaaataaattttatttagttatcttttgtgtataatgagtgcaccaaaatttaaatttataattacatgcatattagtcccaatcccccgccactatannnntataattccatgcatattagtcccaatcccccgccactatactgaatttagtggattaaatcttatttactttaaaataataacactcatgcatgcgtagaaattttaagaaaaaattaatgcctcaactttattgtaacaactagttaagaacttcaattttactttaatgatcagttaaattatttaagtttaatgataaaatgtttgaataatttcatcaattaaaaaagtttatatgaatcataaaatgctattttttattaatcctcatgatattctatataaaaatattaaacatataaaatatatttagtttttttctttatttagtaagtaggaagagctatagaaaatgttatggaaaaatataaaattatccataaacacaatattaattaaaaatttaaacacacattattaaatgctttaaatttttaatggttcaactaaatgctttgaattgatactttaaaaggtaagtattgactttatattatgaataaaatattttttaattttaattttttatcacatatatatagacacacaatagaaaaatttgtaaataaataaaatcgtgctgaagtaaaatcataaataggtttatgccttacacattgactttgattatagcgagaagagtagagtagagaagccctacaaagccgaaatatagtaacctgcattgaaagtttagtacctacactctacatccaatgcatccacaataaagtcataatttcaggaaaattatgggattgacgtacgggtaagtaagtcaaaaggagtgataattaacgaacacaatatctatctatttatctcttctttcatgttgcaagttgcaacttcagttcactctaagaagcgcgtgagaaatgctaatgggcacgtggaatgagattaattattgtaaaataagagattaatgaaactctcaaatgtcagctctgccccacatgatggagaccatttcactaagacggccccgccgtccacgtcagtccccaccctttacgcgccgtcagtctccgttatgttatgttttaacctaacgtccttcgcaacgcaggttactccattttatttttttgatctctagatagaatcgtaaaataaaaattgtaataagaaatcatttctttttatagaaactgagttatattattattagagtaaattatgcatattctcttttgatattttgaacgtaaacaacgttgaagaagaaaggtcatctgactagcacatgagttttattgaacatttttttaaatcaaaaatactatcatcgctttcatttaacatttgcaaacagaggatccttatttgcagaatacctcaagaacacaaaaaaaatactatgaatatcatatttgtgcgtacttaatttttgttttttgtcaggattttttagttgacatcaaataattacacatcaagaattttaaatcaagtcaggtctgaatccacgtattgcttcaaactacttcgcgaaaaagatgaggaacgcgtgaataatgcttctcccaccctcgttgaatcctatttcgaatcgcattgccaccactacgaaaccaaccacgcgtccgatcccctcatgaattggaacctcacgcacaaacaaccctaaacccaaaaacaccttctgaggttgtgaccaccaccgcaagttccttgcccttcttattcgacgccgcatctatgtctcccacagttcgagaccagatgttgatttgatgagtagaaagcagatttggcatggaggaggtggcgagcaccgacaatgagggtgggggaggcggttagatcagatgatggagtatccagccaaagaaggttgtggtctgagaaatgaacactccaaccctaatctctcaatgttgttgagaggaacaaatttggtttatgataaaattatatttaatttatttatttatttttaaataacttaacggaatcaggatgtcatttgagacaggggttaaaaataatgttctaaaacggaagaataatacatataataagcataaacctcagaagtgatcagtgtaattaatttgatcttattgctaaataaagattgacagcaatacaagacgaaaactcgaaatagaaagggtttgtttaattataaacaatctctaaagtttggtaaactttgcaacaacaaaccacagtgttgaacagtaacactaaattcagaaatagcataattaaccagatcattttgactctctcgttattcgaccttttaaaaatcactaataatcaaatacgtgaaaacattatgtttgtttaatatttagaaaaattaattaaaaagcactaattgcacattcttaaattttttagttacttacaaagaaatattgaattattttttgttttgaatataattaatattttaattttaataaaatatattaattttcttagtgtataaacttgatatatatataacagataaaaaactgttgacaaactttataaatgatagaagtgaaaattatttgaattttatttataacagaagtttaaagattatgtgatagcattctcaatttttcctgatatatcatattataaaatattcattttaagtagttgatggttatgaatttttaattaactgtgttataattattaaaactttctatttatagataattgttttctcattgtaattttttcatcatatgtttcattgaactatataataataataacattaatattaatatggcatttattaaattaaaattatacaattttaatatttctatattttaatttatttaaaatttattttttagcgtacacacatgagtgatatactgatactatcacatatttatgaaaaaagagtgataacatgacaggctagaatgaccagaggcggacactgacgattagggtgagcactgccctcctaaaattttattaatataaattttattgtatatatatatatatattaaaaattaaaaaatagtttaataaaaaaaattgtattacttaatataataagatataatatttttaatattatattaaaaaaataaaataaaatatttttaagattacattgcataatataatagaaatttttaatattatattacataataaaataaaatatttttaaaattgtatttaaaaataagttcgaacatttttaatattgaattaaaaaatatgatagaatatttttaagattgtattacataatataaaatatcttaatttaaaattacattgcataatatgataaaatatttttagaattacattcaaaaattggttaaattcatatgcttaaattaatataaatagaaacatatttttgtatttatagtatacattccattccaaataatgctagagttttagaaagtttaggtttgtatcattgagagaattgttatgagatcatatataaacgtttgacaagtctgattcttaactctccattaggatttaaagttatattattatagtagagttatctattggattgattatctaatttggacgttttaattttttattcaattgggtttttcaagttaaacctgattatgtcttttttatctattattttcatattgttgttttgaatttaattttaaattatgaattattttattaaaacacattagactttattaacttattcatcaatccaccctgtttacctttatgtagtttgcaatttgtctcttttatatattagatttttattgtcttcataatacttttatttatgatataacttttttatattcgaccccttttaataaaatttttacaaaatttttacttccgcaactgaaaatcacagtataaaatagctacaaatatattgtaggatttataccattatccatcttttcctacggacttttccttagcatgactatcgcaacaccaccagcatgtgtggaaagaaatgatttttaacaaggcatgtgtgccattaagtgagaagctccaagactcgatttgtttgtactaatctacctaacattaattttaaaataatgtcaatgtgtttcatgggaacaagatatatttgatttaaatacaattttgttttttttatgttttttaatttctattttttgttcttttattttaaataaagatatttgattcttttatttttaaaaattaataattatggtttaatcatttgcttacattttattttttatattttaatataattaaatttagacctaacatattcttttaaagtatcattaataaataaaatagttaattaaaatataagaaatatatagataaaattgatgattgaatcaaaattgtaaattttttaaaatagatgattaaatatttctatttttaaataaaaagaccaaaattacaatttaaataaaatagaaaaactaaaattgtatttgagcttaactctaaatggtatttttttgggtatgctaatttgattttagtgaaaaatatgaagttggtgacaccgtcaaatgagaacattttatttgtggaagcacacgttgtgtctaatgttttcctcattcacttgattattatcaggaccaattttgttgcttgttaacgaggggtgctgtctacggtgaagtttctgaaaaattctccaccggtgaggcaggttggtcaccggaaaaaaaaaaacattttttatttcaaaatgaaattatataaaatttataataaaaaaagcctcaaattacgggagagtctcatattttcctaattcttcttccccaacccaggaggccaggacgaaacttccatatctactggtgtttctcctctgtcattttaatagcttggtcaataacatttctactatgcaattttcttccttgccgggaacggagaagacgtccctgttgttgtcctcgacaaacatgattctttttcttcgcagatcgatccagtgccagtggtggtggtggtgccgttccaccggctactgtaggagagagagtttacgaaagagatagggtaaaaatccacctctcctctatttttctttttctcttcctctcatgaaaaaatccaccttgttatttgtacaatttccttttacttcccgaagatctcagcacttaaaatatgaaaaaataatcatcaacttcatcagtcgaagcttatctacaaatataaataatgaaaaagagataatgaacctccaggaaattggaaagtgaagtctgttcacaattcttgtttgctatcatcaaacaaattagtaggggcctctggaagtctagattttttctttgcgaggatcggagaagtatttgaaacggtgccgagttcatttctttttcatttttcagaaaaaatgaaaaaaaaaattacctattgatccagttaccattcttaaatcttaatcattaaatattttattaatatattctatggttatttttattgcttcgtgagtgtacctcaaaataaacaacttcatattagacttggccgttaacgagggttgaaaaggagattaatggctaaagtttggtaactgagaagaggaagaagaagaaaaaatacaaagataatgagttttaaggttgagaaggacaaaaatgtatcctatagcacgagatgcacatgaatcatttttcttcaaaacatctcaaaaactaaagtcaacaacctcaataattttgaagaggatggtaaagacttactctaatttgacgcagtttttctcaatgcaccacgctaaaaaaagatttggggacaagcaaaatcattgagcacgatggctgtcaggaaaggattatacggaatggtttgcgataaatggtttttcttttggacgaaaatcacatctaaatttagcagcgcagccaaatgacgccctaattgtcatggtgcacttctgcacaaccatccaaacatgtccttctgataggactgtagtaactaataactaagcctcattttcaggtattcaattttaaatcaatctaaaataaaaataaaaaattataaaaaaattgaaaatcaaatcaaaataatttttaaaatttttgaatattttgttctcacacatatctgtttgatttaatttataatttatgattttgaaattaaaccaaatcataacacttatattattatttatgttattttagtgttatgcactttatttatatatatatatatatttatatattggtgttgcttgcattatttttttcttctataaatgcaatgcaggatttattaatcgttcatcataaatatcatgcaactttctttcgaactttataaaatatttaaataaatcagtaaattacacaacatgatctatagtcaaatgaaattattaatatttttttatttctatcaatttgtttggtattgatcatctttttttgataattaaacgtttatcaaagaatgactaacaacttttttgggttttgtccaataccaaagaaatcgatagaatttatcagatcaaacaattttaatcatttgaatagagtaaattaagaaaaaaaagagagtaaatgatcatgtttatcctcaaaaagtgcaagtgttgttagtttagtcttgaaaattgaaactactaaaatgatcaataaaaaaagttcataaaattattatgctattattttattcctaaacttaattatttattattattttattttttaaaatttgttaatatcattgctttaattacacaattttttaagttttagactaaaaatgggtgtcaaattacacttgtaaagagatttttgtcattttattacttttaggaactaacttgacatgtctcatgtttccaataacaaaatttgtcatttaccctaaaattaattatatattgaatgaagatatcaaccattcaacatatacaattttttaatttaatagagtcggcctaatggtagagggattggaatacaaacacgaggacttaggttcaatactcgaggccaccaccgtaaaaaaaattaacatgtaatgcactgaagacatgttaattaaaaagtaaaataacacaaattattctttttggacaaggtttaaaaatagtttcattctcaataaagtgaatgattttttttatccctgtaaaaaaattatttttcatcttctaaaatatgaaatctttgtttttaattcctattaagtttattgtgatctatgtaaaataattttctttgacttttatctcttcaaaatttcatatcactgtttttgtcccccaactctcactctaaagtagataaatggcatttattttaggaatctgaatttttcttaaagtatcaaatattgacaaattaacacataaattagtaggtgccacctagaatggtcacccaacttttgttaaacacaaacattttacaagtgttacataatagtaaaaactaaaaataattaatttaactttttgaaggtctaaattaaaaaatatacaaaaaataaaactaaaattcacttatttgagaaaaactagaagcatatttaaatgtttgaataataacacagcccaaataataacatatataaccccttgtctttaaacgtacggttctctcgagtcctgagtaatatgaacttttcttttttagggtgaccaatatgaatttaactgaggtatgtttttacaaatttcgaaataattttaacttttctttataaattatggttcattatctttccgttcctaatttttttatttctatctttaatccataataatctaaatttaaagtagttaaagtctttaaatttttttttatattattgttgttatcaagtaacaaaattaagtgaaaaagtaacaacaaaaatattggtattgctgtaacttgtcacataattaataagttgatgagataattatgagtaatttaataaattttatttttaatttctcatcttttttaaaaatgcagctttaagaaaatcatgtgattattttatgagacttttttatgacatgacaagtgactgccaatgatattccttaaatgcaaagactaaaagtggtaaaaaataaaatgtttagggattttagttaatcaaaatttaaattaagtaatataaatatacattcgaaaaagtttagggagcaaaataataaaccctttaaattaacgttttaaagttctcattttaggcgcatcttgtgctttaattttatttacttttaataaaatcatcgttgtctataagaaaattaacattttaaatttaatcaagaacttgttttaatgaagtctacatcaatctatatctctgacaaatcacaccacctaatcatattttaaaatatattcaaataaaaaaaaaactaacatgacttttaatctgctgactgtatatatatgatgggtgaactggtatatttgatctgtgaaggaaaattaattaattaatctattgatggtgtttgacgttaatgccggcctttaacattttggacgagtggaaactgccgtccgtgcaagctttatagttatttaatgttattataaacagaaagaagatcacgctcatccatgatgtgagcttatctatctataaatataattgagtcaggtataatcattttttcactgtgagagagactcaactcaacagtggtaatcattcttaatttcaaaatcaaatcctggttacgatagttaaacaataataaaattatgatttatttaaaaataaatatatatatatatataattaaaaactaaaaactatcattttaaaaattactatttaaagtaatattttaaaaaacgtttaaagttaaaaaagtgagttcattttgatttgtctatttaacagacataggatttggttgggcaaccaaatttacagtctaaaaaaactgagttaatccttcctgatttcattctttgattcactaggtttaagccgaacaaaattcaatgtgccaactctaattaaagaattatgcaaagcatgcattatgtgaataacaaaatcaatgtgcatcttcgtttcataatataaaacgtttaaggtttttatgtaagtatgaatataatgaatttattaaattttaaagaaaatattagataattttttaatatattttttatttctctaattaaggattcattcattcttcctatgcactactcccattaagtatttattaaggatattttaggaaaaaaaatatttaacataacattggttttataaaatgacatattttaaaataaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttctctaaaacatcatatattctggaatagagggagtattaaaatattcatttatttctaaattatatgatgtttttaagattttgacacgtgaattaaagaatataattaatttattgaatttcaaataaaatattaagtaattttctaatatatcatttatctctttaatcaatatgtcatttactcttctatacattattcctactaagtattgattaaggatagttttggaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaatattaagtaattttctaatatatgatttatctctttaattgctatgtcatttactcttctatacattattcctactaagtattgattaaggatagttttggaaaaaatatttaatgtggccttgattttgtaaaacatattttgaaatatttttttctctctaaaacgttatataatttgaaacgaaagaagtattttcaattcaattttctttattggttcaccaaaaaatcttttattgatttaggtgatgcaaataacctctatgcaataatttggttggatatttttcgggtaactgtcgtagttagattccttgatttttcagtgggaccttgaagtattcgtaaagttttgatctttaaattaattataaaattaatcattttgtttgaatttagttatatttaaaattcattatctttctctaagaatgtatgatgtgaaaatcaaattcaatattttcttataaactcataatgtattatcaattgatttacaccaacaaatgttggacataaagaagttgaaagagaatggaaaacaaatcaaattaagctacttctcttgtgtgaataataataataataaaaaaaataaaagtggtccaacattttctcaatctctccattttggaaagaaagttggtcaaagatgataaaaatattaaattaaccttatgcttacatatctattttttttattaaggatatttacatgattttatatacaaatttttctttatttctactttctacataacaaatcaagagatgtaaaattttgaactttatttcttttcattctgacttctaccaaccaacctaaaaatcatctcattatttactattttttttttcttttctttcacctttcatttttttataccagacaaagcatacaagtgggtgttaattatagctaggcatataaaaaggagaagggtggcctagatcatagatgggtcatgggtgattcatcgttctcagcacgagcgaactagcaaagcatgcatcactatcaatcctcatttataggaggaaaatgacgagcattgtttggactcgtctaatatactttgcagagttaaaaacaaaattccgtactcagggagcacatcaaagtaaacatttggaataaataagtttttagaataccatgtaattaaaaaccaatattatgctagttgaattaatttgacaacaatatttgtataatttcacggtcaaatagaaaaaataacattatatattttggcaatttcagtttggttagtatacaaggtatatacatcattcatatgatatggatgttctcgtattaatatctagtaatgacattttctgagaaaaaaaaacaattaataagtttcatcattatttatataggacttgttaatttcaatttttaaaattttcctctcatatggcattatcatgttagacatttacacgaggatcttgatcttaatacataagggtcacacaagtatatgttacattactgtaaaaacaaaaaaatactgtaaaaaaaatacatatataagaatttgtccagcccattcaagagaaattgaggttttagataaaataataatagtattttttaatatgataaaaaattaaactcaaatattatttaaataatttaattttaacttgaaaatattaattatatttgtatccaatcacttaattatagtatcaacatttttttatttataaatacttctaacatcatataactgattgtctgattttcaagagagagaaaaaaaaaacatgtttttgctttgatgatggatagactgcattattcagccaaaaataaaataaaaatggatggactgcatttattttcacaagacgttttatggtaccctcttccctctatatactagtagatggatgggttcaaattaatacagattttaattaattatgcaaaatttccaacacgtcaatttcttaataatgttttcatatcatcgaatcaattgagcacttcattgaatatattaaatggttcttgtctgcgggtggcaatgtgcaatcgtcctgataggagaaagaagaccaatcccaaagatagactatactgcacttcttttctttgattttcttagaagagaaaataaagagtcatagtcgatcattcaagacctaattagtagtacatattgaagaatatttaatatttaaagctgatgtgaacatataacagaacatctaataaatataaaataatatagttaaattaaaatattcttatttaattctagtattttttttgtaattaaatattattgtagttattaaatagagctacagataaaaagtaattaatgtaaaacatcaacgataattttgattttttttttaaaaacaatgaatatgaaatgaaggtagtatatatgagaaaaatttaaaaagatctaattggattggttgagcaagatctaattcgattggttgagcatcatttattataaacccttcacttcacattaagcaaatgaaagcaaattacaatcaacggatcaagtttgttagttttataatttttcaactcaaacatattagacttatcgtaacgtataatctatcaaataggatttggtgtatttctttgtacttcttttctggtttgagacactcctttgttaaaaaccagttttttttttagtaatattcagttttgtctttaaaaataaaaaaaaactcaaaacttgccagacataaattgggtttgtctttctggaaagctaaaaattgaataaaaattgatcaaaactttttttttttttttttaaatttccgagtcaaattaattgagatccgcttaactatttttcaatcactgcatcaacggcgtcagagcttaacgttataacatctcgatgtttaattcaatggccctcacatatcataccagtatcttgcaggtggaagtagaattgtttcgatgttactagtactagctaataaggaacagaaaagtttcactttctaaaaggaaagtgaaaaatatttatgtacctaataaagtaacttagcattgaaattcaatcattttcttatgaaatttacttaggctttccaagaaagtcgaaaagttaatgcacttataataacccttgactttatcaactttcattatttactaggttttttcttctctggataaaaccaaactgtagttaataatagttaatgacccaatctacagagtaaccataaatgaacaatttcgttgaaaacaattgtatccagataagaaaataaagagtcccatgaaattaaaatttctgtccaatatctcacaattagtaaaagaacctggattagaaatcactaggttttgtttaattatgaacgtcggacaagagagtaatatgactctttcctgttagtcaattatttagctatatatgttaataacaagaggtacctaatgcaaatgtacttttctctaaaaattgtttgatcattcttattttctagtaagattttttatatcatgctctagctgaatatatttgaaacagaatggagaaatccacctttgtttcaaccatcatatcaaagtttttccccaaacatcttataacaaacattttcatgtgctatatttattttacacattgtctcatctgatcattgttgggccgaaagctacccacgacccaattgatagagtttcaactaatccaatccacaaatgatatgtatcatgatttcgtacttacttggtcctatatcccaaaaatttgaaggatacactctaataatatcttatctttggagaccacaaagatatataagatatgattaaattagatcaccacctaaaagactagtatataattcaagttggatctagagataagggtagattacatactttagataaacaacctcaaactccggaagaagccctatatcaaaaacataaatattttctatctttccaaactaattttgactaaattaaaagataaacacctattaactactgtccaattacaacaatattttgtgtgtgtgtgacaaaaatattttaattttaataccatccaaatataatgaacattagtggacagttatttttgaccactctacttaaaaataataactatcttatatatagagaatcttaatgtttaaagttagagtatctcgaacctaataatcgaattccaggcatattatgcaagcaaaactttgtaaaagatacttaaaatacatatggaaggaaaatatgaggaaaaatcagaaagacaatataacatgtaggaccatttaatgttcagaggcatatataattgtacctttcaaagattcttccgatatttcgtttagggtccaagagttggttggattcatgcatttgcactgagggaggggggaagagaaccatacattggtatctaattggggccacaagatagcgagatttaaccccctgccatgtgcatcatggtccatcttagtaatctagcttggttcctgcaccttagtgtgtagcttcccaccaatcccatctcagaggctcagaaagtgaaaactcatttgaaccttaggggagtgtttgttgtgaattgcttttggggtcccgggtttcaatttagatgcacatgaaatgaaatcataaaataaaaaaaataaatgcctttaagagggcatgccatgttttactttcacccttggactaaaccaaagtgggatcaactgctactttgcttcaccaatcccaaccctgcccatatgatcatgtgcatgtgatgtttggttttccacaatccgtggcccgtccttgactactaatgaaagtgattttttcacttctccttctggtgctgatgtctgccttttagttttaatcacgcagcctcatcaactcatgtctttgatggaggggatattcttgaataagcacggttatagctagggatcagttgatatggggactttttagtatatatgacaccaacacaagattgcccatgtctagtgtgtgactatggtaggtggctagtgtttacttgaaattttctctagattaagtgctgaaatttgagaatagattcatttatatatatataagcaccaagagaatgtatgtttctttgcttatgattattctttattaaaaatttgtttaatcatttttagtagattttttttattttaattatattttttaatttataagatttgagttgaaattttatttaaaagatttgaatctaatttcattaggatcaataacatattgataaagaaagtatgtgcatttaacttacactgcaacaaaatttattttgaaacaattatattgtgatataaactaatggttggtacttagaaaaaaactatggcttgtaaaatattattagattataatttgtggtaaataagcattagtatgtaaaaatttaatttatagcattaataggcaaaagttaataaaatggttttttttttttacaataaaatgattatttacgtgcactcactaaaattttcagtaatccttttatcatcctgaatacactaaccataatctaattgttaacaaatgttttagtagttatttaaattgtcactaaaaggcataataattatcacaaaaaataacgtttgttatagttgtcttgtactatagaattttataaaagcaagtagccataatctagcataagtaacaaaagagattttttgaataatctagcataagtaacaaaagagatcgtgaatcattgattattgtattgcatatttttttaacaggcattcgatttattttttcttgtcgacgtagttgcggaatttggagcattgcatcaatgtattgtatgtaagaaatatgaaggaaaaaaaaagtaaatttaaaattatattacaaaatattatattttgttgataataaaatataaaattaatttcataatattatttccactacaattaaaatgagcttcaatttagtcaccatataatgaaatttagacgaattttaataagttaaaatacatataaattgtacaaacagacacctaagagagtaaataagaaataaacaagttagtgactcaacaaaatatattcctctcaatttattttatgttcaaagataaacatgactcaaactctagattatttagtcaaggaacacaatttttgtctattattatgaaaagtctatctaaatgtcataatagtgcttacttgttttgtgaagaacgttttgattttgcattttcaaactctcctcaaattggatggtggggaatctcacccctagtagcaagtagtgtatggataggtttgaagactgtccccacatcttgcattcgacccgtacgaaactacgaatttgaggctaatcccttctgcttcagcttccacttaactcttaaagaaataatattatgtttattattgttactaacaaagttatgagcttaaaatctattcacccacaatgtaaaaaaaaccttgcatactcaattaatcataatttcataaatgatgttaggcatttaagttaattatggtaaacgtcaagaagttagttatttaattattttttccctgtttaatgtttgttttgaaattcttcaaatttatgagattggttagttaatcataataacgcaaattaattgtataaatttattttaaaatattcataagtattttaagaaaagccagaacaaatgcaatattttaagaaaaaaaaaattctgagaaaaatgctagttttggttcctgacattctttcccaaacctaaatgtaattatcactaatcactatctatcggttgagaatgattcctcgttggtcattaatcaagtttcaagtgtctttcactctttcttgatataaattaggttgctttgcttggattttttaggtttggacattttttacgattacaacatatctgtcgacttcttattgttaattgtgtgggctaatgtaattgtaggctttgattatgggtgtatttttctttttggttggtacggttagttttgatatacttatatgagctcagtatatatttattgtgtgaacttataggtctataagactataactttatttatgttctgtgaagtatttttttaaaatgtaaatattgttgaactcacaaattaaataaaatttatatctacatagctactcctcgtctgcattttagtcttccagcctgtaccaaaaaaaggtcactgtacaaataaaaaaaatagtcatccagcatttttggtagccataagatatgagatagagtatctaaaaagaaagatacgagatagagagcgctttgggcttggacaaaggcttttcataaacatggagaagcccatgctgtctactgatccatattctgacccaaagtgtatttattcaaaagatccttttgaaattgacattagacatttttaatttattttttttgtgtaaaaaattataaaatatcatattttttaaattttattccccaaagtaatgacttaagagaaatttttgtctgatgtgagaatacaagctgaaagaaagatcattaacgtgttaaacgtacaacatctagctgttcattttcaaccgttcaatatattatgaactagttctcaaactgattggtatgcttgaaataaattcaacttagtttctgagttaaaaaacaaagnnnnnnnnnnnnnnnnnnnnnnnnnnnnnnnnnnnnnnnnnnnnnnnnnnnnnnnnnnnnnnnnnnnnnnnnnnnnnnnttatttttaatattatattaatataaaaattttataataattagactatacacatagtacattgacttgatttagaaaaaaaaattattattttgtttcatgatttagtttacttaaaaaaatttattccttaaatttaatgttttctccgtcgctagtaagatataattgactaatttacatttattgaaaaattagttaagttaataattaatattgaatttataatatttttctaattttattcttaattttattggaaatctattcatcttgtttaattttcatgagagagaaaaagataatttaggatattttaataaaaaaattaaagtatgcgagaaatgaaattaagtcttataacaaaaaaacaaaatatttatcgattatctcttggaaacaaggatgcagggagtaaatttaatatcaattgagttcaaatgaaaaaaatatatttgaaagaatgttatatttatttttctaatattaaaaaatattttagtttttacgaaattatgtaatagatgataaacttgagaaataatttagtgatttagtatttaagtataagaaaaataatttaaaaatactgtcaaagagaaaaagttgcagttatataagtgtaaatgggaaatgtttgcctgctacttttaaaaaccagcgagagatttgtaaaaggaaaaaaaaaaaaaaaagcgagaaatacaaattggaaaaagcgaatacgttgtaaaaaaacaaaaaacagagaaattgttaccatttgtgatttgagnaaaaaaaaaaaaaagaagcgagaaatacaaattagaaaaagcgaatacgttgtaaaaaaacaaaaaacatagaaattgttaccctttgtgatttgtgagtttcctacgtagtgttctcattcgttgttggtcgtgctcgtcctctttctgtcgccattctcgtcgatccgaagcgcaaaacaacctcaatccctacgaatttcgtgtctcgaactcgatcactaatatcaaggtaacaatcaccgattccaaaatctattgttctgttcgatttgcatgttaatcttcgtaatgattttgatgcttagattctcttcgtggaagcctatggctttttcttttgttttggttgttgcacttgcacgctcatagggatagctatgctggttgtaaagtcttgttctttattcatgtacttttgtggggttggtctaattacggcttgtaattattcaattctcattcctatacattcatatttggcttttccaaaaaaaaaaaaatgaaaatgcatgctttctgggttgaaataagtgcgtttggtttagaacactctgctgcagatgatccacggctggacgcccagttatgatctccaaaagtaggaccccaaatgaaaaaaaacataatttttctcccctacaattccatgcatgaaatgaaatattcaggagcacaatagctgcaaatcaagtaattaggtgaatatattaaatcacgagaacctactaaactctagcattagtaattttttatttgcgtacccaaatgtgccttcaaattttgatacattatggtgagtctattgttctggtaaccacttcgcaagcccaaaatcacatatctggataaaatctcaatcaattaataagggagtgatatatcagaaagattgcgtcaaacaacagggagtacaacagagccttaagagacatggccttctactaatctaatttacaagccgaacatgaattagcatcatttagccattagcacaaaacatgacatgaaagctcagttcatgtattatctcttggcaaaagttgaaattttctcagaggataagaataatattagaaaatagtattctattgcttaattaatgatgatatggcatatatatatacacacacacacacacatgaggagctcattacagcaatagaagttaagtttggcaatagaagttaagtttagcttagcttagaatattggaacatatcaattgataacagcataataatataaaattgttacacctgaaactaatgatgaagttaatgctcctacacacccacaaaaattcagaatacattcatggagcctaagtttcatgtatcaaagtaataaattcaaaattctccatgacctgaatattctctgccttaatatctctatgaaggattcgcctgtgacaacactcatgcagatagaggagaccatcagctattcccagcgcaattttataccttttactccattctaatttgtttttatttgaacctggaatacacaccatgaaagaataaacagtaaatactaaatacattaacatcaagttttctcatacaaggaatctgcaatgcaaactaaagtacaaaccatgaagaagagatcctagacttccgagtgtatatagttcaaagactagttgcatttctccttctggcttctacacaacatccaactagcctggcagtattaggatggtcaacatgagcaattacacctagctcacatagaaagcctgcggttttttcatctgtggtccctttagtcaattttttcacagctattaattgcccatcttggagacaccccttgtaaacctcagccagaccacctcttccaattatattttcaacatgtaaaaggaacgatgaaaatcaacctagtcaaactgatcccctctaagagtaaaaaagagcattagaatcaaaatgtgacatagttagggtgagatttcagaccattgctaaaattgttggttgcatttctgagttcagagaggctgaaagtaatccaagaagacctgaagttgtattgcttatttagaacttggttttctcttctgcttttgcttttccactttggtatgttgggcatactaggaggagagagagtgtgccctcgtgcttgtacaagtggtttctgattcaggtgattggtcgtgagagttaaagtctttcatgcagacttccaagactcctcttggtgatgctatatcttctttctctttctccaattccaaatgcctcaagtctagggttgaaataagtaggatgtgttgcattttgaggtgtatttttgtgttcctattttctatcacaaatattttaggggttgaaaccttttctgttttatttttttacttgattcctttgtgtatctttccccccttccccttgtactcctttagacttttgattataaagattaattttttaatttttggtaatcttttacttttaaaaaaaatgcataatagaataccatctaaatctaatttggtcagaagaggcattattatagatgaagaagggggttggtgtgggatgtagaagtatgacataatgatatgaatatgcattttcagcagtttcaggggcgtaaaggactggtataaaagtggaggaatggaatgttatttggtttgctgtgttaagggaaatttggatcaatagaaaccatatgttgttcaggcagaaattgattaatatacaagacatagttgagaatgttaaaattcattcttggagatggttgagggcaaggaggaaaggttttacttattctttgacatcatggatatcaaatcctagacagtgtcttggagaaagttcaataatttttgaataatgatgcagaattttggaggttgaaaatcacttgtataaggttggctggtggacattggaattagcagttgctgaataatgaatttcatgtgagatggcatgggatagttatggtgagggaccaaactgggtgaatgagttggtggatattattatgttcaagtttggagacttatggaaatggtcaaagtcatgaaataattctcagatatcagttggggatatggatcgaacgcatggtgggcacttggttctggatctgctatgtacataatttagatgtagatggtccaattttaaacagatacaggcagttaaaacaataaaagggaatgctttcagatgtgttgcaggaaaagaataaagattgatcctgttatgatcagaatcgtgatgcgcttttggtcctttggttgcttcaaattatgcaggtttaaagattggtaatatgctgcagcatgaagtgggcagagaaatatagttggtatctaaagtttttttctattcatctatgttggattatactctgggtgttagctagaggtattttgaactatgatgtatagtgtttctgtctttgttttgggcactacttgtgctaaaactgagtgttttttaatattatattcatcaatgtggaatcaagcatgtgaaaaattacctaaaattgcatttaagtgatatttcaacgtaaatctagagaaatgtgaaaccaaaaatgcactaagtctgatgaaaacactttcaaaggttttatatgaaaaaatattagttatttgacttgatcctgactgacccaaaaaaggaaatttgtttttgcagctggaagagatgaattggatacagcgcaagatctacctttacaatgtgacttttgggctgtatatgttggactggtgggagcgctgtaccttcagtatcctttattgcactctatagtctattctaaatggattttaactcctttatgtgttttttcctttgtaattctcttggaatgcaaaattttgatcatttcgagatatttatgtggggggtttctttaaaaaggttcatcaattgatggaaatttgtttgtcacatacgtataagttagtctgtccaatagtggttttggggtcctttggttagaaagacaacttaaactatgttagagaattatgaaaatgaagttaaggaatttcttaaattcatatgctgtcttgtctgttgtggtactgcttgttggagttcctaaatttttgcagatattgtggtgattgtattaatgtgtttcgttctacgttatgttactcagttcttcaagaggtagtgcatctcctccatctttttaattagtgacataaattgaatccgtccaagtcttaacatgcaggtagtttactggattataaaaaacaaaaaaaaaaaactacataccttattgtccagatgctcctcgctatatgaaagtaaaggggagagatattgtatgcagccttatccttacatatgaaaagagacatatttccaaatttgaacccatgatcaccaagtcaccaaaacacaactttaacgctatgtcaagactcgccctcagtttactggattataatgatatataattatttgtggttattaagtctgctagtttttattgcacttattcttgttaattagtaatgcatatcactgcagtctgcaaagaatatttaacatgcatgtagtaaaaagcacactctgacatttctccaatctccacctatgcaaactcttaaccaaatactttttacgtcattaatctcctacatttgtcgctataaagggctattagactatatacaaattttagaaaactcagatctatatgtaacatatttacggacttctacaatgatctgaagataaccattggtcaaaactcaaagttgagactttttcaccaattatttatttcactgcagtcaatgtaaattagagatcgaagccaaaataagcagagtaacatactattcttggggggattatatatttaatccaattgatgtaaatcctttgtagtgcagcaatataccattctgagagccctttatatcttagcatccgatttagctcccattcccaattctgaatgtgcaaataaatgtagaattgtagattctttgtacacaatacttccacagcctttgaataaaaaataatagtgttcaaaatcttcatttaatctattgttgcagccacttatattgcaatttttgcactagatcagcttggaaatgcgaccaaatttattatcctgcaattgcaaaaaaaatatctgtgcatgttgcaattgaaattactgtatcaatttgaccttttcttcctgtctaaactttttatgttttaaatttcaggtatgtttggtaagaagcaaaaccattgtcacgggaagaagcaaatgtagattgttacttgggggattatattacttgctgccggtgtatttggtatagatgactagggaatatcttgatatagcctgacttggaatttctttaagctacccagaaattgcccttttgatgccaaatatacacaccgacatgaatcttatttgaacatcttttcttataagcttgtataggatgccaattagcattctttacattgtgataatttttgggaatgttcaaatactaagcgttttttgacttttgaatagtggaaagtgtgagctcctccgaatgccatcaaaggtttcttcataaaaaggggaagtgtaattaaaataaaaatcacatttcgagatggaatgactaaagctagttactccctccctccctctgtcgtcttaaattattttatacgaaaaaataataaatagataaaaaaagtattaatttttaaaattaattttatattatcattaatttatttataaattttgttgttcattattaatattattaaagatataagggaaaataaataatcaatgatttcattgaaaaatgaaaatagtaattattttgagataattgtttttacacaataattataatgggatggagggagtgcaatttttgtcatttttttctaaattgaagagcatagtatgaaaattttagatgggaattggataaatttttgtattcaatttttaaatatcatctaaattgtcattgatgaatgtacatgtgcggacatggtatttcgagcatattatctaaatgtgggtacataggaagagatgagtgtaatcgtttaccaggttctccaaatagagtgcatgctttcttatcatgcttgatttgggttgccatgtttaatagactagcttcaatgtggattcttaatctttatgtattagataatttatttttagtcattttttctttatctttctcctctcttttttttcccttctttgcttttatcattttttttctttttaacctccttatatctattattggattcatctatcactgatcccaattaattttagattaaagatgttattgatattaatgtcattttagtgtacttgtactctccacaatcgctatttatctttacctttttgttcaatgaaaaaaattgacgcttcatagttcacatgcatacaacttggttttagactattaagttattctaacaagttgttgaataagatgtgtgagttgtttaatttttttttttttatatttatctttaattcttatggatcaaaaagttggtttgatgttgttttgatgcttggcattaaactggagtttgttattgtcgtacttgtccgatcttcatttttaatcatatcatattttattttaaaaaatactgataaaaaataataaagaaatttcctcagactttttaacttctatctttcaaggatgaccaaattgtacctaaaattttaactcagttgacgattattaagtgattgtctcggcggttactcatgaatattcaaatgatgcttttaagtttctaaccaagatgtttgtttatcctttaaatttaattgttttttttttttgtcattttttctgtaaataaaaaagacaaagcaagcaattaaaggataaacaaaatgcttgtttctgttttgctaaacaccaacttcgtcaattaaaactcaccaccaatggactaggcactcaaaattaagaagagtaatcctatttacaaattgttcggataaaatcttccaaagacctgattgagacgaaagattcctcactttagaatttagagcagtcaacaagagtaatatcaagtgaagatgtgcatatcatgcattcccaagtcgtagcagcatttttgaagttgattgtgccataactgatgtcataataatattcgtgattatacccaatcaatagtggataagatgatttgaagtaatcactaatctcccgccacaacttaaacacgttttcgttgatgaagtatataacaaaaatatgattataataaaaatgtgattttattatatattttgttcaacaaaaatgagtttttgttatattattacgaaaaaatataattaattttatatattatacttttgtaaagtgattaaattaatagtgatataatttttttaaaaattaaaataaaaataattaagatacaatttaccttttttaacaatagtcagtatatcatatagattatttacaaaagtaattgagttactttattaatagtaatcaaattattatgatacaaatttgtttatatcataattaatttaattacaattaaaacatataaattgtgttatcattaatttaaattttaattgaaaatataatttatatcacaaataattttattactattaaaaaaagtaatgtgtgtcatcattaagataatttgtatgtaagtaatttaattattgtaaaaaaggtaacttatattataattaaataattaaaaataaaatatatatgatgaatgatgattttattatgtatataagcctagatacataaaggaatcattgtgcatctatttaaatacaaaatggaattatgattctatttgaatctaaaagttaaagaagaaaagaaagagagaaaagtgtggaggtgaaagagaataaaatagggaaagcatagtgctgggaagtgaggggtgaggaaaataaaggaggttaagagtgtctttttggatgtttctgaaaaagaaaggaggtgaaaaatgcaagaaaatagaagtgagaacagaataacagctctccttaatgaataattttaagattgagtattggacatatatacttgtattaaatactcattatcttcaaagtaaaatagaaaaatacatttaaatgttctgttcttggattgtctagcaaatattaccttcaaaataaaactacaggtggtataattattattcaatgtttcacactagtttaatgttttccattaagaaaaatatttaaatcttaaaatcttactgtttaaaaataatcataggcaaggtcgcaaaggtctaaacaagtaaaaattaacatactacaatcagtctaggaatgaaatttgggtaatataggcaagttcctaaattcaaaccttgtttgtgccattgtgaaaaaaaaaatacaaagtaaaaaaatgtggttaatttcgtattttcattagtgagtatttggtacattatatgattattttaaaatgaagataaaatataaaaaagaaagtgttgtataacgtaaaagtgttttacactgtattactattaaactcataaaaatatgaattaaaagataaaaaaaaaaaataatttctacagtgagttatgctgacaaaatataaatatttgaaaaaatatactaaacaaaataaaagaagaataaatgagaatattttaatcatattataatattttattttaattaaaaatatcttcgtgtgtgtattaaccttaaaaatcaataactttataatatattataggtttaactgttcataaaaaagcattttaaaatgcactgttcattccttaaaaaaaaacatacggttcatattgaataaattataaaaataagttttataacatactattaaatgatatctttttaacttgtgtaaaagtatttatttttttgtttcgacctttttcctattttttcagacattttgataaaaacttctttatatatcactaacttttaactagttaaaatcatgatacactttattaaaattaaaattaaaatcaatgatgaatgcagagttcttggtttacataaccaaataggtatggataaaactaagacaatggaatcaaacatgtgctgattaagctagcataatggtgtcaaacacgtgctacaacgtgcggaatgcagaaatagtatatttacatacatttcatcaaagaactaaatatatcatccaatgctttacagaggaagttttctgtgatgtctaaccgaaaatgatattttgggaaaactagcatctacatgataatatgatctcataaaactattaacattatattaaagaaacatgcaaattataggaagtcagtgaccatctttcgagaagctataactagcatgtaaatctttcaactaggggttatataatctgcaacgagggttgtcatgtcatgtgggacataaaaatcaccacaaaaaagtataagaaaaatataccacccactacacatgttctcatcatcagcataaacaacctacgaccttcacacctgggtcaatgttgttgttgttgttgtaccagactcttcttgtaaatctctaagtttgaagtagccacagcagacaaactataaatctcagtagatcgaaactcatcacaatctgtggagccattcttggtgaaaaaagcaatcagagtattcatcatcctactcacagctgactcaaattctttctgggcgttagccgtagaactattgccactacttggagctagattatgtacaaccgagccgaccggaaccccctccacgtatgatttacaagctctcagtatttcaaatgctcgggtacggaaatgtcccgcaaccaactcctcgaagtgctgcatatgaaagaaatgttacacaagattgtgatttagacagttcttcagttaaggctccacacacatcaggtttaggtgtgtttatatgaccagaaaaccatataacctagatccaatagttaagctcacaatatcagctatctatctatatattcatgaaaataacagagtaacatataaatgacctatgctacacagcgttggaataatagttggagagtgacaattcacaagtacttggcgtttcctgttaattcatcaaagtagcaaactcctaacatcctagaagtctcaaatcaaataataattagtaaaacggatttcatattaattctttttttttttttacttaatagagaaagggtcagttatctgttacagttataaatatgaagaattgaaatttattcttgataatttcttaaaaaatttataccataggcaaaagtcacagcaagtgatcatccaacacaattgaaccttcacaaattcttggtcaaaataaatattccattttctcaatcattatataaaagatgagtcctgcatgaatctcctgaataatacatcaggagaaacctaaagtacaactgactacatctggttaaaattagaaatcagtcaatattgcccaaaaagctaatacacaaaagataacccgatagatcaaaattatatcaatgtataagaccgaaggctggtaaatataaatcagtcagttaaaccataacataaattttttctattgctaagcataactgttcctggagatcatatgtatgcattttcactatgttgatattctgcacactttctttcctagtcctattttaactttttcttttttattttattttttaatagaaagataaatttatggtttgtgtttcttacagttcgcctttaaaagaataattataaattttgtttttcattaatagtttttatttgatttttaaaagttttgtaagtttttcacataaaacacacatacctgtatcataatttttttaaaagggacatcctgtatcattccagtgttgtatccaatatccacatcagtgcttctttgctctatacaactatgtacaaggttaagagaaagatcatagaagtatgtttctagagaaagctttgcataactttaatcactgcaattatttgaatttcttttgaaggcaggtaaaatggaggtaatcctactgatcacatgcagctacgttgtttaacaataaaagttatctgagctcatgattcaggagtgcagttgactcaatatcaggatgcattattcagctcctaatatctgtagcctgtttagtgacttcataatcctcttctcgtctattgatttttaatatctagtcaaagtttaatattataaaataataatatatattatatgatatgacatctaaaatcttgaaacagatatttagttgtactggtgcaatttattgagtagacacagtatcataaaaaaggcagccaaatccatctatcaccatgtatgaaattcagctcagaatcacaacaattactggaaatataagtgaccatttggtttgaaataatgttttctattatcattttctgatttcacttttaattaccaaaataccatcttgtttttactttgtatgctgcttttatatgtttgtactttgtatatgaaacagtaaatacaactttttattgttttgtttacactatttcttacacatacaaactttgaaaacagttaacaagatgaaaacaaggtggtatttttagtaattaaaaatgaaaatagaaaatcaaaacagaaaacatttttgtcaaatcaaacagccactaagatatcaaaagtatcaacgaaaagagtatacccaaagattacagaatcatgcattattctagtctacatacctttgggggtttccgcagagtatacatcattgtcttcaaggataaaataaatgtactctcattgtactccttagatcttctttgcccctcagaaccaggatatgttgatggatacccgggctcattaaaaaaaggcttctcatttagaattagagcttgtattgaaaccaacacttgtagcatggttgatttttctggaatccagttttcgctatttctaccatgccaagtgcccaaaagactaaggcagacttttccacattgatataaatttggatttagcctcaggccacctgagtggtagtgaactttctgccaaagatagtacaagttaatattatacacacagcacaagacacaacttaaaacacgtgaaacatggatgatgcataccggtggacctgcagggtaggtagaaggaaagaggcaatcaaaaaagaaaagaccatcatggtatggggtgccttgaggtccaatgataacagcccttagaagctccatccttgattcacaaactcttacaaagattgtctctgtaaaagtaagtccatgtgcaatggttgaaaatgaaagcaaattttcataaagtttgagagtttcaccacaatgataaaaggttggatggtaaaaagaagttggacaatgattttccattctcccaaaaacgattttaaagatggcaattgttattagaaaactggattaaaaaaaatgcaacagagagacacttcaaataatacatctctaggaaaggccacaacaacaacaaatatcatcttgtagataaaggataatgaatatcttttctagagagagaaagactttacctggcagattttcctttaaaatttcccattcctcctggacctttttggcccaatttttaggcttctgtaacatttaaaaaaagccagattctattcaatcagtagcttaaaatttaaaaatacatgttggcaaaatgcaaactattagccaaaaacagtttcccaatatttatcacctgtgcatctttagttccctctttatcatagtgatgatcaggaaaagagtcaacagtatcaaattgcttaaattgttgaaacttttgcatgatgatatcttcagtttcatccactttttccttggaactagattctgtactggaaaaagcaatagcctgcttgcattcactagaagaaatgtccttcaaccaaggcagtgatgcctccaccccaggaggcaaatccacattgtcaaattggtcctgcatacttgaataatcatcttcatagatatcatcatcattgtaataaaaagcataatcagcatcttcatctccgtcatcgtcaatcatatctgcatcatcatcaatcataccctcatcattatgacatgaaatatcagaattgtaaccatttagattgtttgaattcagtgttccataggtagaactcttgcagagatcaccactcccagatgactctcccacactcacagaatttccatgatcattgatcaaagtatcctgcaaaagaagataaaccaaaaaatgaaaaataaacacatagtgctaaaggtcatgctaagcacgtgggttcatccccaatctaaacaaaaaattaaatagttttccactgccaccaagtgcaactttttcattatactccccccctctccccctgcaatgcacacaacccatattttcccccaagaaattgttctttctttcaacctcaattatgtaaaaaatacgataatacgtaggattgacacaggaagtgactttactgcaatgtgcagattagtaagtccagcagtaagcccccatgtcaacagatttttgactttccaactaagcttgggtgattttagaacactctattactaaactgttggcatgatgtatcatgaacacgaagaacataccaaccacatcacatcactgttcagaagtaatgagattcagctacaggtattggtaggctatgaagtcaactctgatagggacttgggtactatggggtgcctaagtctcacatcgggtagtataggatgcacagtgaagtacttaagtgcctagtttttaagggagggttctctaagtacttgggtgcatatcaaaatcattaatttttaaggggtaggggtaggggaaaaagacaatcccttatccatgaatttaacatgtaccaactacttattctgtatgggatcatacctagaatttgcaggccatgtaactgtcactcaaaacaaacgtccagtttcattttattttttttacagcaacaatagaaatttaataaaagcttagaagatatttccatactcccaaatcaaatgcactgacaaacacaaacacgttttcaagtctgtcttttggctattttctaaggtgatgagttcttaaaaaaacgagcaagttttatggcattttaggcattgttcccacccacattagtaagtatcgctgtaaaattattgttgagatagttaattcagttagttagttagtaactgttttagctttatatggcttatatgaaactctataaaagtgtgcttgtatttttctgcaagagagtaatgcagtgagtgaatgaataagtttttcctcagtccacaaaacctctgctctgttatactctgttctaacaactggtatccagagccttatgttcttggtagagaaagagtgagatttccactgtgtgtgaggagtgggtgagcaatgctgtgtgagaagtttacggagtgaaagcagagagtgaattctgctgtgagaagagagtgagttgttgaagatggccacctccaaaaatggtggttttccagcaacgttacccattcttgatggaaagaattgggataagtggagcaatcaaatggaagccattcttggttttcaagatgttcttgaagtgattacagaaggcatcgaaaagatcactacagcaaaggtggatgaagctcatgccaaagaaatcaagaagaagaactacaaagcactgttcattctccatcaatgtgttgatgcgggtcattatgaaaagatttctggagtcaagagtgcaaagcaagcatgggacattcttcaacaggccaatgctggtgctgagaagatcaagaaagtcaggttgcagaccttgaagagacaatatgagctactggaaatggaagaaacagaaagtgttggaacctatatcaatcaggtccaaactcttgccaatcaaatgaagagctgtggcaagaaagtctcagatcgatcaatcgtcgaaaagattttgagaacattacccacaaaatttgatgtaattgttgtgtcaattgaggagacccgggatcttgaccaaatgaagcttgaagaattacaaggctcccttgaagcattcgaaatgagatgtgctggaagaaaagaaaaaccaggtgaacaagctctgcaagcccaatccagttggagaaaggaaggagataattcaaaaattaaaagaggaaaaagcagatggagaggtggtagcagcagagggagaggccagtcaaattggaacaatcagaatttcaattctggcaggcctgcatttgatcagaaatcatatgacatcaagcaaaggagaggaggttcgtgtggtctaagaggaagaggtgaaaggaagagaatggacaagagtggcattcaatgccacaattgtcaaaaatggggccattttgcagatgaatgttggcacaatgacaagaagcattcaagaaataatgaagcccaacttgtagaagaagagcaagatgattcaaatcaagtcatgcttgtggcaaccactgaagaaagagaatccaatactgatttctggtatttggatactgactgttccacccatatgacagggagaagagattggtttgtgaatctggattcaactgtaaagagcaaggtcaagtttgctgataatagcacactcacagctgaaggtgttggtaaagttttgatcaagagaaaagatggcaagcactccttcatctctgatgttcttttggtaccaggtattaaaagtaatttgcttagtcttgggcaattacttgagaagggttatgtgatgttcatggaaaacaaaaagctgaaagtgtttgatggaaataaaagactgattatcaaggcacctttatccagcaacagaacatttaaggtgggaattcaagtgatggagcataattgctttgaaacttcagtaaaaatagaagaatggctgtggcactacaggtttggtcacctaaattttagggatttacatctgttatacagaatggtgaatggtatacctcagattcatatgccaaaggagatgtgtgaagagtgtttggagtcaaagcagccaaggtgctcgtttaaaactcaagttcccagccaatggtatacctcagagatgtggtcatagatgagtctaaaagctggaactgggagaatgatgatagaccaagcagaattatggttgattttgggtcagaagaacaagaaaaaggagatatggaaacagatgcagaagtgagaaaatcacagagaactagaaccattccacaaaggctgcaagattttgatattgtgtctgatacacaagtgaatgcagaaggtgatttagtgcactttgcattactatcggaagctgaaccagtgagtgtggatcaggccctgtaggatccaagctggatttgtgcaatggaagatgaactccagtcaattgagagaaatgagacttgggaactagtggatttacccattcataagaaacctataagtgtgaagtgggtatataaggtgaaagtgaacccaagaggagaagtgattaagcacaaagctagattagttgttagaggcttcttgcagaaagctggaatagactatgaggaagtatttgcacctgtggccagattagaaactgtgagattggtagttgcaatagcaagtcaaaggaactggaaactgcatcaaatggatgtaaaatctgttttcttgaatggtccacttgaagaagaggtgtatgttacacaaccacccggttttgctgtgacaggagaagaagacaaagtctacaaattaaagaaagctttgtatggcttaaagcaggctccaagagcttggaataagaggatagatggatttttgcagcagatcggattcatgaaatgcagttctgagtttggtgtctatgtgaaaggagaaagatcaagtctactaattgtttgcttatatgcagatgatctattggtgacaggtaagagtgagcatgaaatctgttcattcaagcaaagcatgatgaaagagtttgagatgacagatttgggagagctgtcatattttcttggaattcagttcaagaaggtgaaaaatggatatgtcatgcaccaaggaaagtatgcaagtgattctttaaaaaggttcaagatggacaaatgcaatccagcagctacaccagctgaaacatgattggtattagaaaaagatggaagtgaggatgctgtggattcaactcaattcaggcagatggtaggatcattgaggtatctctacaacaccagaccagatattgcttatagtgttggcttgattagtagatacatggcaaatcctagagtgcctcatctcttagctgcaaagaggatcatgagatatgtaagaggaactctggaatatggcttgctgtttccaagcaaaatggaagaggaggaagctgaattagtaggatattcagatgctgattggtgtggagacaggaatgatagaaaaagcactgcaggttacattttcaagcttggtgaagcaccaatttcgtggtgttcaaagaaggaaccgattgtaactttgtcatcatgtgaagctgaatatgtggcagcatctatgagtgcatgtcaggcagtgtggattgatgcattgctgaaagaaatgcaggttaaagaagaaggaattgtgaaactgtttgtggacaacaaatcagcaataaacctggccaaacacccaattgcacatggaaggagtaaacacattgaaacaatgtttcattttcttagagaccaagtgagcaaaggcaagctgaagctggaatattgcatatcagcagatcaagttgctgatattttgacaaaaccattgaagaaggatagctttttaaggcttagaaatgatttaggtgtaatgagtgttgtagaactgaattaaggaagagtgttgagatagttaattcagttagttggtagtaactgttttagctttatatggcttatatgaaactctataaaagtgtgcttgtatttttctgcaagagagtaatacagtgagtgaatgaataagtttttcctcagtccacaaaacctctgctctgttatactctgttctaacaattattaatggctacgtttcaattgttccattgcactccaaccagaaatcaacacactcgatggccaaaaattatgagccaaaatatggaagatcaaaatcatttcatcaaaaaagaagagggccaaaagaacaaaggaaaaaaagaaaaagaaaaaagaaaacaaaaaaaaagtgattttgcaaagtcagacgatcaagggtgaaggtcaaaatccaaaagggcacagaaggcaagcatgaagaagaacgaaaacataagcccatatgataaagcaacaacctttacccataatataagtacgaaaaacatgagtgatactagaaacgaaaaatgaagaagaaaaaatggaatagttttacggagaattagtggaaaggggtacctgctccggctttcgtttcttcatcccagaattgtgggaactttcgtgaagatccatcggaatcaaaggctgaactgaacccccccaacacacaacacaacacaagtagtagagagaaaggtaccacccaagtgcgaaccaagagccactcctacactccaaaagtggttaaaaaaatacagtataaatattaccagtcttgataatataaagaataaatgttttttttttaggaagagaaaaaaatgattttaagtaataataaaattaaatctttaaattttattttagatttaaaacaaaataaaattcatttaaattataatataagattgtttttagttattaattactattccaaaatattattattttatttatatattatatatacaaagtatttattaattgtcaacaagattgatccaattaataaacaacatataatagataatatataagtaatctggtcctcttttcaggtgagctctcagaaatcgaagactttacctaaactttcagtcaaaaaaaaaaaatctattaacttttaagaaaaattaatatatctacttctattatctactatatctatcaaatcatactcatattagtttaaaaaattcatgtaataaacattttttaaaataataattacatttttaaaaatttcaaatttttattatatttaaattttataaaaaaaaaagtgacaggatattaatttttactaattgtagttagagaagcataaatccaacatcgtatcattaaaaacaactaataaaaagaaactaatatttaaaataaaaaaaggaaagccataattctttcctccatttatgcaattgtatcagcggacagcggtcattctctcaatctctatatatacccataagaaatttcactaaacaacaataatatacacaacataaagtaataaaaaaattatatataacacatcgtatttgtggtacctgcgaccgcgagactttgaagtcaacaccagacggcagcaatcagccacactgacgcacaccataagcacatgtgcatacccacgtggagtctagataaccaatcaaatgccccaacgtagcatttaagacaatatcctgccgtataatattttttttctaaattggaaagttgattctccaataattttaaatcattaattttgattctttatttaaaattaagatatctaatttttctagttcttaaaataatttttttaatcctttgattagttgatcattcgggattttgatagaaattgaatgatctttgattcaaatataagataataataaatcattaagatacttgttatattttgttatatttaatcaatttataaagattatgttgtatgtatcattagtcaaaatttattattatttttaattattaaaatttataaattaatatataaattatccacataaattattttgtaaattaattttaatataaaaattattttgactctaattatataaatcgacatgactacatcaattaatataaattatacaaattaaaaaaaatattttaatatgtaaattatttatattctaattatataaattaaaaaattttaatatttaatttttcaggaaacttacatgttaacattttagttttaactataaaaaaaacatttagtattttttaaatgccaattatataaatcaagaaaattacataaattaatatgtaaattatttataatttttttatgtaatttataaaaattatgtaaatttatttttatataaataatacaaattttttatttaaattataaaaataatatattttaatttttagattatttgaatattatttttaatttacataatttctataaattacatagaatattttaaaaaaataatatatattagtttatttaatttttaaaaaacattataataaaaaagaataactttttatatataataatctattaaattatatgaaaataaaattttataatagtagtatacatgtaaaataaaatattaaatatatttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataagtataaaaaaaaaaaaaacctgatggaattggcgtataatgtaataagccaaggcaattcacaaaataatatcaccattttaaccaaacaaggggcgaacttctctttctctctgtttttgtgagtttatttattttgattattgaatccaattccttttatttgttcacaaatcttcttatctttattatttacacataaatgatacttaaaatatattaattaatttattttcaattttattttaaatttttgtgactgttttaatgcatttgaaactacaaagataacctctaaaattttgagcggaaatttttttatcccctgtatatccttaattatttatacgtattagaaaattaaagaatctcttccaatccaattgaagaaacgaaagccggagcaggtacccctttccaccgattctccaaaaaaagattccattgtttgttcttaattttttgttttttgataacaaccaagtagcattttacccatatcagcttagccaaagttatcaacctttcatgttccattttggtcagaattgcatgcaattcatggaagaaaaaaatgcaatggtggattgggctaatcaagttggtgttggtgcttgtgatcctaaaatgggtgtactaaaggaggatggatttgacaaaaatcaaaactcctcaccatgctactacaacggaaatatgcaaactcttccttctcaattgcagtatgatgcaactttccagaccctaccaactaggacaaccatcaaggtttgaacttaatggtttttacgattcaaatatgcttcaattatctcaatttttttaactgcatgcatggaaggaagtagggtcatccctctactagaaacatatatgctttttgtttaggttttaattttcttaggctttcaagcatttgcttatgctttaaaaagttgttgaatttgttttcttttcttggttgagtatgaatttgaacattttacacaatatggtcttcacaacatgtgtcgaacactaacacatgtacgacacttacataacgtgtgtcacatatttcattttagagtttgaataaaagatttttttttagtctaacacgttttaagacaaaggtttgagataagtgtagtagagagtgttttgcaatcatccaaaggttcaaatgtgacactacacattatctacaaaagtcaaaagaataagaaaaagaaaagaaaagaatttgttagcaaggaagaacaaattaactaatttagccttaaattccgcactcttcattttaattgataaaacgtgtaatactcttttgatcttaatttgatttgattggatatttttcttagacatttatttatttatttatttacgtcaacacctaattttgatttaaagtgttatatattatatactttggaaatccagtattaaaaattaagagaaatgaataacattggtgatgtatataacaaagactttcatctctatattcgaagtcgccccacaatgaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccatattaaaaagggttgaaaaaataaaataaaaaattgtatcttacttttatatctctgataaaatttaacaaaaataaaaaaatcgatggttcatcttatgaaaaaagatcatttttaattttccaaaaggtatttgttttatattaaaataatatattgataaaaagttaaaaggtctcgttaaagaaaagtcaaaaacctcttaaaaagtattatctttgaagaataagtgaataaaaactaaaaacacttttgtgtaagataacttcaacttataaagaaattcattatttctatattctattgtcgggaaaacgtaaacactgacgctttgtcgctaagaaattaacgatgaacattatttttgttaccgtcttcaaacatgcattgttgtcaaatttgtgaagcagtaaataatcatttaccttcccccagaaaaattatcattgaagctccaaccttaattcggaacaaatacatattcctgtctaaatgaaaactataatccaaatcttatagataaataaatcaaagcatgtgcctaatctttagttaaatctatctttcagaaattgaagattaccaaaaagcaagggagcacagctctaggattcaaaacaataagttcttcaatctctgaatggtcattcattttctttaccaaagaatcaaactcaggatcaaccatttccttgatctcttgtagaggattatggattctcccagctattactctgcacaacataacacatattctatggagagatttattggatgagcaaatagaatcaatggctttttcactagtagaagtggtgtaaaccccaagtgcaccatgaaattctttagtggcggagaaaccatgcctcagaatttgacacacaccacattgctctaaagtgcaaagggtagaagagccatttaaaccaagggagcatgcaattgttgtaccatgaaatctcaatagctcatttccatcaaccatgcatcttgggtgctcattttgtaacctttcagctttagtccttaccatacccgtactttcctcaaagcatgcaaacgtttcttgtttgttctgaattctcaagacacattcaatctgtgctgccttgctttcgatcaagttatctttgcatatttgttggatgatcttgcaagatgaaccttctctctcaagtttgatcactgcaaaatggtacatgtagatgttccataatttcagtaaaagcacttttttaagtgaaattatatctgtaatttaaatataggaaaagaaataaaatagatttttctgtaaaagttacaaaagatcacatgaatattcttccaaatgtttcaacattgacataaatctatataattaatttgtcatactagtgtcaaaatcagaattgttcgatcgtaattggtcaaatttaatatagtgtcgagttgagggccacctttttttattcccagtccctttctcaaagtatactattgagttcctttataagtggataaattatactatgatacaggacccccacaacacgaaacaagactgattttaacacagacatcataccatctataatctataattgttataaagggaataagatattttgatgtacatgcaaatttttatgtctattttatttttataacgacattcataaattattatttcatttttataactatattcacaaaccacccactaacttgtattattttttattttaaaataaacatgaaaaaaacaattaggcactccgtgcctgttttcccctagtatgatataaagaaaattaaggagagaacaattgactcaaaacatatataagcacttcaaactcattcatgctaattcaactagttagaaaaaatacttatcccttacctgaatgttcggggatattatgatcatgttcttcaacagtgtcagtagattttagtttctcatcacattcatgatgacgagttgatattgggagatcatcattagaatctttcttcagtggcacctttttcttcgagaaaaaattacattcatcacaatcaacataatgtgttttagatgaaggtataattcgtttggttgatctaggaggatgaggctcttcttgtacaccttttccatcttcactgccttcatgagaacaaggacaacatggacaaagcataatctcaccgcttgatctatcaaggaaaatttcatggctaacatggtcccctagtgagtgtctctgcatgttattaatcttgccttgtggttttctctgagtactgctatatgccttcggatcatgaacttctgatgcatgaggtttgcaacgaagtgatttctttagaagatgccaaacctctgacatttctcttgatttcttttctttgtgacatgtaaaagattcattactaatgtttttatctattccaattgctaaggcaagtgaacaatcaaggaaaccaaatcgttattgttttcaattacagattgttttctttgtcggatcattcacaaatgggaggaaattcatggagtgcaaagtttgtaaacggtgccagctttcaatgaaaaaatacaaataatttcaaccttctcatttatttattatttaaacagtaaagattttcttttatttgaaaaaatatatataattgttaaaagaaatataaattaatatatacatgaaaagattttttttagagaaaatacttcatacacatagtagtgtaaagagattttacaattgtcttctaataataaattgatatgtgtgataagtttattttaggattttcttaattatttggaaaaaatttagttctaggaattaatgtgataacattatacattttcgaaaaacaaaatggtgatttatggtttaattttttcaactactttaattcaatttggataaaaacaaataaatatatttgaacttattttcaataaggagaaaaaatgaactttattttttattatatttatattcaaaattgcattataatatttacaaaactaaattatatttaattaactatattaaaataaaagaaaaatatataatagatttattaacttttataattaataattattttaaaagttacactaacaataatttataattaaataataatataaaattattttacactaaatttttcgttttctaaatttttattcttccttataatgacaccattattcacatttgattttatcatattatctgtccattaaatggagtaattgtatatggataaatagaatttgattttaagagttattgtggtgacattttctcaatggtagatcaaaagactaatgtaaaacgaatgcacaaagaaagaacgacaaagatgtaagaaaaggcccaattaattcttattccgttaatgtttcgatcattttcatcttataacgtgacaactatgtatgcatgccaatttagcttctactcctgcacttaacttgccaattgagcttttttaacattgttagatgactatagttaggaacgagggactaaattaattgattatttgcagtatcaatcattttgtcattattttattttagtgattaatattaacctgccattaattataattttaagaattaaattgattgataatttataattttaaaaatcactttgctattttaaaaatttcagggatgtcagtaaaaaaaaattagggaccaatttggatattataattttaaagcgtaaattggtagttgaaatcaattaataagacaatgtcatgctacacttattgaggaaaataatataaaaaattatctctctcttaggatttaatttttttttttaaaatgccaccgatattttctttaaatcggttctcatataaccaatataaaagttgttattttttgcaaaagtgaaagtaaggtaaggaacaaaatgaaactaacaagatgaaaaaatataataatcccgtaagaagatgacaaagtacaatgacatggtagtctaccatgtaggtatcacaactgggcgaggcgggagcagggcattccccgtccccattgtagtctgtcgactcaaaatccgttccttgatcccgtccttaatttctgtaggattttaaaattcatcctcattcatgttcttgttggaggttgggttttcttcgtcccgtccccgctatttgattaaaattaaaaaaaataataatatcacttttttattaaaaaaatcgaacgaaaatactaattaattaacaaaaaaacaataataaaatcacatttaaatatgagatcataatttaaaaattataaaataaaattaattaatttaattaaaagaattacaaaataatatatatttttttaatattatttgttacgggacgggtatgaataatctcatacccgcccccgcccagcttttggctttcgggaaaaattcaaacttgataaactcaggttttttctactaaaatcgaaacgaattcgggttaatacccacgaattcaagtcccgcttccattcctactagcatgacttaatttgcctatagttaagaattctgttgcaggtaaagtattagagcttggattgcgtataaaaggaaaaaatggagtaaaatacagataacacttttaaattgcggtcacatatatggtagtggttattttgcaattactaaaatggagcaagatacagttgtattgtggatggtgatggatccaatataatatgtctattatccctcaccctagaagtggtaaatggtagcaacagccaacttgcagaacacactataaaacatatatagagtaaaactgtaaagtcaatttggttatgtgtaacagagtgattaaaaatgaaggaaagattgcgaattcaatctatcatgctgacaaaaaattaataaattaataattaatgtttgtgaataataaaaaattgtgtaatagagacaatgcaagcaacatatatagcctctgtttctgcttaactcatgtaataatgtttgatcttcgtccaatcacattatgcaccatgtgctttacacgcatacaactggcactgtggcacaccgcatgcagaacatttcctttctgtacccaaagtttaaaaattaaaaaaaatgtggaggagatacattaacatgaacattatcaagtcatgaacattaacttctataaatgctgctcatattttaagatatatagagagaagatcaagaattcaagatcactatggctctagatacacgcacaaatcaaaaaaatggtaaaagaaaatattattcactagaaaaaataaaaacaacggttctagtgtcgtatctgaacctttgtcttgaatgtgtcatccgaaaaaatgattattttattcaaagttatgtgactatgtgagtgtcgtacacgtgtcagtgttcaacacatgttgaatacataccagccactacatgcaagtgctacataacaataccaggttatttgccaggttgtgaagaccattgtatgtgtaaataatgttcaaatccatactcaatatagaaaagaaattcaacaagtctttaaattaaacataggcaatgcttgaaacctaagaaaattaaaaccttaactgacaatccaaaaaataaagcatatatgtttgaagtaatgagacgaccctacttccttccatgcatgtagttaaaaaattgaggtaattgaagcatatttgaatcgtaaaaaccattaagtccaaaccctgatggttgtcctagttgattaattggtagggtttggaaagttgcatcatactgcaattgagaaggaatagtttgcatatttccgttgtagcatggtgaggagttttgatttttgtcagatccatcctcctttggtacacccattttaggatcacaagcaccaacaccaacttcattagcccaatccaccattgcattcttttccatgaattgcatgcaactttgaccaaaatggaacatggaaggttgagaactttggcttagctgatatgggtatgctacttggttgttatcactagatgggaaaagttgttgtgtttgagacatgaaatttgaggccatgtatggagtaagtgtctcagctttgtctgattttgctattctttttccctttgaatcccgctttaacatattcatcctttgattacaagcatcaagtttaacatccaaaatgctaacaaacatcctcaattgttcctctccaagagtattgtaagagtcatcccaagttgggtacatgagcttgatcttctctttgtgcactttggaaatctcaccttcaatctttttcatcctatcgttaaaatactcttgcacattatacaccttagaacacctgtcactagtggtgttttgatatttttgaatgacacgtttgatttctcttgagtcttggtcttggggccatgtttcgggttcattgagaaacttgggagcatagataactatgccaacatcaaccgcacaaagagtggaaaattcataggctttcttcaataatcctttctttctcttatcaaaagttttctcacgggctttctcctgttggatgagttccataggtattcttccacgacccattttctgcatggtatatagtatatacaacaattggcaacattcagtacataaatctagacaaatttagatgggcaccagatttttattcaaaataagcgtaaaaggatagcttttcaattcatatcaattttaattaataaaaaaactgcatgtttgttattattactatatatagcaatatctatagaacccaggcagtggcagaaatttgacttgagaggaaaaaacatgatttaatacggaaaatttaattataagatattcaaaataatattttaaataattatatatacccacactataacatctcaaatacgcataaaaaaaataataacattacaaatactctattaatatttactgtattatctatcacaccatctctaattaattagtttttttttctcgctaagtgtcaactaacacattgatgtttatacatcttttttcaatattttcttttcataaattttagaggcaccataaatttatttttataataatttaaatatagttttgaaaaaaattgggagtcactattactactcccagtcaaacccttgcctctaccactatttataacaattggagagtttggagagagaaggaagcagatatggtgaaatcaaagggtgtttgagggagaatcaattggttaaaggatcccttaggtggagggatttggcaagtatgtgtgaaggaggtcacagaggtagctggttagagaataatatataaattacatgcagtgatgatctgttagcacagaaaattacaaatattagattacgatacaaactttggtttgattctagatcaagatacaaactgatattctttacagcacataaaatttgtttcttcaatttaaactcactataattattataacattagactagagactgacattcacggtgtccatgataacgacactgctctaaaaacatgcttttttatcatttattttttgtacacacatttatattattcttgacagtgcacatcttgtgcttcaattcactgtcttagttattataatattatgatcaacaacagatttttctacacatgcatttgctggacttccttgcacacactataactttcaagttaatttcttattacttaacccctaactcttcaaactctgataaagaaactaaaatgcggataaaagacataaatttaataaactaaaactaacataacattaatatataataaaaaaaggtatattatattaaacttaatgtcttatccaaaaattcaccaaaaaaatcatgttttatccaaaaatcaaaaaatgaagaacgatgaaaacaaacatacttgtgtatccattccaaaaaaatagactcttgatttttagacatgaagaagatataaacatctcattaacacattatatttttgcaaaaaaaaaaataataatatcaaaattgtttcttgactaggactgagaaatctgcttagttttattatatttcatcaatattatcaacaatacagtcagtcattcaagctctgtagggtgaagatacaacaatggatgaagggtccaatgaaaccaaaaccacatacaacaacaaatgacattaattcatcaacatatcactatcactattataaaaatataaaactagtgtttacttcaaaaggaaacgtacctttttgactttgttccctgaccttcgttttcccgttttgtgcgatgacattttatggtggatgttattctaatttatatgagtattttcttgactcttccgccctctgatttccttcacttcctacagatcataattagtgctgaaattgccctaatttgtgataattcttgggattgtttcctttttatctttctttaatgtgacttagattatccttaattaattcgaaaattctagcccattatagaattcttcggacatagttttctacaaattttgttattttttttagtatttaatgaaaaagggacaaataaaaaattaaaaaaatttaatatcttaaaattttataaacaattaaggctttctttatttagtaagtagggaggtttgtaagaatatgtaaaatgattcccttatgttttgtttttgaacaaagttaattttattaaattgttaccaaggtaacaatattctgacattctcgcaagagtcttctgcagctaatgcatatggatggctgacatctgagacaagcactggttcccgcaatgctttccatgctccttgaactttcaccagcactctcttttgccatatgcagatttaaaatgattcctaacataacccataagttagttaagattaatagaagtatatattcaaattaaatcagtcaaataaactattaaatcttttatatatatatatattgattttatataatacgataatcaaatttattaaatttcgacgggtagttgtagtagctagaatccattcttgcttttaacttgtcaaagagattcatgatgtgcatgagaatgcagacgacatatcatggaatcatgttttgaaagagactatatatgaaaaatttgttgattagcgaaggaataacaagccttctcgattccgtctctaatcagccacggaacagagaatcacaatttcatttactagtttgttgctactttgtgatgaattagtgaggaaatatttctctcgctagctattacatttcttgtagtgagaagctaatcggattatggatgggatggtcactcatgcgttgggtctttgcagttgctatcaagtttttgaatttgcctcttcttggatttaactcatatattttgtattttttagaggatatttttttttatcgtgtgcattaaaaatagtgtcatgaaatttacaacactcacacacattatgttcaactaattaaattagactctcttaaccatttcttagatattttagtcaccttgtatattaaaaagaaaaaaagaaactagagatacttaggatcctttcctttcattttttatactccaaaattaaaattgatatatttttaatcctataatttgataataaaaaaagttttaatcctatgtccaaagtgtcctctgcccaaatgccgtcagaatgaatactttgaacaaaaaactatacatgtagtaagatgtttgataataaaaatgtaaaatcaatataggttgtcatgtaagtggcttatatataatcccaaacaagatccttaacggaactgaaatagttttttttttcaaattacaaaactaaaaaggtaatttttcaaggagatcaaatacagttatacaaactttccttgaatttaaagaattaaaaatatatctaaacctattaaattttatgaaatgattttcttattaattatacaactttccacagttatacataaattttgattttattaattttttataatttatcgtaattgattacaaagtaatgaaaataatgaataacataatttatttaattatgacatatctaattacagtaatcaaacatgatttagacattttaattnnnnnnnnnnacttgataacactaatgtaaattttaattcatatttatagtaaatttaaattgagaatttttttaagatttattttattttaatgataccaatatatgaaattgagaacataaattaaaaatgacaatttgtagggttgtgggtaaggtactataatacttaatcttttacttgtattttaaataaatctttatatttgtgtggataataactttaatattcttgtctttctttgtttagtacctcaatctccataatcgtattagttgtccatgttttaattaatatgaaaaatcaatannnnnnnnnntagtaagatgtttgataataaaaatgtaaaatcaatataggttgtcatgtaagtggcttatatataatcccaaacaagatccttaacggaactgaaatagttttttttttcaaattacaaaactaaaaaggtaatttttcaaggagatcaaatacagttatacaaactttccttgaatttaaagaattaaaaatatatctaaacctattaaattttatgaaatgattttcttattaattatacaactttccacagttatacataaattttgattttattaattttttataatttatcgtaattgattacaaagtaatgaaaataatgaataacataatttatttaattatgacatatctaattacagtaatcaaacatgatttagacattttaattnnnnnnnnnnntagaatatggaaaagtaaaaataacttgttggtataaaatattaattaattattttaaatcagtcttaattatataatctcatatatgcataatctatcaatctctcacatttcggtgtgactcattcgggttgttacattctctaataatccaaacttcattcctaatttaattactcaggggtattgattaatagagaatcaaagtgaattattgatataagttggttgagcatagtgtaagtgttttataaattcttagtattgtcttcgactctatgcataaaaaatactaacttaaattcaaaatcttttcataaacagtgtttcctcaacctctcatattttacctatgtgtttcataattagaatcgtcgctccctattaactcataagcatatccatctttaatgctatcaatattagctaagttaagcgagataaaggtctccaccaccaataaaaaaaattgtaatagttttcgcagagtttatacgtgtcaagtaataatttcactaataattatattaataaataaatgtttttaaatgtgtgacatagaattaatttttcatttataagtatttttaatcaaacaagcaactataattttcaactctaaatattaatgaaaatagtgataatcatttcaacagtattatccattgtaacaatttttgtaagggtaatttcgacaatagtttaatttatgataattttaatagaaaagtcttttcgataataataatgttaatgataaattcaatcatatatgtgataataattatagtaatgatttcaatactaataaacaatggagattggataaaattttagtagaagaaatgaatatttacaaaagtaaatatttcaagaagaaatgagaattctaaagagattaaggattaaaagagatacaaggaagtaaaagaaaacaaattttattaaaagtggaacaaagacgtacattgtgacctttgaaccaataaccattttttgtgaacaatgtgagtggtgtataaaaatttaagtggtagtgatttaatccaacgaaaatgactgtcgaagtcttatttataggcttataatattaatgatcaaattatataattttgacatgcatacaacaatttactaactccctacatctagtggcgttactcatttgttcagagtaacaattacaaaaaccaaatatgttcagagcccacaaacaagattcatgtgaaaatcgaagaacactttgtgggcaacgagaagaggaaaacactgggcactgtagtggttcttccaatgttgggttgtggggtaggggttgcggacaaggttgaggcgggagaggaggcgtggagggaggaccaaatcttagatatgagggggaaaaacgaaaaaaaggggagaaagaaaccgacgccggtcaattggtctccactaggaagttgctgtgcgttacactggccgtcgacaattttcgaagaagcagccatgcggagacgaagaagcagcaaccgccgtagaagaagccattgttgtagtggtagagttgaggacggtgacgagacgacaaatgtgacagatgaagtggtcgacgatgcaagaagagggggaggcgatggcagaagtccgcgagcttgatcaaggaggagtgattggagatgacggggagagagacgcatgggtggtgccgttttgaaataatatatgttttttattttttttctttcgattatgaaccttttatttccagacactttgatgtttcaccggtgaatccttgatttttggacttcacattaaaattcacctaaaataatagtcaaccaaaataaactaagtttttcaaactttaaaagttttcataacaatggtaacactttcacatcaccaccctgcataccataccaggacactccacaacacctaacacatcaaaattctgcacatcaacatcctgcacaacatcaactcccagaccgtacaaatcgacaccttaattagcggcaccatgcacatcgacgcccaactcaaaccctaacatgtctaaaccttgtaattgagcatcttcaccatgtttttctatttgtgccgtttggaggtttaattttataattctggcttgaataacagttgaatccttataatgtaaggttatttgtattgatccattaatttttggttgtttttattttttttcctttcaatttttggttgttataatttcccttttctttttggttttgtacttataattttttttgttagatttgacgaaacaaacctaacaaaacaaaccataatcaaataaaaagaatataataggaacaggaataattaaaaaggaaaaaagtaaaacacatggacattttcttataaaaagttatttaaggtttgaatattcttctttgggacttaggagagatgctcgtattagaactcaattagtgtcatgaataggatttttttttttcagaaagagaatgcatttagtaaaccaaaaaaatttaaataaattattatacatgataaaaaaaatttatttgaaagaaattttttattatatcaaaagtagtaaacatttattttctgaaaattctttttttgtgttgacttttttaattttttaataataaaacgtaatattttctgtttttttttcataaacaaatccaatttaaaaatatgtcattatttgagatttgagatttgagataaggtgatggatgtattttaagatatcctcttaactcgtaataatgaaacgataaacgtcgtgtgtacgaatgggactatacacgtgttaagagcctattcgacaaaacacgtgcttctttcaacccacaactaccccatggcatttccgtaattccggggcgagagcgaggtcaatttcaggaagtcaactctttgaaaaatcgaaaattccccttttcgaatttcttcttcctctcctccttctaccattttcctttcactttccatcactttctctcgtttccccttcgcaattttccccttggaagagacatcgaagaaaatcacgtcacggcaatggaggaaaagcacgcagcagccatcgaatccgcacacgccgaatccaacggcgtctctcacggcgccgaccacggttggcagaaggtgacctacgctaagaagcagaagaagaagaccgttaacgcggccaacagcgccgattcccgcgcgaattccaacaagctggttccgaatggcacgctgtccggcaacgatggcgttttccggtcgcttgagctgcaatcagaggaccggcgccggaaaattgtggaggctaagaagctggccgatgccgcgtacgacgacgaagacgcgcggctcagatcgaagcagcggcaccgcgacgacgacgaatacgactacgatgacgagaatgtggaccgttccgcggagaacgggaaggccgaggaggcgaagaaggtgaagcagaagaagccgaagaagcctaaggtgacggtggcggaggcggcggccaagatcgacgccgctgatctgggcgcttttctcgttgagatatcggtagggcattgtgaattgaatcgtgcgtgtttaggttttttgttttttggtttgatctacttggatcaggaagatgatgtgatgcgattcgattcgttttatttgtttgttttcacaacagggatcgttcgagaaacagcaggacatattgatgatgcgattcgctgattactttggacgtgctttttctgccgtgaccgcatctcagtttccctgggtgaaattgttcagggagtcaactgtggctaagatcaccgatgtgagtctcgaatatcttgttttttttttttgttctttattgtaaatattagaaaaagattttcaatttgatcctttcaagatgtttatgtcgccacattagttcttattcaaagatgggttgtcaccacattacatctttgtgaagttcagtcacattattctctaattaatagctcataaagaaattatttcaaaagtttcatagcagcaaatcatttacttatttgcatttaaattattcgagtctgttaagtacatttgcggtatagaagccaaatgttagtatctttggtgaagtgaaatttaattgagatgcatattgatgctttactaaatctattgtgatattggttcatgtgattatttaccgtatttactgttttaaaattctatctttggcattagaatcttgttctagtttctaatcttcgcctgtgatgttgattaatgaatttcctttttgctagatgccactttctcacatatctgatgctgtatataaaacatcaatcgactggattaaccaacgttctcctgaggcacttagtacctttctgatttggtctttagatagcattcttgctgacttgggtagccagcaaaatgtggccaagggttccaaaaaggctgtgcaacaagtgtcctcaaaatctcaggtacttatactatatactcttctctgtcaagaactagtgtttttttccccttctgattattattggataacagaaataacttgtattagaagataatatttattagagagaagaaggaaaacgaaacactcttgaaaactaattggagggccactcaccaaattgaaccaaagctaagctaaaaagaaaatacaaataaagaatagctgttcactctgcaaatccatcaagggggctctctggaagaacccgtgtgctgaacagctaagagatgtcaattaaacaatcttgtcccaaagcatgattaattagcaaaggacaccttcctttataaatccaaatattctcttttaaccgaatgcttgattagtgcatgactgcaatgcatgactttgaaattctatattatgccttagtgcgctttgatttattaattaatatgtttgtgataagttgttagttttgatatgattatctctgcttttaagtgttcaaatgactggggttggcgtaaattaagaacatggaggaggcagtgttgctaaattttatttttagttctattttttatttttccattttgatcttctttgatctgtacactcaatatgaatgaatagtcaatgtcaagatagataacacaagtacgtgctcttgagataagcagtaaattcacaggtgccctcaatgcatgactgacaaacatcagaaaatgaatggtgaggatgaggagtaactcccaaagagttactcttggtgtaagttaatccctcctcacacacatacaacatgcatcaaatttcctttttcctttttttcttttggggaatgggcattcagttacttagaaggtcaaatatccttgttcttagatttctattgctatttttggttgtgctgtgaatggaaaaatgagttagctttcattattcaatacttgtgtttttttctctctctagaaattaaaatgcacttgaaaatggaaaaaaaagaaaaaaaaagaaatgcttccatttgaatctccattaggttatgtttgttcattgtagtttgtgtatcttctgattttattagtttgtttttgtgatttttttattgttaaatttgacttgaaatttctttttgtaattttggtttctaaatcaaattcaacctttacatgactatttgtaggtattcaaatgtagatatacttgtctgttttgctcttcttttaagctgtagactgatatttagttcacataaccgcaggttgcaatgttcgttgttttagcaatggtattgcgtcggaagcctgatgctcttatatctgtattgcccacattaagggagagtacaaagtatcaagggcaagataagcttccagtcattgtatggttgatagctcaggtgaggggtacaagccaaaataactaagatcttataagaaatcccaaaaaaataagtttgactttttctgcgtagcatttcattttcccttcattttattaatgcttaatattttctgagtaggctgctgtaggagatctctcagtaggtttgtatgcttgggcacggaatctcctacccatagtgattggcaaaagtggtaacccccaatccagggatttggttttgcagctagtggaaaagtatgtaaatatagctactttcttttttaatatcactatctcattattgctattgtcatcaccattgtgttttctgtggtttgctgtcagaattttgtctacccccaaagctcgacctgttttagtaaacagtgctgtgagaaaaggggaacgattaattcctccttctgcttttgaaattttggtccaggttactttccctccatcttcaactagagtaaaggtagatgttcgactggttttgtatgtttgtattttagagtatcatagctctgaatcttcaaaatttatgtcaatatgctgcttttgtataggctactgaaagatttgaggccatatatcccactctaaaagaggtggctcttggaggttctgctggaagtaaagcaatgaaacaagttgcactgcagatattcagttttgctatcaaagcagctggagaaagtatggaaaagtgatttttttattacatttgtgcttcttttcttatttgatgaaatgaatgtttgagggtattctgaaacatactgtatttttcagataatcctgagttatcaaaagaagcagctggtatttttatttggtgtttgagtcaaaacactgaatgctacaagcaatgggtgagtagtttttgtctagaagcttaccttttcgagtttatgcaagtgattgatttttttggatagagcaagaatatttgttatatgaaaaaatttctttgcattttaaaaatatatatgacaatttgatacataatggttctgagtatttgagaaagaatcaaataaaagataggattttgttgatgatatgacatctcccatatagccctggataagtgatgaacccgtgttaggaggagaaagaataaattcaaattgttcctcaggatttcttgagccaatcagtgcgagatttctcccccaaaccaatctctaactaaatccaacaaaacctccaatcaactctgcctatctctatattgccgctgccaaattctgatagaattctttccgacactcaaacccttaactccctcaactaacaaaaaccagcccattgggcttattacctaacacaatcataaaactagattttacttatttggtattattccttattgtatatggacaggaaaaagtttatcaggacaacattgaagcaagtgtttcagttctgaagaagctttctgatgattggaaggagttatcaacaaaattgtctcctcatgatccactgagggataccataaagaacttgaagcaaaaggtagttttacaggcaaaagagctagactttcagtttattgcatctgggtttgctctccagtctcccaggatggactggttgaattgtgttttattgtactgaagtaacagaatgtttgaagtaaataatggattaactttttttggctgcagaatgagaaagtattggactctgagactgatgctgctcgtcatgcacacttcaaggatgccgataaatattgtaagataatcttaggaagagtttcgcgaagccatgggtgcatgacttgtttaacctttacagttcttgctttggctgtgggtgctgctgtttccttgtcccccaatttggaatctttggattttaagaagctctcggaacttttcaacgttcagcactgagtactctggagaatatcccgcattaccggtagttggttgcttccaaacggcaattttcttttcagcccatctcattcacaaatcacaatgggtacagtaaaccaatagcctcataataaagtgctcaatgcggagattgtacacttagttcaaatcctgttcggatgacagagaatagttgaggtcaacaatgctttgaggtttactttagtttgacctttttataatttatttgttgttgtttctgttgagttttaattttagttactatgcctttacattaacttatgctggcaaaatgccaattaggtaactacagctgtatcctgaagttagttattaatcagaggaattttggtggtacattgcgagatttttctctaccttttgctctgttatcatgggtggatgattgtgcccttttctgttgccttttccctggtctcgatgctttgtttttcctttaattgaacaacattattgagcttatcagatgatcgatataaaatcaggaatgtgattttttttttttagtgtgagaaaggtagaagttgataatttcgagtgaataagcgcttcttacatttttaaggctctcgatacagtagcatgatgatgccaagtacaatctttttctatttcagagacacttttatatttgtgaaaccacgtattttgatcaattttctgaaatttgcattgcatgatcgatatcataactacttatctcgattcaatgaattttttgttaaacttattacattacattaatgcccattaatttccacctcagcgcctcgctcattaatttgaataacttgacattatacatcaagattagttttattagtttagtgaacaaaattgttgaattcttttacggattccaatccatgttgttccacatagaaagtgccattttgaagggttacctgtaaattttgcaactgaatcccacttaatatattcattttgtaatcaaaatcagaaaaacaggtataaccctagattcacaacaatgtagttttggggaactgcacatctatagaacatctgatttgttgtgttttggtcttgatctcatagattatcataatcttcaggttcggcatatgggtactttgcgtatgaacttctaatttttgaaggatcttcaggtacagaccaagggtactgcaaggaagggtcccgtgggaatttcctgaagtttaaaaatggtgcccaaagaataaccctgcaagaaatcacatttcacacattagtttgctagcttttagaaatttgctgccaattcttgaaacaaataatttcaaaagtcatgcaaccaacttaatttgtagatttgttatcactgcgcacaattatactagttgcttcatccttatattataacatgaaaaatgctcctaattgaaacctgaactcagtggagttacactgtagtcatgcaaaatttcgaattagagtagtctcttgacaaagttagacaacagtacatatattttgcttttagatgaagagttgctcacccggggaagaaaatgaagacacacatgaattgaaaatacatctccagcaagtttcttcggtaccatcttttccaaagccagtacatgattattggctgcaattcactcactatgttctgctcagtcacatcttggtaagtacataagagcaaacttcaaaaattgtgaaagaaaagaacttactggcacgacaaggaaatatccaaagagaacaatcccccattgtgtcaaaacccagaggagttctggccggttattctctccagtcactgccaatactggctgctcagcctgttcaaatagccacactcaacttttgtatgtaaaaaaaacaaaaacaatgaagaatatggcaaccactgtaacctcaaagatacctgtttaaggaaactttataaagttgttttttgaaagcaaaatgccaatcaaattcaatgatactggttgaagaatcaaaagtgatattttattgaaaagtgtaacagtgcatttcactgcaatttccaatacaatctcaacttaagactttctacttgacgattctttaaacattgattagcatgatcctttttagaaatgtaagtttttttttttactattcataaaaatcaaagacaggtatcaaggaaatttataataacttacactaattactcaactaacttaagtgagttacacccctttattcttagaaaagtgtaatttaaagttaccaacacactcttatcataattttcaataaaagttatctattgattaattactatttaactaggatctttaggagcttaggttacttgtttgctggaagggtaacaaaaaaactgaatttctatgtacacgaatctcaccaaggccaagagtactcctatttgcagtgccaaacttgcatgctttaggctgccatcatcagcatgatttggtttctggctgctgcatgttatctgcaatgggactcatgagttcaagttggacaagtttttcaatgaaatgaggtaaactagaattatagagaataagttggcaaaagaaaataaaagtacacgtagtgattggcaagaactagtgttgttgtggtatgatttgtgcttggaagaaaagaagagagaagttgttccacgtgatgaagagggaagaggaggcagagctttgggaacatggagattgaatgtgaagctcatttttggtttagagctctcacagtttggctccttatcctttttctcacttcagtttcatggcaatgagtgaatagccttctgaggaaaaaaaatgacaaaattaaatgttgattgagatgacacgtggacataagactcatccacctcctctttttcttgtccattcaaagttttgatgagggtaacacaaattcccccaactctttttatagtttgtggtcaacataaatgtactgaattttgcaacaaaaataaaactacaaaaactgttgaactaaaatagaacatggatttttacttctaatattttttacaaattaatttgtttattttttttaatatttgtgcattaaaaaaattgtaatccttgttggtacattgagactacggttttaatgtgagaaggctggtaagaattcaatcactgggttttaaaagatagaagtagagtgtgggaatcagaagttccaacggggagacaattaatatggctttaatttctccttcaaacagtcgtgaacattttgtagttcaattctcatccacgtgatacatttttcttttcatgaaatgaaaaacattaatatttcatcaacaaagttttccagatgtgacacccttcccattttaggcattttcaaagttgaagaaccattgttgccttataaatggaggacgtcacacctttccttaatcattttaaatttgaggtgatgttacagttcttgaaagagtcagattataccaatgaaccttagttatagtatattattaagtatattgactcatacgacgtataaataacttctatattttatcgagagtattttagtcgtagctgttaagttgtttcctaaatttaagaattgttcataactaaattcactattattggacctattttaatttcttaaagagttacattgctgtggtaaaatttgttaaaagtttttaaaattgatatggtactataggatctataaaaaagagataaaaaattccaatgatgttcaacttttttggttttccatatgtataatttttaggaaaaaatactgtctgatatactgtaaaatactatatgtggcaacctgttttaacaaaaaattgaatattggtttgtcagattgtagatgaatagttcatttcattagatttaactttcttggttctaatggtgtttacggtttgaagatgttctaatacttttaagaaaatgaaaaaaatttaaatataaaaggtatatactttaaaatttaagtaaaaagttaatgattttttagtcccggaaaactttccaaatttttggttttagtttccgacttttaaaatattgatcttaattcctatatattttttaaatacctaaactttgctctctatatagttatttgattatactataatttatatatacacacatatatatatataaaatatttaataatatgtattttttaaaactgaaaaataataataaaaatataaattataaatttaatacaagtataaatttataattgaattaccttcacattttgattgcacttttaagttttatcttatgtttcattatatgttgtataacaatttcctctttattaaatttaaaaagtataatataatgaatttatatttttaattattttaactgtgcggcccaagatgataatggtaccaaacttgatgtgtgtatataagttaattagtaaaaattatataaaattaattttgtatgttattattataataataataattaatgttaattaatgtaaaattagttatcattatcattaaagtgataattagtataaattgtgtaaaattaattgtttatttgttattattcttataataattaagattattattatttaatataaaaattaattttaattttatgtatactaataataatttttaaattattatttattaaaatttaaaatttagacagttgaatatttataaaagatgaaaagaaaaaaaaaatccaaccccatttataaggatttctgcatctgtgcctgcaaactatcaatggttcatttgagtatggggtactttcaattctttgcaggttacagtgattttacgaaaaaaaattctgaaaagagatgaattgtgattcgtaacaaatctcaccatttatttgtcgagctttattaactaaattatatttaaaaaagatctccgccttagatactatatttcgtgctattcgtgcaaggatttattcgtacgaaatagcatcactcgctatttaatcactttcatatgaaactgttgcacttccttgcttcgtgtgaatttcgtgcataattttgttgtttttgcttaaatttctttttcacttacatagtaaaatcgatcccaaaataattgttattaattagtaattctaaaataatacatttcctaacaataaatgtgaagttaatgacaagaaaagattccatattgttggtatcaaatagttataaattataatatttctgatgagtgatgagccgttgggcatgaaaaaagttatatatttttggtttcttacatgaactgtaaatcatatgtatagataattcatgatgatcgtattgattagcttatggtggatctggcctttacgaaacgtagatcacatgtgatgtgggtataaatatggaagcattgttgttagctgtcaaactttatgatatcatattattagcacgtacaggtacagccaagtagtttcagactcactctgattctttctcagctcctgcaaaatgaatatgaacttgaaaaaagtgtgtgaaaaaatttaaatcaatatttaatttattataaactatatgaattgtattttttttataaatatgaattataattttaaagtaaaacttatcattctcctgtgtgtaaaagaatgaatgatgaatgatacattacgactttcccccctacatatttacatttcatcaaaattacactcgttaggattattctaatagctcaataaatctttgacaaaattgatataaagattcatcagcgacctagaaaaggtagatatgaaatttgcattataacatagaaaactaaattatatactatgttttatttgttttaaagggaatgctaaaataaaaatctttagttttttttttattatttacactgctctttaagtacttttagttataactttctaatcacccattagacaagttgtttttcaaatgaaatcctaatctacatttttatttgtttatttgtactaaattaaaacatttaaaaattcactcttaaaaatacagcattgttaacattaaaatataaaaaaaaacgcaataaatattctcctttttaataaaaatttaccacttttaaatacttaaaactaatattaagattaatattaatattttgttaaaataattagtctagagtgtaactatacaattgaaaatataaatattacatttctatgtttcaattaatacattgttatgtttccttaattttgaaaaccacactattaaaattgagacacattataactcctcaaccccaaataaagaattcttttaaaataaagaatacataaattcagatagtaccaattgccaaattataactacagttggataatctaaatcatttggagcttaagacagccattccttaatagccacttcagttgcgattggagagtgagaccaaccacgaaattactttttcccttttcatcaaccaatattcactttcatcctacacattcaatgcccttgattacaaatagttaacaataactaatcaccaattattacattaataagacactgacccttcctgcccttatcataacataaaaaattatcaaaaacttttgaaattaactaacagtgatttgtatctctaaattagataattcatgattaattcttaattgatatttagtatgaaataaattatattgtgagaaaaatatttattttatgtatattcataatttctaacaaaactaatcactctaattagtatcaatactatgtcaggaaaaaatcataataatactgttaaattaatagtaataataaaaagaagaaagttttaaaaagaaaaaaaaaaaaaaaaccnnnnnnnnnnnnnnnnnnnnnnnnnngggccgctaaaagccaaggttgtcggaattggatttgattcttcacttgcgctgagtcttaccgatttttccgatcaaagttcctcactttctctctcttgatcgacacccaccacgcgttagagagagaaaaacccgagagatcggaaaatgggtacgcttcagtcttggagaagagcctacggtgccatcaaggacaccaccaaagtgggtcttgcccatgtcaatagcgattacgcggtaatttccctctttccaaagataggatctttctttgctttcgattgattttggctatgtggggtggtttaattggttcttaattttaggatttggacgttgccatagtcaaagccacgaaccacgtcgagtgtccccccaaagagaggcacctcagaagtgagtgatttgtgggctttcagatccgaattaatttgatcttcttgttgttggtatggaaagatgatgatgaagttgaatctttttttggttttgttgcagagattctgtttgccacgtctgctgtgaggcctagggctgatgttgcttactgtatccatgcactttcgcggcggttggcgaagacgcggaattggacggtaggattgataatgatgatgatgacaaagtttatgtgatcgcttgattgatgtgcaatttgattttgtttgagtattcaatgatttgtctgtgtttttttggacttggattcttgttttacttgatggattgatgttgttaggtttgaagaatttcatggtaggaaaagagaaaatagagattcaatagtctgaaattgatattggcttgctgatgtcagaagatgtgatacaaacttttcaaattcaacaacatatcctgttagaaatccggctaaataaatgtgaaactaatttggattctcttttgttttttcctcttattgcgctctggtgttcggttttgtgctatttctgaattttgataatgatttgtggcatgtggcattaatgacaccaaatggtgaaaggaaatttttatgaaggattgaattcaaatctattttgatggatgatgcaatagtggatccaattttttgataattcctgttcttattcatgttcttattactatttactactaaaggctgcattttccttacattttgttaaatttgttatgcactggtttagatagccatctcttagaagtttattgtatgccaaaaaattgtattcacttattccaaacatgttatgaggttttcgttgtcgtttttctcaattctcataaattattaaaggatcaagcagtgatctgatgtccagccttcctttttattcttgtgccactattggaccctacgtagaattcctaaagtggtgtttggtaattttggtgtgttttctgatttcatttcagttgatatgctttaaattaaaaaaaacgccaccttattttttttcctgttattaaacttttgtgaagggaatcttgaaaacatttttttgacttccctagtagttaatttctagattcttccttgtgttggagggaatagggttccatgaaacaaaataaccattattttgttctcattttttcccttaaaaattcttggttaaaaagtaaaaacatggtagtttctcattcatgtaatggaattcctgaataccaacattgtgttggttattgcttaagatgttttcattatttatatgtcaactgactgaactgagcatctaatattactcattattcctcaggtcatattgtctaaggattatatataaagaatttatgcctagtcctctgcaatgtctcaattttatgagtctcaactattttcttataaaatgtattttagcatcagttgctagctcaatttcccttgtctagcctgtaattatataatgtgtatatgtagatgtagataacaagatatgcttttgtttcactaccctgcatcttgttcacaggtggcattgaaaacactgatagtcatccataggttattgagggagggtgatcctacttttagagaagaacttctgaatttctcacaaagaggacggattctccaactttcaaatttcaaggatgattctagtccaattggttaattttttggccttaccatctttatgttttgtttattttacatatgggcttaagttagatgtttctaactgtactatatactttttgccatatgatttcatttgcttgcagcttgggattgctctgcctgggtacgtacatatgcattatttttggaagaaagacttgaatgctttcggattctgaagtatgatattgaagctgagcgtctacccaaacctgccgaagggcaggagaaggtaatttcaatgaacccattattatactcttttaggataactggtcaagtttcgtgtatgttgcatctgatgatgtctttatatggattgagaagtgtttccatgaaaaccaatactaagacctaaggtgaatagtgaatactccctccatcccataattattgttgtcttaggtttttttacacagaccaagaaaaactaataaatggatgaaaaagagagtagcaattttacataattaaccttatcatcattaattatttttagtctttgttgcccatcattaatattataaagtgtataagtggaaaggcaattattattatattgaaaagctaaaatgacaattattttgagacttattttttattcttacacgacaattattatgggacggagggagtgttggtaccaagcaagcacacaacaattgagaaaacagaaagagagaaagggaagaaaaaataacacacagtgtttaccctggttcacccaatgtgggttacgtacaacgtctgcgagcggcttatcttctgaaggcgaagtatgagccgtacccaacagggagtactattttctctgactgtcacccttttccctagacaaaaatcatcctattgggagtgaaaagcttagtttgtcttgaatatatgtattctggtgttgaaaatcatcagtagtatttcagtgggtgttttatctatatgtttttgttgtctttagaattaatttggatttggataatacatttactaatgggttggtgtggtgtaatttgttctttctcttgatagctgtgtcatgtgctggtgtagtttagaaacgttagccaacttatttgtcgttatgtgaaagtttggggttcttggtgtacagttgacgtatatttcacccttggaactgtttctcaagataacagcaatattttggcaagaagtcctttctgtgtgtgtgtgtttgtggtagagtcctaaatatcaagaatcagttacatagattatcaatagttagttacagagattggagtttggaaggataggtatttagcttaaataggaggagaggttggaacaattagttagtttagtgctagaattctgcagagatctttgatttgttggtattgctaaaactaaactactaaattacgaaccccattggccggaggcttcacgctatgcgtaggtaaggagaagggatattgtacgcagccttaccattgcatatgcaaagaggctatttccggattcgaacccatgaccaacaagtcaccaagaaacaactttaccgctgtgctagggctcgccctctttgccatggtggaaatacaatacattatttacattattcgaattgtctatatttattgtttaaattggtttgcattgctgatggacattgttaaaaacttctaaatggttagttgtggatttttttgactcactattctttgattatttgcgtttttgaagcaagttgctttctgattttgtattgtgtttgtttttgaaagtcttcatgcttattttgtttttcaaacaggggtgcagcaagaccagggatttggatagtgaggagctattggagcagttgcctgctttgcagcagctgctgtatcgacttgttggttgtcgggtaatattgtgaaatgtggatattcattatcttatgttattatttttttaatttcaccagtttatatcatttggtttaatgattatttatcttattactgcttttttgtagtattttctcgtacaataaaaactgattgtatgcttcattttacagccagaaggagcagctgttagcaattatgtgatacaatatgctcttgccctggtatgttttgttgtctgtttatctaaagatcctctttgtattgagctagagatttagagtttacagataggatatataaacgtttggaatgtaccatctatattagatttttctgggcagagaaccagagagcatttatagcgcatggttgggaaagatgggggattctttggtttgactggaactgtattggttgatcttgaggttgtggaatactttttcttttatttcatggattgaaacttttaagatgtgaatattgggattagaaattgaactttgattggaatgccttccaaactttcacaaccatttattgatgcttcttccatttaaagtaggactgggactatcctccatatttggttgttgataattggaattgatatcaaattgctacatctaaaactatgtttaggaaagggaaagcatgttggcaaattatcatcatagttaaacgagtccttgttagtaaatagttgtgaatttggagttgatgtaattgatcaccaacttgatattgatctgcttcttttgttctttctaggtactgaaggagagctttaagatttattgtgctattaatgatggcattatcaatcttgttgataaggtaaatgggcttatcattatttacatgatgagtgtcaagtttaaataaaatgtgttttatactggaaaatgataatttcctttttgtagttttttgagatgcccagacatgaagctattaaagcccttgaagcctataaacgtgcgggtcagcaggtgatattttgctgcttgtatttctttcagttaaccactggcttttgcattttaatttcatgatttgttgcttgtataaaacacccaaactgttgcaggcagcaagtttatctgatttctatgatgtttgcaaaggattggaacttgctaggaattttcagtttcctgtcttaagagaggtatgcctttatgattatggcaatctcatgctttgatttaacaatttattcctgttcattttcaatttagggttccaattattttcattgttgatctttttagcctccacaatcttttcttaccaccatggaagagtacattaaggaggcaccacgagtggttacagttccaactgagccattggttagtacatcatttattgtgtttatgtagagcatagctgttatatttcctttgtaaattgatttttgcaatggttatgctgaacatttgttggccaacaatgtatgcttttccttgttttctttcacattcaagttctagccactaatttattgtgctgtatgaacagcttcagttgacttacagaccagaagaagttcttgcaattgaagatgccaaaccatctgatgaagaacaggagccaccagttcctgttgataataatattgttgtctctgattctgaacctgcacctccaccaccaccaccaccttctcacaacaattttgaaactggagacttgctggtaggtttttggatcccaaagttatctgttattttttgtatgatttattttccttatgctgtccttgttgcagggattgaatgacactgcacctgatgcatcttccatagaggaaagaaatgctcttgccctagccatagtccccactgaaactggtgagttttgtttttggcttctgctcaaactctgctggttagaaaggtttagtggattatgttccagttttgcttatctatgaaatgtgactgtttcatgcatataggcgctacatcagcttttaactcgactgcttctcaaacaaaagattttgatccaaccggatgggagcttgccctggtcagcactccaagtactgatatttctgcagccaatgagagacaattggtaggggaccttcaagtgacctttctagattgttaatattaattaatatccattatatcatcctatgaagttacattgttcaataaattgtttgttggcatatactatgaagtttactcagttgtcaatatatattgcataaatttgatttggtgttaatctactgtttcgacggacaaatgtgcattacatgcaggatttgaggggtataaataatttgattgtttatatctgctcttaatatttttaagacatttgatctgtgaatatatgctttttctcataccaatagggtccatttgttaatattcaatgccactgtatctgataaaaaacagtgtagatgcctagatggtccatagtgaatgatgagaataacataaatctctctaacttgagctgtttgtcatattttaccattgaatgtcaggctggtggattggactctctcactcttaatagcttatatgatgaagcggcatatagatctgctcaacaaccagtatatggagcaccagccccaaatccatttgaagtgcaggatccatttactctatcaagcagcatccctcccccacctgctgtccaaatggcagcaatgcaacagcaagcaaatccctttggtccttaccaacaaccatttcagccacagccgcagcagcagcatatgttgatgaacccagcaaatccctttggagatgcaggatttggagcatttcctgcctccaatcctgttcctcacccacagaacaacaacccatttggaagcactggcttgttataagaatgcctttttgaacatacaaggatgtatttaatcaattaagttggttggttggttggttttgagcaaattgtaatatgtttctcatttgttgctagatatagatgttttctggaatgggagttgtgccttgtaaaatcgagacaacgcacacggtgtattaatcattttatgatatacataatggtgggatagctttctttgaacatttcccaactcttaagtaattggaacacttttacacatgttcatatatatcgtattcagtattcatggtatggttctacactttgtattagattatgtgtcagtgtcacgttatagctttcatttgacgtttcttgtttataaatgggggcggggggtaaaattggagcagccagaggttgctgattctggtcatatctgaccaatgccaaattgccaatgattcagattggaacactaaatgcatactagtatgttagatttgatgtttgatctacatggatttagaggtgtactttaaaatataacgtgcattgtactgttgacaaaataaaaagatttaaaattatgcaaaatgcatgactttgggttgaaacttgttggattttacattctagttcacgggttagaactgggtcagagtcagtgatccgaggttgaagataactgcaaatgcagtttgacatttgtcgttttatgtgttaaaattaatgaaacagaaaccgcccgtaagcgaatttagcgcagtgtcaaggtgcgtttcctatagttttttgtctgagttcgaatctcgcagtatagggtttgcctaaacagctagttatgttggtgttgagtagcaattgtcacgactaaacactataaaagtgaatgaacagttcacaatgagccattaatgaacattaagtgctggctattgacgtgccagcccatgtgtagatgcaatgatggttgatagtttgatgacttaaaacaatatgaacacgaaaaaaaatcgttgcatgtttatatttacataatctatgacttagaattataagttgatttaccaaatttttttttgtcaagtttaatttttaatttttaatttttatcgttgcaaattatcttttatattattataaaattatgttattgtaccatcaagtacattaataaactgacagaattgttataatttaattaggtattgaatttaaatcctaaatatgtaattgtattttttttttatttaaaaaaagacatgcaattgtgttaattacacaaataaacttaatttgtcatatccaatttgatgttgggtattgatcaaaccctcaaaacaaatcaaatcaaatgcggaagggaaaaataaagacacgagaaaaacaaacaatcaagttgtttaatttgagaaaaccttcctcaatgtgaagaagtaaaaatctataggatactaatctaaaatcaaactttcattataacaataatgattacataagatcaaatatataccaaagtgatggttcactcaacctctcaaacaatggtgataatcaaactctctaaagtgtttcactcaaactttctctaaagatctcacaaatgcaaaacacgtaggtttgctcaaatatgctctcaagaatgtcatctctcgtctgaatctctctatgttgcgttgtgttttctctcattctctcagtctgatcttatctgactctaacctaatttcatcctcaactaatgtatttatattgggaaattaggtttgaggttttagacctctcaaatggacttggaccagcattggaggagtaaatccaatccaacacttgattgtcttttgtgaaagatataaaattatgagataattttaaaagaacttaatctcttataaatgaacaagtagccaaagcaaacctgtataaatttaaagttatatattaaaataataagtcatcttattaaaaaaatgtccctagacctacaatgtaggtctatccctgcctataagaaagagaaaaatgaaagtgttgttctaagttcaatgatgaagtttgtttgagcatgcttactagctactgtctaacaagtacttgagcacatgaacttataaatatgagtacggtgcacatatattactttcaggataatagttaccccttgtgtccccgtgcgtctgtgcgtgtgtaaatttgtgtggtatggcatcatgaagtgggaagagaagagactcaggaagataaagagagggttattggtaggtagaaggagaggcatcaaagagaaaaatatggttaagggaagggtgaaaaaggcaaggtgaagaggggacctttgtcctacacatcctaacactttcaagtcatcatcattgctaccacatcccttcatgtaacttagattaattaaaattaatcttttatttttcttggtaaaggaaccatgagtaatatcctatcattagcacttccatgattcttactttctctccattgtgtatttttttaattttaatcctaacagaatcctaagttttaaaataagagaaaagataaaaggcagtatttctaacgtactttgctgcctaaagatgaaaaatataactgtttggaatcttgcaaaaaatatatatcaatttgctttctgtaggttcattatatttatctatatatccatacttaaaaagaaaaggcattactcttaatttttattttcctgacttagactgttatggctccgcagacagcaggtaattcacgttagtgagtttttttatagaaataattgtttcttaattttatataaaaaactatatatttttgaataaattaaatcaaatatgtatatatatttttcaataataaataaaaacttacaatgtgccacaagaattattaagttggattcattgaacctttaaactttggattacagaaggaaggaagataatatgaccctttatagtttnnnnnnnnnnnnnnnnnnnntgtctatttttaaaataaaaaattgttctaatttttattcatttaaaattttaagacattattaagtattattttcaatatacccttattatattcatttaaatattaatattttatctacatattataaatgtgagagaaaataatataaatttgaatatcagcaaagaaacatgcatgtagcataatcattttgaaaaagtgaacatttggatcataatattatctaaatgccaacgcaacttaatctgagatgcaatgttttgtatcattattcaccatgaacatttcatagcaaaccattgtttttataaaaaaatagacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattaaaattgtatttacataagaggtatttgaaatgaataaaaaatagaatttaaattctatatattatcagtataaaaaaattgagaaatggtagtgaaatattagtgctctttaatatactctttctaatacacttcactatcattaaaatttattaaatcttacaaaatcaagagaatcattaaatgagaagtaaaatctataaaaaaatataattttcaacaaaattcagctaataaaaaaatatgttaaagagtatgttattaatatatataaaaaagttttattttgtaagttaattaaaaataagatacatataacttttaaatttaattattataaaaatcaaaaaatttagtgtatatttctatttgggattaatgacaatacaaaaggaatttacactatttgtatatgaactttttgctctagacaattataataaaaaactaaacaatcattcattgtagaagaagttacaccatgtgtgtgttgtgtgtgcgcaggtgcctgcgtataaagatcaaataacacaaggcattgaacttagtaaaatcaaaagtgaattttatcaatttaactacttccttcatcctaaaataatagtcatcttaaattgttttattcaaataaataataataataataaataaataaaagataataataatttattatttattccataaattggcatgggtttggtcttggtgtgagattggggtgtcagctgaaaacataattgggatgtgacaccttgccttgtgctcttatcattcttttaaaaagatagtaattttataaaattagtgttaaattatgattaatttatttatagattttgttatccaccattaatattataaagaatataagtaaaaaaataattaatgttacactgaaaaaactaatatgataattattttaaaacaaacatttttctcttttatgacaattataatggaacaaatgaaatattgaatttaaaattctcataaatatatcaaatatacaaaatttaattggtacttattgtcttattttagcatatgatatgttatttaagatataaataaaaacagttattgttgaattatatattaataaatgtctaaattataaatttttctatgtacaccatcatgattatatcacatgcatcaaacaattgagttgacaaaaaaatggttattgaatgtgtcattttactctatgtttaatacttgatggcattttatcttgtctcgtgcacgtgtgcttatatataatttaaaaatgactatttagattacttgttcgtgatacataggaagttttttaatcaagaatgttttattataattataacaaatgataaggtgaatgcaagtagctaatgaatttactgaataatagatatgggtagaaagatttaataaagcttttatcaggatcgtttaaacttcttaccgatgatgttaggatgttttagcaatgaatattgagtttcattgatcttgaaaataataaattatattatttatatttggtcttagaaaaggtattataaatttaaatattaaacttccgactaaattttaagaattatgttgcatatataactaatgagattaaggaatcataaaataaataacctcataatgactttttttcgccaaaatcaccactatatgagtgcataaaacccatcaaatatgaatctaacttcatttttacacttccttcatactctcacctatttgagtgtaagagtctttgcatgtgatcatcacgacattaccaaacttgtctttttgtcgtactttttgctgtaccatcttcaccaaccaaaaattgtctttagtctagttcatgccttcttgatattttaaattaaggaataaatgtaaaaatatttgtatatgggttcaaaagaacttgtataccaagaaaatattagtaaaaattatcttgagcattaaaagaagatgcttggattatgcgggagctaatcacacgaacaataggggaagtctatgctttaactatctttatcattatttgattttctagattaatttgaatttaaaatttccttattcctggtttttgggaaattttatttttcttttttactaaccatttaaaaaactagcatacactaattcttttagagtgccttcattaatttatttgatttagtaaaataatacatgacaattgacaaatctatgaaataatactctatttatcatttaattatttgttcaacttgatacattttcaaattttgatatgtaatttgtgattttttttttgttgtaattaaagtttaggtgaagtggatctgaagagtcttcagagaatcaggacagatatcaagaatctcatgtcgatatcaaaaatcaaactcacgtctttgtaaaatatatgtatgattttttatcatttggatcaattttaattggaccaatctttattgacatgatgtattattttctaactttattggttatcacttattaataattggaattcaatttattttttaaattgacataatggtttaatattgttttgattgcatttccatttctaccaccaaacacctgaattatcatcttttttagttgggacaatttttgtcccatttgggtgatcggacccttaaatgcttgctgattgttgtttataagagttaattttgatttaaaaagattaaggaatgaaatggtgtatgattattttgttggagtctgaattcacttcattctccagattagttctaaaaaaggttaaaatgatatcagttcagaaatacaaagcattgaaagaagtctctgtcgataacagatgtcctttcactcctttgctatgtttgtatagacatgatgtcggtatcattcaaatccatgatattcggtgcctaaaatctaaacaaaaaataaataaatagaattaaagaaagaaatagcaaatatccatcaagtttagtgtttattcactttattggttgggatatacactgatactgtggataaacacagataactgctggccatctttccctaaccaaagcaaaaagttattattggttctttgtccatagtccatacgtggatatttcgttatgatttgaaagattaagatggcatagcatgaacgttattttttatcactaaacctctttctattttgattacaaaacattttttattcatcacttagtaggtaaataagagattacacatataaaagtatagactttttttaaggatttttttatgctcatatatatctcaaaaatagactcataataaagttatgaaaaactaaacccctttcactggttaattagctaggaatgaaaatttgggaatatttaattacaataaggtttaatcattctaaagtttttttttaaaaaattttattttttcctatttatgttcacgaaccaaagatttagacattctaaccatcatccattcttatctcatctataataggatatgatactttatcataaaactagttaaattgaatgaatgacatatgtagcattccaattaaatttgtacgtaggccattaaacctttccaactcactcgtactattaggactccaattcaaagacacatcagagcgttatatatgttagaatatgatatttgtatcaatcaattaacttaaaacagtaattagcttaaaacaacgaaactcaattccacctgttctaatgtctaagatttcaatgtaatagtaatgtgttgtgcatttaatcttttattattgtcacccatcatctttttctactattcagtactttcaatgtaccatttttttatataaaaaaagtgaaagaagtaaattgcaattagattgctggtacccccttcccgcattaaaatccaaaggcggagttttttttggcaagttcaatcttttttgctaagtcggagtttgctaaaaggatgttattttcatgaatcatgatataacgtaaataaggttgtaatggttatcattgaaaatggaaaatagggtccatttttatgattaatatgtaagattaagcaaaatacttcaacattcgtttcattatgttttattaatttaaattttgttgggtgatgtctttttacccacgcaagccgtttagatgaggcctatacgggtcccaatctaattgatcaattagataacaaatgcaattcgtgagttcatttttagcttaagtctccaaatttgaaaaattcaataaaactttttactaggagctatttgccccataatttagactatttttcaacaataagtggaccaacataaccaatcttttgcgtatattattcttattcacatgtttttttttattaaaaaaaatcaaatttctggatcatgtcatgtgttcgaagtatgggactcattagcctcctgaattgcaaagttcatgaagaacaatgacattttttaagctctacttttgtttaacattctagatggttgataatcttttgatcagaataagggggaattgagattaagaaggagcaattatgagggcttccaacagaaaacaatgacattttccaatcccttcttttgtttcacattttcaaatggttatggttctttggtcagaaaagggggaagaaaatgggattgagaagagcaattaagagctcccaccagtgattaactttaaaaagtgagttttgctttgatgttccttccaagaaagatagtctaggtttgaatttaaaaccttttttttttcccgttttctttacttctttgcgcttttgcctaatcaacaatacatcataataaatggtcccatctttccaaccttcatttaattgtcacatactctagcacctttctcattaactttcaaattacacaaatacttataatgcaacccattagcacaaatattttatgggaaaacataaataaatttaatatttgccacagagcattctatcaattgaactttgataaataaattagtttattaatttattgtacacatcaaacaacactgatgataggaagaagggtccaactttttttaatttgacataaccataatttacattaaaattaaaatttgtatttttaaaatttaatatatctctccgccaagagcttgagagagatattaagatttatttaagatgttgatttcttttaacatatttttctttagatactagtctaagattgaatccctaatcacatttaaaagataagattatttctccatcatatcacattattttaattttgtatttttggatatttagatggatgtacattcaaatattatcatcaataggaacaaaagtgtgatcatatatatatttcctttgagctggcatatatgtactaaataaattttataatggcagcccaatttaggttaattaaattagcattggggggtgggggagggagaggtatctgctcaattataaccagtagggccaaatgagagacactgaaaaacttatggtgtagtgcagtggaaacttgaataaagcaaaagcaatttgttggagggccaaagcacaacattcaccaaggtagctatagattccttttataaaagagatatggaaatgtagatattattttggaaagtacatatgggtgtgtgataatgtatgggaacaaaattttgaattgtcatcaaattatattttataaaacatagggtgctattgctatggcaattagtcggtgagtgacggtgcagccatgaccccaaaagccaaattcatccctgttggaccccaaacatcggcttcttaaggctacctttctctagggtttaattggattacttaactagtgagttatttcattgttcatccaacatgaatttatggtaaagaggacaaaaatacaataaaactcaaataattgaataaattatttgatgcaagtttattttaacatagaaattcacgaattacaagtatagaaaaagacaaaaacaataattttattagaatgtcaatagtgtacaaaaattacaccattatctaattttgaattttaaaataattgaaattatatttatgttaatttttaatatgttgatgatgtaaaaaaaattatacaagtagtgtatcaaaattaaactaaaaaaaagttgtgtatatggttataaacctaaaataaggtaactcgtattcttgattgaggggggaaaacaacaaattttttataatattgtccatctgttgaagttaattatcagctttctcttaaaaggtgtcacccctgtgaaataaaattggcacacaacaggcttgtcgacaaagtaaaataagtgcaatttaacttttaagcagctatcttgcaaaccagagtttgattttatacatgatttcattggctggaatgagcgtatattaatattcatataaagaaaacaaagtttcttaggaagcatacccacataatgacttaagcatctgcaggtataacaggccccactcctcactttgggtctggtccaccagctcatgtgtgtggtttggtgggccgttccattttgttacctcaatagaaaaattgaagaggagctggcagcaggatcatcaaaataatatttttcagccacagaaaattctagaccttgaaaaagctcattacaaactcaaactatctagatcccaaaacactaatccacataaagcagtgattacacaaggacagtttcacattttctgtctgaaaaattcctcaagtttcacaacaatatttgtctttaggtacaaatgtaaaattaccaacatgatataatagtttgatagataatcatgttcctcaaacatttaaccatatgtttatatgtatgaaataatatacatgtcagaaaatattattttttaaaataattttagtatctcaaaattaatttttagcttttaattaattgatacagtaaaaccatttaactgttaaattgccatgcttcattttgtcaaaaagcattccataaataatgcttagaaaaaatatacacaaaattcttttattttctttgactcaagaacatttcatttcccccccttaccttagtcctctttggttatcattccattcaattcaaaccgcctatttctcactcagtctaaataaaaccacttgctatctacttctcttctactctctctctctctcatacattacacacccaaaatacagttttgacatcttgtctgaaaactctctttcccttaaacctttttctctgtctctcattccaatacttgcttaggttccaatctgatattccaggtaaacctttctttgtacatatcaaaaaaacagaacaccaaccatggcttccaacaagtttgcaaccatgttgcacagaaacaccaacaaactcaccctcgttctagtctatgccatcctagaatggattctgatcatcctcctgctcctcaattctctgttctcttatctaatcataaagtttgcggattactttggcctcaaaaggccttgcatatggtgcaccagaatcgatcacatcctagagcctgggaagtacaagagttcttgcaaagatcttgtgtgtgaagctcatgcctctgagatttccaaactggggttctgctccaatcatcacaaactggctgagtcacaagacatgtgtgagaattgctcatcctcgtcccaaccagattatgtcaaactctctcagagttttggtttctttccatggatgaagcagataggtatgattcaggatgagggtgctgaagatgctgttgacaaggcaattgtgaaggttgaagtggctttgaggtgttcttgctgtggtgtcaacttggacacaagattctaccctccttgcattctgatcaagccttctctcaatgttttggagtatgaccagaagcagaattcggagagcggggttggtgtagagattgatgaagatcacaccagatcggatattgtgcttgatcatcatcaggatgaaaaggagaatgaagaaaacaagggaagccagatggtgtttgaggttgatcggggtttggatggaaaagatgaggaggcagagaagagttgtgattgttctgtgtgtgatgctagcgtggagattctgtgtgatgaaatttgcaagatggatttgggtgtggagaaagggaaagaaacaattcaagaggaaagtttgaatgtccctaagcctaaggataatgatggtgatgatgttgttgctgctgctgatgatgatcaagcttgtgagaaatccactgctcaagttgattgcactagagagataactgtggagactccacccatacatctggaatttttcattcatggtgatgattgcagattgattcctattgaagtggttgactcccctgccccagaaaacaggaaacaaagcaaatataaggtgggacgtgaagggctcaacagcaatgaagattttattctggactttgataagagtgctgatgcagaagccgaaccggttgtggagaattggcacatttctggggatattgtggcagaattttcagcacaagggaatgaaaatgtttccaagtccaatgggggtgaatcagttcaattaaggaccagaggccagtcttcagagctgttacaagtagaagaagaaagtttggagcagaattgtgaagatgtgagatttgttcaaacctcggaagacttgaccaaggatgataatgttgaagtaaacatggaaagaagagatgcagaactatgttcagatgtttctctaggttctaattattttcctcctcaataagtctttttagttcttatacctttttcttctggattttctatgtgcaatgatctctaatactttcttaattcctgcagcatctgaagatgcatcacaaatggaaggtgaggaatatgaagcagaagtctcaatagggactgaaattcctgatcaggagcaagtggatgagtatcaaagccaagatgttcttttggatacaaatcaacaaatgcaagaagatccatctactagcacagtcagatttaatgtgcaagatgaaattggtaggcctcaactttttcttatcttcccttttcccaatgtccagccttaaaactttctaaataactcgcttctttttattggaatttataactaggtcatgacaaaggtgaagagtttatagaattcaaaaccatgtcacttgaagtgaaaatgccaacagtaaataaccatttgccatctttattggagcttaatgagaatgaggaagaaaaagttcctgacacacccacttctttggagagtctacatcagctacacaagaaactgcttctccttgagaggaaagaatcaggaacagaagagtcattggatggaagtgtgataagtgatatagaaggtggtgaggtaacaattgaaaagttaaaatcagcattgaaatctgaaaggaaagccttaagtactctatatgcagaactagaagaagagagaagtgcatctgctatagcagccaatcaaacaatggcaatgataaataggcttcaagaagagaaagcagcaatgcagatggaagccttgcagtatcaaagaatgatggaagaacaatcagagtatgaccaggaggctttgcaactcttgaacgagctcatgatgaagagggagaaagagaagctagagctagaaaaggagcttgaagtatatagaaagaaggttcatgaatatgaggtaagagaaaagatgatgatgtcaagaagagatggtagtatgagaagcagaacttcatctccctcttgtagcaatgctgaagatagtgatggattgtccattgacttgaatcacgaagcaaaggaggaaaatgggttttatagtcatcaagatcaagaatgcagcaaccagaacacccccgtggacgcggtcttatatttggaggaatcattggcaaactttgaggaagagaggttacaaattctagaacagctcaaggtattggaagaaaagctagttatattgaattacgaggaagatcactgctccgatgatgctaaatcagtagaacatctttgtgaagagaatgggaatggataccatcatgatcatgatgatcacaatggtcaggtaaatggatttgcaaatggtcatgtaaaggaaataaatggaaagcatcaagggaggaaaatcatgggtgcaaaaggcaagaggctcctcccattttttgatgcaatgagttcagaagcagaagatgttgagttgagtggagacgagttagactttccccacttgcaacacaattcagttgaaaaggttaattcggataggaaaaaacttgctttagaggatgaggtggataatgtttacgagagactacaggtgctggaggcagatagagagtttctaaagcattgtatcagctccttgagaaaaggagataaagggttacatcttctacaagaaattttacaacatcttcgtgatctgaggaatgtggaactccgggtcaggaacatgggagatcttgcagtataagaagtctccatgctcaaattttccaaagagatgatataggtaaaaaataatgctgatcttgctctattagaaattatttatatttctcaatcataatatcatttattgatgagtaatagtatgtgaaaccttcttatatgataagtctattaacttttacaatatatatcttaaaattcatatcaatgatgatttttaataaattaatactataaactattttttatagcgacgatgcatagaagctaaactcattatttatgcttataatgtagatttgtacattggagttgatctactagctgcaaatgaagcatgcatgcgtaccactgtggtctacatataatagagggcaacaaatgcatcacttcaattttaacaaaaaaaagtcagtgggagttccctgatggagaggggagaatccaatggtggacaagaaaactgaagtctgccattctcttttctttgtttcttttgtccaggtaagcccaaatttttggtgggttgtgcccatcatcaccttttgtgggaaagggaagatgatgagtatatgtgtgtgtaggctagtgaggtgaagccatcctgtccacttgtattttgtgagagcatcgacctggcttgcaaagctggacacatcccaaaaagattccagtgccaggtaaaatagcactagtttattagacagacagaattagggccactagttttgtcatttctttcattttttttcttttctttttttggttagagtgaagattgaggaaagtagcctctctcttttctctttctcttttttttcttttttctttttttcattcttgcgtcatcctttgaggtttgtttatttctgagggaaaaaaactgagtaacttgtatactacatgtattcatttgtaattatttataaaaaagtgagtgtttgtttatatatatactgctcggaatacatactgcttggaaataattaactttgcttcttgttatttttttaaagcttgtgactgagatagatgttttataaacaactaaaaatagtgaatggaatatttttatttgattgtttaaggcttacgctgctttcacattgaaatatttgattgcgctttaagcaaaatgcaacttcttgttagattagattgaaaacaatacaactatagtaaaataataatcttactaagttattatactgcgctgaaaacaatagaaggatggcacagagatacaagggacagaagcgtatttgtttattgataacaaatcaaagcaaatgctttaaaaagtgtgaacagcgacgcaacaattgccaccaaagcaagatatttcatcagtcatgtcacccttggatttattcatgaaaaaatggctcatgaaggattgaagatggcaatacgcaataaattgcctcagaaaaataggaaataaatttaatgtagtttgatattttttacataaatctatgaaactgtctcaacaaatattaatgcacgggacttacaaacattgaaaattccaataattcgtttctaatatatattttatttaaaatttataatttatatcccaacgcaatttttgtgtattgaagttgttcgatattctggttcaaaaattaaataaaaaataagtcctactatattatcattattttaacgtgaacaaaataaactaaaaaagtcttcaaaattaaatcatacaattgcaggggactcatgatttctttttcctcatagcgtgaaggcttactgtagttaattatgtttaattgtttatgtttatgtttagggatagggtagcatgtacagaggagaacttccagtgctggtgagtaggtagaaatttttgaggaaatattcctttcttttggtgatgatgatattggtagggataaattccttcgggtttcggcagttgttaaaattaagtttaagtatgttttacttttttttttttttnnnnnnnnnnnnnnnnnnnnnnnaataaataatttttttatatgtatgaattaggaattaaatctataattacacacttaaagagtaaagttattaatcaaatatatatcaattatgttatagcatgttgattaaacatattttacttattttcattatttatgtgtgtatgaaaataatttataatataatacatgattataatttgatcaattatttgaatttattgttaataatttttataaatatataagtattttaaaataatacaattatttattatgtgtttcttaatcaaaattaataaataattattataaaagtaaatagtacacatattaatagtaaaaagactttttatattgttattttaattagagattactagtttattacgtcttactcattgttcatttttacaattattcattaactattcactctcttactcttaaagagtcgactttaacatcaagaggaataaatgattcgaaccttaatcgtgaaattgtaaactgctagtagtagatctcgccttctgataaacaatttcactatttaattttaaaagggcaatttagacaattacaaattactctttaaaaaataaattcatttacaaatatttatatcaaaaccatgtaactagaaatctacacctttcaattttttaaagttatatttgacagtcataaaattgtatatcaccgtaacccagtggacatataagattgatctagattgaaaaaaaatgaaagaagaataaagaaattgtaggtttaaatctcctcaccagacacttctaataaaattttaaaactaatatttaccataaaaaaacactttaagtacgttcacactagcctaggtagttaatttgacatgtgacaaaaaaaaggaaaaaaaatattcttttattaaatagtaaatagattatacaaacccgaattagtgagggaaaaaaaattaaaatataataattttaataaaaaaattacgaaaatattatagtgtctaaactatttacaattgtatagcaatcaatcacatcctccttagtcttggtcaaattacgatttaatcttcgaaccttcaaaaacaaatttggtttctaattttttattttattcaattagtgaattgcatgctattttttatttttctaattacttctcttaatttcactccatcggacattccaatcaaaagctgcaattaattaaaaaagcaacaataacactaactgattataaatttaatccttgtacttgaaatcattttttttaacagtcccgtccattataagaagtatcattgtgttaaattaacttgacactcattttcgtttaaaatgaaatttgttatttaggcctttatgcaaaagatactctaactccgcaattaattcatgatttttcttaaaaaatattagggtttttttacccaaaaaataacattgtcataatcattgggtttaatagaaaaaatataacaatttaaactaacaataacatgaaataatggtttaatagaaacattgatgattaagtctaataattatctaagtgaccatacttgcaaacatgtagaaaccacatcatgtatcttgttagactgaaacaactctcatttcaaatttgaggttgtgttaagaaacttccaagctatgtggggctcagtgaagttcacaaaagcgtaacccttgttcatcctagttctgcaaagcatgaaattaatcatcaataagcagtttccacacatatcacggaaaaagagagtgagagagagaaaggttagttaaacataaggaatttgaaattaagaaaagtaattaaaaaataaaaaatatcatgcaatgcactaattgaataaataaaaaattagaaaccaagaaattttttgaaggctcgaagattaaattgtaattttgaggtacttagagacatcttttgggaaaaaaatttgaccaagtccccttacagacttgcttagagcttctcctctcaatttcgagcgtgtggccactagtttcacctcaatcggacactacagtcaaaagttatgacctttcgaagtttatgtacatcgctccgcaaaatgacacgcgtctcaaaatgacacgtgtcaacacatggtgagtcacgtttggggaggatgtgattgaacaccagtcacacccaggaaggacatgattaaacacatttagggagaacgtgattgattactatacaattgtaaatagtttgaaattataatattttcttaatttttattaaaattactatattttattttttttgccaattacaaagtcatggtgtaccttaattagaaaggactagactacatacgaccatatattttgatattcttattactgtatggtatatttgaaaggaaaaaatatgaatgatgaaacatatggtcgtcattttctgtaattttaagagagacaaaaataataattctataattttaatttgatatatatatatatatatatatatatattattttaatctctctaaaattaacgagttttaatttttttagtgtcccttatacctcaaatgattgctaatgttattattgctgcaaagtcagtagcattcttctttgttttgctttttaaacataagctaagtttgataaaattagctaaaagttgaaaattgtaaagtatatttgataaaattatttgttgaattaactgaaaattgtaaaataataaaattgtaaaaagagtaattaagaaattgaataaatatattaaagataaaaataaaaaaagaatataaaaattaaaaatataaaactaacactttaaaaaaattctatttcaagtaatatattattaattagatttttgtatctaaattatttaataataaagcatcgatactaaatatagtggcaaagatgatgaagttaaaacacatatatgttgccattaaagcatctttaatgttacatcatnnnnnnnnnnnnnnnnnnnnnnnnnnnnnnnnnnnnnnnnnnnnnnnnctctctccctaagatttcaatttgagatctagcattaaagaaaaaaattagaaagatcttgagagatctttaatcctatgtggtactatagggtccacaaaaaagtggtgtaagatctcaatttaagatttatcattaaagatattcttagaatatcaactttttaaaatataaattatttttaacataaaattagaggcattcaataaagacaaaagatatttttaccattgaaatataaacagatcaatttgcaaatagaaagagaggaaacttaaaaagaaaattgataaagcaatatttatattattaaatgatttcttgatctctcatatacttcacaataattattattatgatatgcctaattaacaagacacattgtatataagataaaattctgataaccacacaatcataaatttattgggtgaaaataagaaaataattatttatttattcctccaatcaaaattaaagaagatttttttggtaaattccaatttgtgacaacaattatgttgtcctttaatgccgagctcatgaaccatttgggtacataaatcaaatgaaactagttcatcatctttttttttatggagaatatgtagtttttctttcccactccaataggacaataaatgcgaggttagggtccaacaataaaaagtgcagtccatgattccttcacaccaaattcactcaaaactgatatgcgaaaaataggtgtctccacataatatgatattaaagcaatagagtcatttaacactgccaagtacctgcccgttctataatcaagagtgtcatttggtgaattaatgagtactataatatcatccatgtcagagggcatagatgttgtagagaacacctcattgcttaatagattcaaatgacaccaaaaatttcccggttgcactttcaccctgccaatgacacattccatccatatacacttgggaaccttccattttatggtaacaattaggcatgtcaacatcaaaagtgtcctccaaaagttacttcttaaactttatatttcccacagtgggtcaagagatatatcttctcatgacacatcttcccacgacacaccaagatcatcaagacaagatcgtttagtgcaaaaaatgttacatgtcgaatcaccttaactataatcataacaaaatccttaaagtttgaccacagggtttcagtaaggtggtatagattcaacaaggcctggcaggaatataatgacattgaattcctcagtgattaggttccacaatacaattgttgtccctcgcatgagaaaaacagttccattaatattgtcagaactcatcattcgaacataactgggattctctcaaaatgggggtggtcaatctaacttgactctcttcttaaatctctcaccagaaaacaaatacttgaagaatctaattcacccatcgtagaaaatggtgcaagttgttgtaggatgacaaatgtatcatcataatattaataattattagataaaaatttgttgtgatacatggccatgaaaggagagttttcaaacaaaaggccccataatttgcgtgcatatccaaatctcttcaaagattttagaggcagttttgacaaaacaatgacaatatcatcaggtatgttttttttacttatctttgcctccttatttgttacaaccattgccatagatttatccttcatagaaggacttttgacaataaaattgaaaaaatgagattgagaaaattggcgaagccaaatccactcaagtgtagctgcaagtgtaaaaaatagtctcacctattggatttatatatatttttattataaattatatcttgacttgacttgactgaaaagtaattgtcaaattttgtatataaataaattaagatcatgtatgaagatattttgtaatatttttaattttttatttaaagacttcttcaatcttgtcaacttgcatttagattctacatattctcgtgtatcattatagtattttgttaattattattttattttttattttacttttaataacttgtcactacaaactatgtctggtcaatataatatttaatgttatgggtggtcaatttttcttataatttattagttatgatatttcttaaatataatatattcattaaatgtaaaatatttttaaaagaattagttgataaaatatattttaaaaatttatgtatctattaatgcaatattaaaaaactgataaatatataatattttctcatttttatcattaataatttgactacatattgtatttaatatatatcatttaatattattgggtagtcaattttacttatactatattattttagatatttattaaatataatatattctatgaattttattagtgtaatatatgttttgtaaacctattactttttggacagtcaattttacttataatatattaatttatgtatttattaaatataatatatttcttgaatttaacaaatgtaatacttgttttgtacatctatgactttttggacagtcagttttacttctaattagtaccttaatttagatatttattaaatataacatacttcttgaatttaataaatgtaatacatgttttgtaaacctatgactttccatatgaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattgcaaagtgacatgtaatatctatctatatacatacatacacagacattaaattttaataatttttattattttataaataaatcttttaacatatttgaaaaaataatatttcacttgtctgttaatataagttaaatatattaataaacataaattatagtgtaaaaagtaattttgtgacatgttttttttttctttagttaaaactagacctcgaaccggtacacgggtgaattttgcgtgtgatgtaatattttatattgttttaaaagataattgttaataataaaataaataattagattctaaaattattcatgtgcagtatattatccagaatgtgagtttggatcatccctacaggactttagtttggtcaataaggctgttattggaaaggattgggttgtgtaagttcatgtttatcgttagacaaactctgttgtaaagtaatatacttttatcgagaatctctctctcaatttaatagctaaaaataattttacatcacaatttaaattatttaatattataaatctaaaatataatttataatactcaaatttatttatttattatggattttaattataactagtatgttttttgggtggtaatatctccattttaaactttattatcaaaaaagattattaataaaaataaaataaaaaattaatgatattaatcaacatattttttttaaaagaatcaaaataacttataaactaatcgattgcatgaattattataaattattttatattctttgattcctatgaataaaatatactaatttatatgctattaaaatattttatcaaccacactcaataaacaaaagtttatacaaaatttcacataacacgcccagaaagcatgcatccattcatacaagtgcaacaagctagtcaacctataaaggaaggtttcatatctaaataaaggaggtgacactccttgctttgaaaagatcatatgaaaaaaaaaacgtaagaaaattgtgttgtcgatctttgattctgggcagagtaaacaaactctaaatatctgttttcttagggttaacatatctctatattaatacattcatagaatacaatttcaaaatagagagtgtgacacaataaatttgatcaaatgaatgtaatttataatgctgaattttgcttgatttattgcttatttacaaacatcttgttaacactggataaccgtaggttattataatctagcaatctttcattttgtctttgtaatgattttgagcatccatctgtgttctctttagttagtaatatattgcttttgctgattaaaaaaaatgttgaatattgttctttataaggctaagttacaaaactacttaaaaaacacatggtaattttatcactaaacagttaatatgttcgtgatgggaatgcattcaaaacatgggagctattaccttacctatgactcgtgagttggatgttgaaacttgattggaatgatcatgacaatgtggtctcttttccgtacaacgtcgtaatatcataaagaattccgtgtgaaatggttacaaaagcagtgacgatatggatccgttctctcttgacttgtaaggcagaggaaacgatgagggtcccgaaacaacggaatcgaccgcgtttggttgaagatgctttctaagaaatagaataatcgtttattttttcttcttctaaactcttctgagattttgttttgtttcaacaaaatagtaatgaaggataccaaacatgtcgtgacattcgtcagagaaggaaatttttctatgtttcaatttttggattgatgtgcacatttttcattcaaacacttatgagattttgttttgtttcaacaaaatagtaatccagctgtctttgatgtgtttacaattttaactttaattatatttgagcctcaaagaaattaattaaaaattataataaatttcattataaaattatcaactcaaaataaaaaggtattaggaaataaaacaaacagaagggtctgaatatttgtacttttaaaatacaagtatatcttaataaaatacaaggaaacctgatatttttattgagtttaatttttagatattgtcaattatatagtgttaactattttacgatactataattaaataatgtttcagatgtgttttcaattaaatatattttactataaaatcttgtttgcattatttggtacgttctgtgtttgaagcatttaaatgtaaatccaaacatagcaatcatataatgtttcttataacgtaggcttagatttaacaaaatacctttttaaaaaatattttctcacctaataagtgagaacttgatccttcgagatatattcaagcacggtggagatattaaagcagaaatttatcctaacaattatatttttatatacataactttttttgttaaatgttaatcacatgctgaaaagatttgagtagcaattggaatattttgagagaccgcaacttactttgcctagtttaatttaatggtaaacgtgaccaaacatatccatgagttcaaacgtttagcaccattaatacttaagctcaaaggctactaaggaataacatttggtcttagttatctttgaatggacaaaggaatcaatcaatcaaggttcagtcaaggtatatactgcgaatggattaaaaaaaaaaagtatatactgcgacctcaaatattacctaaatgcaatggctagcacagtgacaaaatagatttaattttagaaaaattatggctttaaataattttttgtattaatggttttgtaataaattaatattttcaatatttatttttttgaaaaaagaagctacaagtctataactataactgtatttcattttgagtattttgtgatcaaatcgaataatttataaaactgtatgtatgtataatgtttttcttgtcattatgatgtgaagtgtctattactttaattgataattaatatttgcttgataatattgtgattatctttagtgagtttttctttcattcatttttttcatcaataaaatttgaatgagattttaagaaatttgaatataacttagcttgtgatgtgttggtatctatgatataagtagtttaatttttttttagttttgatgttatattagtgtaaatatttaatatattaaaaattattttaaatataacttaaaagaattttatataaaacttaacaataataatttttaatttataccatcatacacagtataaaaaaactattcgtattttcaatacattctaattaaacttataaaaaaataggaacatgcatgatattattaagttaaaaaacacagtataataaatgaagttatataaaagtaacaatacataagcaaacaatagaaattttaattacttacacaaagctttcattaacatttgcttttacttttgaggcatatttgaaaatgatcattttctttaaattctctcaatcaaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttgatatggcagagagagaaagagtagtttgctagagagagtagcaaactacttataataaataattactccactttccaataaataattgtctccactttcctgtaatatatgtcattcctttattttttcatatctttttaaactaaattgaatggtaacctacatatttttattcaaatttttattcaaaataattttaaaagaaactgtattgttttacaaaactaatttagttaatagaattaattttcaattaaataaaaaaatatgataaaaaaatcaaaacttttcaaattgtttcacttattttttttttcaaataattgttaatttaaaatttgaatatcttgaatcagttttaaatttataataaaaattagaatcattttaaatagattttctaattattttttatttttaaatatattttttatttagttgaaaattatttttattaactaaattagttttgtaaaccaatataatttttttaaaaatcattttgaataaaactggtattttgaatcagttttaaattgattataaaaattaaatcntttatttagttgaaaattaattttattaactaaattagttttataaacaatacagtttttttaaattattttgaataaaaatttgtcccttaccatccaatttagttgaaaaatttgcaaaagtaaagagataaaatatgagaaaaaggaagcagttatttattataataaatatataattcaagtaaatttgttgctgtgtagttggttgaaagatctaaatgaaatatgatgcgtgacactgataatatacacaaaatagtaaattatgtactgtatagtttattgggagatttaacaaaatatgatgtgtgagagtgtgataatatgttttgatagtagatttcagtaatttgtgtttttggtggggtcattgtctcgagaaaagtcaagctggcgtcactaggtcaacaagcgcaacacgcaacactcttgtctcttcccattgtttatgtatttattgttctccccgaaccaacaaaatctctatgttgttctcttactcgcgcacacctctcatttccccacgaacccatttttcatttttccaaaaagatctcaactttgcttcaaactagaacactccctcttttatgttcccgtttcatgggcatctctcggaatcgtgaaccatagacatcgccatggacaaggacaaggacaagtctcacactcacagctttcttcacagtatcgtcagacacttcaaattcggttcaccaaaaggtaatttccctttctttcttcttcaatatgtgctttaattttgtggtagatgagttttctgattatactaggattctgtttctgctctgttgtgtttgatcagagcaaaacaatgaagctgacatacaacaaatggctgcacaggagcagaagatctttgcctacgaaaccttggcagctgctactaagaattttagtgctattcataagcttggtgagggaggttttggaccagtctacaaggtaaattcaaaattaatcaccaattttcttatttgttccgtcttaggttgctagcaagagtggcataacaaaaaactgataaagcttttcaattggttgaagtacagttttctctgaaaaggaatcaaataatggctggattcaataacttgattggtttgcaagcatttggttttccccctcttgtggtgaattcctctaaaatgaatgttttttctattattctattttactgggtaaaatgagaacccatgactcattctaattagtggaatttttggggtttccttgcaggggaagctgaatgatgggagagagattgctgtgaagaagttatcacacacttcaaaccaagggaagaaggagttcatgaatgaggccaagttgttggctcgtgtactgatgaaatgaatcctatttttttaaaaaagttccatataattagggttgtgtacaaaccatgctttttgtctgtgtagcactaagtttagatgaaagatttagtgtgctggtatttgaattggtgatcattatttcacgcaaatgaaatggattttaattaacagtctcaatcaagataattaactatagagtctatattatttaccatgaaagatgtgaattgagtttttccttcaacccaatttcatttggtctagctgactgcggaacatggactttccgggcgtaccttttcaatgtgattaatgatcaaacaattttttttttccaccatcagaatcagtttttatttgcattattataactatgtgccgttcaattttaacttcacctttaccaacaccatggaccgccacctatccttctctacctttcttcaaataagatatatatagtatactaaaacccatggtggacctgagactatgaaagagacttcacttgagaccttgacttttatgcacataaaattattcatttatctaattcatcggatatcttgcgtagacaatagaatgttcacgacggaactcctcccattcatcttatcaaagccatgacatgcgacttttgttgaataaaccatccctcccattttctcttttccttgccaaacaagcacatgggttaattaataaaaggtagcatttgggagttagaagacgaactttcaagtttcgatcacactcccactttctaagaaagatagtggaaacttcctaaacctaaactcttcttttctagatatattaatattagttgtcgtggaatagtcactaatccctctaaatcagatcaagttaatattaatttaggaatcatggttacgtgaggcacttttatttttattttttaaccaactaagctgatgaatttcctcaatatttctatttttatggttaaaaaaacaaatattatactaaaataattgccaattaaatttatgattaacatttgttcttgctgttgttagagattaattaatttttttgaataacagtaagttgaaatggatgatgcagaatcacaaaagagagagcagcttgattggaaacgtagggttggaataatcacaggcgtggcaaaggggttgctttatcttcatgaagactcgcacaattgcatcatccatcgcgatataaaggcgagtaacatcttgcttgatgacaaatggacgcccaagattgcagattttggcatggctcggctcttcccggaagatcaaacccatgtcaatacacgtgtggctggaaccaagtaagcctatgtttatattcttcttttttctcaaaaagttttcaatgaaattttgaatatacttacgcataaataattgcatgttgatccagaaaataaaacaaagcaaaataaaatagttctttattcgcgtacacactaagagtattattcttgttaatcattttcatgttttattttggataacaaaatcatttttccttaattttggtgacaagtgtatacttattaaggattacttagagtgtgagttcattagcaatatatattcgataatgtaaaattgaattttgttttggaataaatatatctctcttccatgtatcaagctttattcttgtaaatttacacattaatttacaatattttataagcaatattttatgtaaagttataaaatttcatgtaattttaaaaataatcaacattttattttatcgtaatataactatcatattatttgtctacaaatattttattgtatattaatatttaatatttaatatttaatatttaatatttaatatacattatcattaagaaagtttgatcggcataattgcataaaaattatattgccaaccctcttttatatatcaccatatggtttttgtttttactataataaatgtttcttaaataaaaggcttttttatttttatccttttaggcttttagcatcaacacatggcacatcatatatcaaatcaccaaattaaaaacttacgtgttagttacgactcatcttgcatctatatgattagtcaaatgttttgactagttaatactaatattcttttggttctcataaaaaagtaatactaatacttgggaattatacagtgggtatatggctccggaatacgtgatgcatggaaatctatcggtgaaggcagatgtatttagctatggagttttggtattggagttgatcaccggccaacgaaactcatcttttaatttggacgtggacgtggacgcgcagaatctgcttgatagggtaagagccattattgttatttttttgacttccttaactttattctgatacgagggtttaggtatagttgtttctttatcacccaaatatttatcgtattcttttacaaataaatgcgtctcattgacattccataagttttgaggactttttatttgatcaattgattaattagtagcaacttgtcattggacattgattgataacccttttcagtcttcacaaaaacaactctaataacctctacacccccaacctaacttcaccattacggcattacctcatacctacataatcaaactgcgtctagaattcccattaagaactcaaccttttgccttttggccccaaattataaaaaaataccgagcacaatttgatttttgccttaccgtattttgttttatcggcaaatgttagtttttttagacaaaaaggatcaaatccgtgacccttttcatttttcctttttctttaaccatatctcctgccttaccgtgttgatgttggttataggcatacaagatgtttaagaaagggaagagcttagaacttgtggattctgcattagcatctacgatggtagctgaagaagtagcaatgtgcgttcggctgggtttgttatgcactcaaggcgatcctcagctacgccctacgatgaggcgcgtggtggtgatgctgtcgaggaagccagggaacatggaagaacctacaagaccaggaataccaggttcaagatacagaagacctcggagacactccgcattgtcttccacattgggtacctctggtgcctttgattcacacgcttcagattctagtaataatgataatacaacggttactactagtgccacagggactagctcagctactgcagaaacagaccccaaagggaaacgtccaatgcgggagggttagctagcttagtctaagttcatcatatggtgttttttgcaatgaaagtatatatgtagcggtgtgaactaaatagaatgtaaatagattgaggctaggaatggcgatcgaggctcaagtgaattcttattctttaattaatattttacaagtgagaaattaatggtcacaaattatgtaatctctcattttccgatatgagtggatcaaacctgtaactttcgctttgacatggttggagatctaaccaattgaactacaatcccataaaaaatggtgcacagtttatatattgttacggtttctttcaaaccctttttttatatttattttggatttgaaccatttttgctgtaaatgaaagaggtctaaaatcaattatttcatacgggtagtggaagcagagtggcagtagcagtagtgtagatttgcttgaaatcgttgaagtattgggcttttgccagtgatatccaaaccttttcattggagggaaaatagatattataccaatatgatttaacataattgataaataattgggtttattaaacatgttcatgaagtttatggaaaaaactttattagaaagagataaaacgaaaatcaatgattagtctaatgacttttgattataaaatccatgacgatacttgctttcggggaaacaatattttttttttcctttctaaagaataaattaatactaaaataatgctaaagaaaatggtaaaaacatacattttagaaattttcttttaaaaaaaattttgcccgtaagttctttaagtgaaaaaaaaaagtagtaataaaaggtaaatagaataaactttcagctcaacaagaataaaataaaatagagaagtaaacagaaaaggggttaagcgaggaagactgtgtagaaactagaaaccctagagggagaaagagagagagagcaatgagaagaagtcttctgagaaatgctactctctacactcgcaaccttcttcataactccgcccctgtactcgccgcttcaactcgtccccaactcagactcttctgctccaatgaaacccccccaccggttccccaaatcgacgacgttaacaacaaaggtatatcaatctatctctttcttctcattctaacgacgtcgttttacaccttccattcaccattaccgttcaatttcccttggcagagctgaaagcgcagatcgagaggtacttcaagggcgacgagcaggtgctcccgtcgatcatggaggcgcttctgaagcggaagctgtcgggaaagcacgaggacaccgacgacgagctcatggaggagctccgcatgcgcccccttgacaacgttgacgaccgggacttcgaggacgacttcgaggactttcacgataccgacgaggagatcgacgatttgtacaacgccagggacgtggtgatgaagaggatggtgaaggacgagtacttcaacatggatgataaaaagtgggatgacattgttgaggacgggatcaagcacgggcttcttagggacaccaaggagtgcgaggagattctcgaggatatgctcagctgggacaaactcctccctggtacaccattctatatttttattacaaattaataccaaaactacactcattgattaggatatgcatctaagtttttgtctaaattgaagttggggaaaacttgatttttaattccattgcttgttgacatgtgataggattgggcctaggaaggcccaaataggtgacatttatagactagataatctagatatgatccttttagttttattttattttactagaaatattagatgatgccatttgtatggttgatatttcttgtaaaccccctgtttaacataggggatgtgctatgtaatagatcatcaatgaaagtatgagttattattttatcttctctcttagttttggtagaatgataggagtagtgatagaatagttatcttgtgcctatcaacatttcaaagttatttcactattactgataatcatgttgtgtagggaatggtaattaaaggttagaggagaatgtagggactagagtgtgtactattactatgtaagtatctttaattctgattactcgtgaagagtttttttttttttttttaaaataattnnnnnnnnnnnnnnttctaggctaatcagttctgttttaatgggttttatagacaacacgagatctttttgggttgtgcttgacatttattgcatactccagctgaaatttcatgatttgcattttagtgtagttgtcaattgcagctttagaagtggtttaagtgatgttgtgctaatttgctgatttggttatgtcttatgatagacgagataaaacagaaggtggaagtaaaatttaatgagctaggggacatgtgtgaaagaggtgaacttgaacctgaagaagcttatgaagagtttaagaagtttgaggatgagattgtggcagaatacttggacaaaatggaaaaggaggaggctccacagtttgatgatactactgtgccagataagaaaaaggacttggatgatccaccgggtgaaggtccaattctgcgctggcaaacccgggtagtctttgctcctggtggtgatgcttggcatccgaagaacaggaaagtgaaactgtctgttactgtgaaggagctagggctttcaaaataccaatttctccgtctcagagaattggttggaaaacgttatcatccagggagagacgagcttacaataactagtgagaggtaatgttctatcttcataaacattcattcatgtattattcaatcttatagcacctggatatgggcttttactggaagcagctacatttgtgtttgaaatgttcttttccatattttgaaggtttgaacatcgagaagaaaacagaaaggactgcttaaggacccttctctctctcattgaggaggcagggaaagctaataaactagtagatgatgctcgatcttcatacgtaaaagagaggcttcgtgccaatccagctttcatggaaaggctgcatgccaagtcaatgaggttgcaagaatctaatcaggttcctgcttgaggttttcggatctgatgtttgaatttttgaacattcacctgccataattttttattgctccctgcttttttgtatctgagtcttatcatgggtcccagttgcagaaacaacctccctgcttagagggtaaggccgcagacatctgatccttcctagaccccacaactgcaggggagactcatgcaccggggtacctcttagtcatatctttcgtatttagtgcttgaataatggataatttttttttacctcttgttagatattgtatgctagttgactcaaatgttacatttttgtggagtaacattgatcatagaaaaggctggatgacctccaactgaagcaagggatttcaatattttatattataaccacagtttaccaatcaattctatcgtgcttttccacaaaaaagagagaatagccacctcactctgtaacatgcagaattatgagtaatatgattaataaacaatctctatttctctgctactccagcccatacattgtctaagtaatcaataacatgtcatccgtcttaaatttagggtgcttatttcattttaaaaacatacttatactgttgggacataaagctagaggaaaagtagttagggatagttagagagggaagggtcagttagttaagaggagtgctatccttcggaaggaatagccgaaaattcctcaaacaaattttttagtcccacctgtcaattcaaaatagttataaaatactcccttgggtctcaattataagaacaaaaaacttatttacattaaaaaagttaatcatatgtaattgtattaatctcaattagaaactaaattttttctcaacttatctttcattagaacttgattttaggaataaaagagtcattggaactaaaatttcaattaagtgatagatattttaatgatagtagcataaatgaaatgaaataaaattagttgaaattttcttatatttgaaataaagaaaaatgtgtttttttcttatatatgatattagagggagtattagttaattttaattttccaaagtttttcctttttttccaaactctgcagtccgttatctcagttgaattaaatcccgattcccaaatgcattccctcattttcagagtgaatttactttccagcgactccataaaaaatcttctcctaaccatttttcctcaccattgttccaattagttcaactccactctttaccaacggaattctgtgcacctttaaaataattcagtttggtttgtacaaactgttttgcagttcaattcaagtgaaccacatttgcagttggaacaattcacgacaatttagttcagttcgaacaaccacaacttgattacttgaagctattagcaatcaccatcactatcttcactggtgtacttcatgatacaagaaaataagatctggtaggttgcaagctaaaggactatggcacatgtttctataaaaaattgggcagtaagttgacaaaaatacgaaaatagcaaaaataaggtcacatatgcaatgttacattgacaacatacagggagcagtagccacatagataagttttaaaaaattccgatatattgttgtccaaaataaatcattagtacatcaaaaatcaaaattcaaaaccgaatgattatatacaacgaccaataattttaaaaaaataaattgaagtgtgcttggtaagggtgaaaaatgaaggaatgaagaggaagtgaccatttgacttgacattagacaaagcacacatctagatatatcacatctgcactcctttagttccattctatttatccaattttcacttctaccaaggaatcctatgaaaatattgatcataagcactacatcaaacataatataaggactctcaaatactgtgttcaattgccctataccccacaaacattttattcactcttccagcagatagcccgatttttgttttcttcaacccaatcatatccaaatacaaatcaaaacaagagattctgcacaactgcggcataccaattgcagaaacactcttttgtgactctccaaccactaaacacttcagtcatcaattaatgattagtgctactgaatactttcgactgaagctgtcaaaatccaatgcgtggatggttgtattaactttaattatagggccattatggacttggggaggctacaactgattcagtactttcattataaagcaataactattcactttattggccaatgcgtggatggttgtattacctttctagataaagatgaatgaaggttgggttgaaggtagtagtactattagagtaaagaaattatataaagggagtattaattaaaagtaaaaggaaattacatactactattatcttgaggtttatttgtgactttaaacttatttaaaaattaccctccactccatttatatcaacttaataataattttttaacatatgctaataaaatcctctatttaaccaaggttaataaattaattagcattcaaaaaagtgttaaatgttttacaccacatattttttaaaacttattaaaattttctaaaacaaataagctgatgataattttcaatttcccccctcgtattaatattttaaaagcttaaattatgtaatatataaaacaattaagcaataacctcatttcttagttaaaaaaactaaattaaaccatataatccactataataccgggtacaaatttaactactcatgtctaaaagaaaaaaaaaataaaaggagcaaaactaagattcaaatgtcatatttatacaggaaacaaaaagctaagtataagaactcaaaactttattttacaaaattgattttgaatgaaattaattttaaaataaaataacttatattgtgatgttttattttttaagtatgctaatagtaaaactttacatgaaatttttaatccaatacagaaattacctaaatttatttcaatttgaaattaattttttactcaaaattaattcctcaatatatggaagactaacacgtaaatgtttacttaaaatattattttatcgtgattttagaagatgaaacgtgaatcgctacatctactgaacaaggaagataatgtcaaaattacgaagaagtgtgctatgctttagggacaatggctcactgtgtccttttggcattgcaaagagccacaactgtggaagtattaatattataattcatttctattaactgcttaatcaaaagtcattgtcatcaatgctggcgaacgagaatcgttgctgtgttggtgtggggttattaattaaacaattataatgatggcctatctagacaaaaataatatacttaaaagttggtgtatttaaatacaatacatgtaacttttaatttttaattattaattagtattcttatgcattgattattaaggaactatttttttttaaatcatagaatgtcataaaaaaaagtcaatgaataaaataattttacattttttaatattttttctctttttacttatattttttttatttttaattaattatttgagcttagttaaagtgatacgtgtaacgactacatatttaatatctagaattagtctagtcatctagcattaagtggacaaattctaggttggtaagactataataacgagtctctcaaaaaagactatagtaatgaagaaacccataantatatatatatatatatatataaacttaacataatcaggctgtatctaattcattttacatttttaaacataatactttttttggatagaaaacagaataattttaaaaattagacttgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtacttatatttagtaattaaaagtaacatttccctaaagtacataaactttttcacgtggccacttcccttaaatttgtttccgtttaatatgaaagaataaaatacactgtggtgtcagattttttgtcttctattcatagtagtacctactacattatctaaaatcttataatataaatgatagtgcaatacgttgaatgaggatcttaaatttaaaatttaatctttattatatctcttaataaagagttgaagagatttttaacataaaagatgagttattataaaaaaaaattttaagatatacatattatttaaaaaataataaattttctttttatttctttgtccataagatctcaaaataagatctaccattaaagaaaaaaattgaaagagatcttaacagatctttaatcctatgtgacggtctactaaaaagtaatctaagatttcaatttaacaccattaaagatattctaagtacctaaatgattcctaagagttgaatttctaaattaattctgtttacgtcattattttaatttgataaaactaaacatggtacaataattttttatactttaaagcacaaattattagaaaaacaatcttaaaaacaatgagcataaagaattggtgatgttaggaagaaacgacaacaacatagcaggtaagaatcaccttggttagaattaattattgaaattctcagcattagcatcaaagaattataaattgcagctaacattaacatagacttgttcagaacaacccaatcatatgctgccagtcttaggatccaacatgtctcaaacactaagctgcagaacactacacccattggactcaactttgatgaagtcaatgtcccacaatccaaaaaagtccaattccaccgcattcacaaggcactttgccaaaaaatctgttgttttggtcaagatcatggcttctgctacacctacagcaactcctatcacctttggattcaagaatttgttggatacattcactgttgatgtgcatagagcagagaacaggccactgaatgtgcccctaatagccccttttaccattgctacctctagattggacaaggtggagaacgtggccataagggttgagttgagcaatggtgctgtggggtggggtgaggcaccaattttgccgtttgttactgcagaggaccaaaccatagccatggccaaggcttctgaggcatgtgccttcttgaggagatgtcctgcactcactttgggttccatgttgggggagattgctggtattcttccagggcatcaatttgcttcagtgagtgagatttttattttttttagttcatgttttaccagtgcatgtgttgttgttaatcattctaatcctctaatgcttctcttcaacttttgaacctgacatgttcattttagttcatgttttactagtacttgtgttgttgttaatcattctaatcctctaatgcttctcctacttcttgtgcttttgaaactgacatggtctttttgaccctgttactatgcaaattccttgaattttgaatagcagctttagttttctgcttggtaactaacgacataaaaagagttacaaatttggaggaagtttcaatatttcaatctaggatagtatttaatttgtaatatttactgttttgagttttttcctttgtgtaacttttagtttggttctttaatttgcttaattttaagagaatattttgttatatcctcgttttcttaaaagttgctacctttttctgttctggaatcaatattttaagataattcaagagaaagaagggaaaaagagtcttttcttaatcctctctttgtaatgatcatactctccactcagattgatgccttttctttttctttttaccaaaaaagaaagataaagcataatcttactgtaaagagaggaaagggggaaaaagaataagggtacagattttaaatctttctatcactgcgaggattttttttatatcggtaaatattagttgtcggctgtcagtttttgttatcggcaaatgatttgggttcatctgctagaatgagtaataatgacagcctgaaataaatgaggtcttgaatgtgagtaagccattctagagtattatatgtggagttgaaagcgaggggcttgtgtaggtaaactgatacttcatctaatggtttaaacattgagggttagttgaatactggcattaaatgcatgcactgagttcttgtacatcggatctgccaatacagtcctttgaaaggactcctttctgagctaatagaattttcaagatatgagtagatcctttattctaatggctttgcaaatctagaagcacaaacatataagtagatcctttattattataatgcaaaaggtggggtaagggcacaagtggcagaatatttgaagcaaatggagactgatatggacactgatacacaattgcagaccttgttcatgttttttctttctaattatctccttcacactacccttcaatttttataaaactatattaattgacatcaataactatttgccattttccctacatagcattcaacctcttttccccatctttatcttattttaagaaattagttgttactttttgatggagaagcaacctgagattttacagtggataatggcttctgaagttgaaaaggtttcatcagaaattcatgttaatttatgtactattttattactcttgaagaaacaactggctaatgtatgaataaggttgtgaaacatagcacatacttttttatcttttgacttcgtaggatttcttaatagatgtggcagtaaaacttttccattctcatggggtctcctctgtgtaattgaaggttagggccgggatggagatggcaataattgatgctgttgcaaatagtattcgtgtgccactgtggaggctttttggtggggcttcaaataccataaccactgatattacagttaagttcttactaaatctcaaagaaaatgcttataatgaaaattattttacaaaaatacgagaaaaaaactatctgctagaaagaaatctaagccagcttatatgtgcagatcccaattgtttctccagctgaagcagctgaattggcttctaagtactataaagaaggatttaagactttaaagctgaaagtgggcaagaatctgaatgcagatatagaagtgcttcaagctatacgtgttgcacaccctgagtgtcagtttattcttgatgctaatgaggggtataactctgaggaagcagtggaagttcttgagaaactacatggttaaaagctctacatatatagttaaagtttttctccatccaattaattgtcattgtcttgcaatgcaagaaaatgtacacacacatgcacaaaattgctcatgaaactttattgcagtaatttacacaatctggccatgaacatagatttgttttctattacagatatggggttaactcctgttctatttgagcaaccagttcatagagatgattgggatggtcttcggtatgttggtaatatagcaagagagagatatggagtatctgttgcagctgatgagagttgcagaagtataattgatgtttacaaaattgtggaagggaatgttttagatgttattaacattaagcttgccaaagttggggttatgggtgcccttgaaattattgaaaaggcaaaagcagcaggattagatttgatgattggtggtatggttgagactagacttgctatgggttttgctggccaacttgctgctggccttggctgttttaagtaagaaacatcttatgtttgaaaattttgggccagttgccagtttttataacttcatattgttcaccttctaatttactaatgaatttaattattgcaaacttttttgtaggttcattgacttagacacaccacttctgctgtcagatgatccagttcttgaaggctatgaaggtacactgtgcctatatccatatcaatttcaggttttcatataaatattggtttggttgatgtctctgcaatctaatgacactagggtatttctcttgaacagtttcaggtgccacttataagttcacaaacgctaggggacatggtggatttcttcactgggacaaccttgcttaggaagttgtaattttcttgcacaatatgattccagataatccagcaaagttgctagtatatgctaggtgatttctggtgtaagattcattggataaccaatgattcacaccttaaaaggaaactgttcaagccttattcttggttggaaagcaagatacttgttgaagatataaaaccaatctttcaaccgtgcacctaataacaataacttcaaggataactgaatcttttctagccctatccttcaaattcaattgaatttcaaggcaatatagggtgagactgtgctatatatccacctttcaagcacaaaagggttcttgaatgacaaggcatgttagagacataaaaccaacttttgtctgcgcaagttctagaatttgtaaagccaaaatttcctactaatcacctttaatctcaatgctcttggcgagaatggagaaaaatatgttttacaattttatttttatttttatttttattttggacattggtgaaatacgtaaaaaaggttctatatataccgaggaatcaaatttaatatatgtttgtcaccctattacatgtaatgactttttgtatgtatgctatcttcattattgacatctttattaaattatttgcagatgttagagatgtttatgacaacacaagaatctggaaaagcataaatggacaagttggttaaaaaattgcctaattaaggtgtgaaactgtggttacaataacaaccatacgtgaagatttcttgtccggaatgagtagccattacctatccacaattgctatgtatttaactttttcgattcctcaccatatattctgtaaaagaaactgccttcgaggtcttgaaccaaatagtaaccagttgctacttgctaaaagctaggaaccgcatatgatatgagatatggatataatatgatatggacattgaaatatagcaaaaaaaaaattaaaataggcttaattattgaacttttggtttctacaatttaagctgtgtgcgattttgatcgtacgattttttgtttcagctaattaagttattctattttgaaaattaagcaaattcagtttcctcgtccattttgtttcacttaaaactctcagatattattacttatgtaactattaacaggcggatgatggaattgaggtatggaatgattctaaatgtttagaaataagaaacttagttgaagataaaatttgagaaggggtttataagatgtgaaattaaggaaagaaggaaaatattgtgaacctttattttagatgaaatttgatggtcaagatttttagttgacgagttctctgaattcgatatgcaaacattctgaatagaaaataagaatttgagggtcttagatataagaaaatcaacgggagaccaaatttgctaaattttaaaaataggttgacttaactgagttaaaaaaaaacttaaagagattaacttcgtgataaataaattatgaagttattgaaatttaatcattcaataattaataggaaaggaataaaatagagtggaatgcaatgcaatatataggtcactccattgtgtagatatattatgatgaaatgaaaacttattttgattccatcccataacctccaaattgggaggagatataaattaaaattttggatagaatggaacgaaatccattccattttattttaatttaacaaaatcaaataataaaatatattaaaattttattttatcccacttcattcaatcatcttttactaattcaaacatagccttcataacacgtttggtttcaagttttgaaagtcccaaactacaatttgagcaaaagtttgtttcttgtatggtccaaaaccttggtttgagaatttcaaactattggttgcaccgagttacatatcataaacctcactgcattaaattcggcttccctaaagctctacttttatgcttgaaatattgcacaattctactacatggaagcaaattcggtgtggcgagcggcatgctatgtaactctttgtgtggccaattgatcatttatgattccaaatactccagtgttgcaaggaatccgaaaaataattttcacactgtttctcaacacaagtggtttagatttatcaatgtgcgaaaagtcgaaaactacatgattgataccatacgttctctacaaagtattccaccatcatcgagctaattatgaacatctctaatagtataagaacatgtttaaacatcgtaagagtgtaaaacttattttaaaacagcaaaatattgaacacttacactacatcagatatagtaccaaaattgggccacgcaacaccgcaaagtctcagtaattcacccattttcttctaaatcacaacatctgtaaatattttatctctagaaattaacgtgatctcaaccattactgaactgaaaatgctcgtacagtctggcttaatccctacatatccttcctgtgaacttgtttgtcatactccactctggtttttatacttagtttctctctcatttcattaggaccctccagttacctgatagtttttcctcccatataaaactttttttttttcttttctttttcactgtagcaatctctatgaattcattgcttcatattggcttcatctttttgtgctgcttaggcatatcacaagaatccacaattaggcagtcatcacgtcatcacaatctctacagatggatggacttttaccaagtttgcaccaagcaatgaactcagaaattaaggctcagttttagccaaaagcaggaaagacatgtcggcttatgcagttcatctatggtatgtgccatgtgatttaaagaactgaaaatccgggtgattaacctgaactagccttaaccagttatcagcagcctgcaagagggaactcacttgttgagattcactaactccttttttcatccaaatagacccctttaacttataggaagccattgcaaaagtaggtatagaaatctttggtacaccatccatctcactgggataaaccagtgttggagcatgagtaggaccacttcctgcaaaatgtaaccaaaagaaatgttttgaaaataagtcagtattgcatcatagtgatcaaacaattacatttcacgtttttttgaagaaagcattattttcacatattagctgagataacatcaaccagcaagttgagtaatgcaccataagattaagaatcagtttctatttttccatatttgtcaattttaaattgagtgtaatagctgtaattgagaaaagattaagaaataagacaacaaacgatactaaaattctatttggttttattctaggcaggttgataatggaagcataatgattgccacaacgattgatggaaaatatagatgaaaaaaaaaaacttctatatgtacaagtgggtcacagtaagtcagaacacaaggtcaacttgttgtgacttactgactcttggatgtgcttactgtgcatgtccaagagttgaggcaacaatgcttttgttttaaagataatatagtcctaattggagagtcaatagataaatttggaaacacatggtaagtaagaagtatgtggaatgtaactatgtaagtttagcaacagatgcataaaccctagctcaaaggtgaaaatgggagaccatactgtatcacaaatcacacatgtatcttgagttcatcatgcaaaaatgacagaaaaaaaaaaaaaaaaaaagnatcacaaatcacacgtatcttgagctcatcatgcaaaaatgacagaaaaaaaaggtgatgtaaaccataggattctaggtagggtggatgaaataaagtgtctctagtgttatgcatgactaaaaggtaccattcaagctaaagtgaaaattttactgtgcaggtataagacctgtaatgtagtatggaatcgagtgttgggtaataataaactgacgagaataaactccacttaacatagatgagaatgttgcagtgggtgagtggacatactaggccaaaaaagaatgggaatgaatgcattagagaggaagttggggcagtaacaattgtgtagagaaacccagaagaatttaatttcaccttaagtgattttggcatgtatggagaagatttgtagaagcccactaagaataatagaacagatggagggtagccatattgctagaggtagaaagagattataaaaaatataggtgaaaccattaaaaaaaggatttagaggtcaatagtttatctagagaaatatttacaataaagcattatgacatcatttgatccatgtagctgactccttagtgggaaaaaggcttggtggtggtcattttcaaattgcaaaatgatttcccatggtgtcttctatcaaatcatccatcattaaaagatcaaaaaaagatgcagtcagttgcagatttgcagtcattctgttcttagctgcacagttgagaaaatgatgcagccagtttccacagaagtttggcatatggtaccacttgtgcaggtgtgagaaatgtaattgtaagtatgtgtatctagaagttgtgagacagagaaatgagagtaatgaagccctaatttaggtgataatattttgcattattgagagactaaattctattaaagaagagtagaataaatgaatgtcactttgcattgttgcaggataacacttgtaacttaggaggacaaaagtagggatttactcaaaaggaaataatctcaaaatgcacaggatgtttaatatagcaatacggagccaaaatcagtgctgtataagcaagtctaataagatgacattgacgatcaaacataggcttgaagttccataattacctgtcaagggtgtatggagtgtatggtatgttagaaagcatccatctaaatcttttaaagttgaacctgtgggtattcgatatataggatacctagaacatgacattaaaatatgttaacagaaaaaaaaagtattaaaacattagattaagtcaaagtctattcaaaacaggagagggggggcggggggtgtggagaagtgacacattagattaccatgccacagacacccaactgactggtaataaatcacagcttctcaacaacttgagggcaggatagtggcgtgcaagatcttgtatctgtcagaatattataagtataagatggacagatcagattatgggtaaataagtcacacattaactaaggatcagtaattgccttgtcagccaagggttcacgactatacggaggatcttgttcaaaatactcaaaaagtagatcttgaggattcccagtttcactatcatcactagaaaatccttcttgcacagtactgtgtttatcatgtatagatagtgtgttcatttgcagtgagacaccacctgttagatactgactacttctttgagtcataaattcattcctttttccatattcataatcactacttccttcactgcatgaatctctgtagtaatcaccatcactatcttcactggtgtacctaatgacataagaaaatcatctgattggtttcaagctaacaaaacaatagcccacatttgtaagttataattacatagaagtaggacagtaagttaataaattacaaaaatagcaaagtaaatttacatatttaaaattacatattacattgactacatacaaaaagcagtagccagagagcgagagagagtataaataaaaaaaatactaaaaatatatccaatatattgagatcaaaatgaaaagttaatccatcaaaagtcaaaaccaattgatattatacaagaaccaaattgaaaaaataaatttacatttttaaattttgaagtgtgcttgtgaaaaatggaaggaatgaagaggaggaagtgagatttgattagatatcagacaaagcacacatctagatatatcactcattcgcactcttctagttctatttatcctgttttcacttctaccaagctcaatacaaaagagatccctgaggcaatacaaggaatcacatcaaatattgatcagataaacaccatatcataaataagaggactccccacagtctcaaatattgtgtttccaattagcctacacccctcacaacattttattctctcttccagctgacagcctgtttttttcaaccaatcatgtctaaacaattaaaatacaaatcaaaacatgagatactgcacaatttctgcataccaattacaaaaacaatcttttgtgactctccaaccacttaacatgttaactcatcaattaatgattagtgctactgaatactgtcacctgaaaccaccaaatctaattcaaaaggcaacttgctaacattataacttatataacccaacaaaaatgctgcaaatatatatgactccaattacaaacaaaaccctgcctttcattaacagcttggacatcaaataattcactcaaaagaagtgaaacaaacactagaagcacataaaatgtaagcaaaagatggtccttatgagtcataacttgaaaatttgcacatataatgtgcaggatcgatgactattaaacaaattgctacatgcacaacgcccagtaccttggcaattttgtccaaattctaacaaaatagtctaaattctaaaagtaaaagcatgatgacatcactttgtgaaagtgtaacttcaacaaaatcagtgctttaaagcaccatttcatacacttcccctcaaaagtggttttaagtagaattatatgttttttctataagtaaattcctaaaactaaatgattttatgccttcaatataaagtttgataaccatgttccatacactaaaccctcaaggaaaatctagagtaatgaaaaaaaaaagttactcattactctttactggaagggaaaagagggaagatcaaattggtgcttaaatttgttccaaaattcattggaagtgaaatttaggaaacagaacaaattgaaatgactataatttataaaagggcgatgcaacattatcattgtatcaaggatcaccctcaataaaaccaaatggttataaactattagatttaaacattttctttacaaaatcccaaacaacaacttttattaaaaggaatagttgctattgacattcctcttgagggtaaagaaattttgattgaaaacagtcaaaaccagctaatcttctattaatacagataacaatatcatctttctggtttccaccattctgaactcctgcagtttctatatctatgagaagcattttacaaagactaaaaaccacacttgtatttctaattcatttacttctcaaccttttcctgttgcctttcaaccagaacccagaaagcatattcaataccacatataatccatttaaccaatataccctatacgcagatgggctgaagaggcttaaccgtggggagatataagcgttatccacaggaatgaacagcttcgtagatctgtggatttcacccctacacacaaaattccactctcctctgtctcactcaagtgattttttagcttcccttgttggataagttgattttgattcagaatcaaaagaaagttatgaaagcaactgaataaatgttgcatcaccattaatttgcttcctggatatgcacactcagcatttacactccatatggaagaggccatttgacatcttggaggcaagatcaatcttactcttgatttagttcagccacgtgaaccatacagtactcaggaagcaacaaattgttgagagaattattatagaaagcttctgcaaatttttagagccaaatcacgaacttaaaaagaaaatagtaaaactgaatatattttcaaattttcattttctgaaaatagaaaaacagaaagttaaaaccaaacaaattttctaaatcttaaaactttgaaagtgaaaataagaaatgaaaatagaaaacattttctcaaaccaaacgtccccttagccactgtataagagtaaaaagattaacacctggtatatcaattgattaaacacattttttttatcagcaaatgttagttgttagttgttagcgagactaaaagagctgcatccatcgacaattctaacatgtttccagtgattagtattgtcttaaagttaccaaaattcttattaagcacatgaaatggcaataccttggctttgcacttgacttctcagcagagtgaccatagagttgaatagctgacaaatacggaacataatactgaacaacagaatcactttgatcaagcaccaaaggtactccagctccgtacgcactccactccttaaaagactcccacagatcactcagtgcaaagtaagactgatactccacatcgcaaaacttccatcctctcatcgttgtctacaatcacaacaacaacaattccgataatataactaacaaagtataaaaaatttgcaacaataactgtttcaacatttcaaaagcaaaatcaaattgcaaagaaaaaaataaattaaaaatatgaattcagaattcaagatcaaccttggagaaatactgagccggaactgatggtgttgtggactccaagaacctatcgatgttactgacagactctacggacggagaaagagttggtttcagagattggctgagattgctatcgctattgctgttgttatcctcagagacatcgactttgctcttagaagctaaatccgcattttcaggttcgttgttcttggctctgtcactctgtttgcgctgattctggctctttcgaaccttcaccggaatataaaaccgatcctcgccgcgaacgccgccgaattgcagtgcagttcccagcattttccaatcgttttcagaactgcgttctcctcctcctcctccgttccgtcgccaagaaaacggaggaaatgagaaaaatcgtaatcgctgagaggatcaataaaaaaaaggaagaagagaatcagaatcggtgatagaagacgaagaaaagaaaacgaggttgaagacaaagggaagaagacaaggcagaggaagaagaaaagcttcaacactcttctttaccacgaaacagacagagtgtgcatagaaggtttggtggagattctgtcattttccgtttgcttggggtgtttaactgattctgtgaagttttggggttatttgttgaatttgttggactttccctcaagagagtgaaagaaagaccgaaagagtcttcgttattatcacttaaattaaatgtcgataaataaataaataaataaaaattacgcgaactttcgacacggatgagatcggcccactcgtgatatgccttacattgactcgtgtttttttggctttatcattgaaaggggtatttttattattattatcattagacaggtgaattttaaatttttaatctaacatatgttattacttatgtattttttaattttaaaaattgaagttatcaatttttttacaacattaatataattttttttaacatacaattttaaaattgtaaatttgtttttgattttgaagtcatgatattgttttttttatgttaatttttttctttcttaattttttttatgttttgtttttaactttttttatgtgacatttctttaaatgatatttgttaaaaaaattataaataattttttaatctaattatttaataaataacagtagaaaaatataaaatatatattaaaaattagatatatcaaaattaaaaaatataaaaataatataaaaatttagaaaatatattaaataaagtaatattaaaaatatagacagtataaaataaaaacatacaaaaaaaaatatacaaaatactaaatcaaactaaaaaataaagaaaattatataaacatttttcaattatgttttagtcatcgagataaaatatcatttaatattattaattattgtttttatctaattctcaaatgcttttagatcaatcttcatcatgatcttcattatttttttaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttcattatttttttaaaatcatataaaaattaaaaaatatatatattaaataaaataatattagaaaatatacaaaatgttaaataaaaatatacaaaatattttcttaattattttagtttcatttaatatttggatatacttttgatatgtttttatttaatatttaaatatttttaatattattttatttaatatattttctagattttatatatttttatttaatatttttattttttaatatattattttatttaatatattttctatattttttaccattatttattnnnnnnnnnnnnnnnnntgtcatattttttgcatatttagactaaatttatatttttaatcttttaaagattaacttatcatcacattatatttttaaggacgaacttaattatttatccactaactaatatcataattagtacaagaattaaagttaaaaatttattaaaagtgtttgtcgtattcacataataattatttactatttatctatcaaaataatttaaatattaaattaaaaatagattatatttttcttaattgatatatttaatacacttaaccatatgattaaacataaatcattaatatattaaaattaaggttaaataattcatatattacttaaatttattctttattaaaaataattcttaattagattttatttatttattagtcaaattttgaattaaacggatctttttctggaaaagttaagataaaaaaatctttaaaacacttatattcgagcaaaaatgaaaaagacacttactaatataagataagaatgaaatagatgacataatcgaggagcttactagttaagactcataagtcataattcaatagttaggtaaatttaaatgtgagatacaatcaatattttttttttatctttgtacgtcgagttaaattttatttgcatcttttaattttatttaattcgttttaaccctctaaattattttttcattttcgtatttttctgtcttccaacttaatggatacatcttataagaaatctacatggctatagtatgcttaatttaatcacagttggcaataacactccacgcaaagtgtttccgttttggttacctttagccgccactaataagatacccattgtttgaaaaaccaatcccaccaaaatattattttaaataaataaaaaatatttttattttaaaaaaataaatctttaaagtcattatttaagaatgtggcatatggtgagctggtagctccaaacacattgaattgaatattgagtaagacttggtctgtgttgcagctgcatcaggggaatgaccttgctgtgtggaccattgagtttaatatatatggatcattcaatctgaactctgaagcaaatggttcaaattttcttttatattcgtctgcaattaaaacaactcattcaatataaaacaatgaattgaagtgaaaaccctcttatgatactgttttaaatttaacatttctagcttattatagtccagtcatagctttctctacagcatcattatgccatagtcaaatgtcattttaaatcttttaaatattctagtatattactaaatgtatggattaattagtatggtattattttaattaacttatccaataattttaattagttttaaatatgtaattatattaaataatttaaaaaacatacatactcaacaaaaatagaatgaggttcttttataaaatgtaaacttttgcgatattggagttttttcatctcgtgatcttatgaacatgtttttattttggtcaaattttgaaagtttaattctctttttcgctaagcagttcattcatttaatggccttagaaaatatattaattaatttttgttaagataattttgtgtaaataatcaaattcgtatttaaaaatatgacgtagtaaagaaattagtctataaaagatgaaaatataaatttagtatatgaatttacaaaaaaaatatgataaattagtcatgtgactaaatttgtaaaattattttattattaagttgtaatgtttaaaaatcaatttaataataaattgtatttttttaataccaatttaacattaaattacaaagtttagagactaatttgtttataaaactaatttgtcatactttttttatattcaatatctaaaattgaattcttcatctttcaaaatcaatttgatagagcatcacactttcatatagatgaatttagctaattatcctctaattataataatattattactatttaatcatattttattgtattactaccgctttgaaaaaatgttgactatgacagtaaaatgaatcaaaattaatttttgctgcattatttctgctcccttttctttgggttagaaaaaggaaaccatcatctacgtacgggacgatttgcttcccgacagcaacacaaaggaaagtaacaacaacgacggcaaacagtgatacctataccaaccaccatttctttgactacaacaaccccccaaaatatgtcgagaaattaatggccacttaattaaggattaaatgtagttgagactccgatagaaatcatagaagtagtatttgtttttatatttatatttttttaaaaatctttttcaagtttttatccacatagatacaattttttttaaaaaaaagttgtttctaatttccaaattttactgttcaattttacattttataactacaagcaccttaatttattactcgcgttttaacttttaattgaattaactatgttttcttctttcactgtcctttcttttttgaaaaagagataaataaataatattttgatgataaactaacttggaaaattacttcctttgcactcagtatataagaaaaacaactaattttattttaattttaaaaaattaattaacatcatttaattttactaatattaagtaaaaaataaaattatttctaagatgtctttcatttaaacttaatatcatgaataaaaaaaatcattgataatagaattagagttaaatcaaggatgttttagaatgataacacaaaattagtaaaatttatttatatttaagtctaacatacaacattactttttatttatatatgagtctagagagaatattattgaatatgtgaatcaaatgacctaaggtattttatttaaacattaagtatgtaattggattaaataatgagaataagaattttgtcactcacaataatcctatattattcaagtagattacttcaaatagaaaaatattagtggtttataccataaacacaaactaggaaagctaatttttttaactaaaagtgtaaagtctaacacaatccaaaaatacccaaagtaatggtgacagtctatttagaagctgtttaaaagcttattttgtgaattcacaaaaataaagaagcttattttgtgataagaattataaatatattggaggaagagtatttcagactgatattttggttatttttcaatcaaattggtctgtctgatctaattttaataattataacttgtttatattaagttatttaaaaatatcttaacaaatttgatcaacttcaacttcattaaatttaataaaccagaatttcatttgacgttgaatctaacctaatttgtcctttgacaactcctaattgttttctcataaaagatatcttttttattatttactgccataaaagatatcttaaaactggatagcagaagttattttaggtttctaaattatcatcaacgactaattttgacatttagtacttatcagaaaacaattgtgtatttgtgttatttgactacaaccccaccaaacatattgtatgattaatgtttcaattttgatgaagaaaaatgcacccatgccatgtctccatcaggattgatgccatataatgggtggcaaagaagagcatgtataatggcccacactggcttgaattgaggtcgagcctttgcatccgtctatgtttcatcacaaaagctgaagaagataggacaatgatgtgatagggtacaagggggaaaaacagggataggagatagattacctattgacattaacatacacaaattatcattttcaatattcaataaaagggtcccttaggcttttggggttagtatggtgtgtccatgtcaaggtaaagctataatgacaacatttacaatttacctatgggctcctccatgtagcatattctgaattcattttgaagatattccacagcaaggaagcttctcaatgtttgaaactcaaaaaatatgggtgactttaggattataacaaaaaatgtttattatattaaaataaaagtataataaataaaaaaaatattttatattcatttgtctaaaatcacgctgatgttcataaaactcaaaaatatatattgcaaagtaaatgagggatattaattcaactattagaaatgaattgatgtaaaaaagttagatttaatttttctattattttttcattatccaaaatattattaaaagcttgaataagtgcagtttttttcttactaatttttaaggaaaaaattccaagaactacaagggaaccttgacttgggaatttttgagtcttgtagatgtgtgcgtgtagctggcgtggatcgtgcagaaattgacttaagagctaagaattaaagccatgaaggacatagataatgataagagaaacaactgattgattaaacccaaatggttaatatactaaaattaagattgaatggtttaagtattacttgagtttaatctttgatgaaaataactttggatcatactttacttatctcccaactagactctgaaatagttagggtctcttctccctatatgaagatgacttgctaataacataagaatttatttataaatttcaaaacttgtaaatttcatttcttatttattcaagttaacttatgtgtttggagattattgtttttttcactgtagtagtactttctaatttaagctattaataattgatccattggagaagtatccgctagcagcccaagaagttaaaaactccaggtcttgctatttacactacaattttcgaagtgcacccccatactttccttttctatttctcaattacccattatatccttttttccaaagaagtacactccttttacttttcagaaatgtatttccgaaattacatgtaactattccaaaaatgtatctccaaaactatgattcatagtttcaaagatatacttctgaaatagatatatatttttcaataaaatatcacttaagaattaagatagttgatgagaaataaaaaaatgataaacattgatcttatattcatgtttgttaatcttattttcactctatcattagtgttttttgaatctatttaaaatcttatttttattttatctttattattctttaaaccctaattttaaactatcttcaccatatattgttatataataccacatttttatcattattatacaatattttatatttttcttcatgtgacactacatttcagtatacgttcatcactaacttcatatatcatacaccttaattacaaagcaaagcttttgacggtggtttctttcctttaggtgcattcattcattttctaatccaagtctacgtcaacgattcagcatcacatgaagttagtgatgaatgtatcttgaaacacattatcacatgaaggaaaacacaaaatattgtataacaatatgaaaaatcagtattatataataaatatatggtgaagatagtttaaagttagggtaaataagattttagatatgatttaaagaaaattaataatatgatgaaaataagactaacaaatataagtataagataaacgtttatcatctttttttatttctcgtcaaccatcttaatttttaattgatattttattgaaaaatatatacctattctagaagtatatattccaaattatgaattataattctggagatacatttttagaatatatatatatatatatatataatttcatgaatatattttcagaaagtaaaaatggtgtacttctttaagaaaaaggatataatgcgtaatttagatgtcaaaagggggtatgggtgtgtacttaggaaaaatgaggtgtaaatattaatttccaaactctattaatacttcccagagtccgaagtatttacattggtcagtttcaactttcaagcctgttgttgattgggccgaatctctattgtaaaaaaaatctaactgccaaaatcattggttccacatttattatccaaaataattttcaatgagacaaaggagggcattcctattcacacctccaaatgatgaaaatactactaacacactcccatatcatacagaaaacaaatttccctgtgtatctaccaagagacagtgaaaacttgtttcattgaccacattgactaaaaattaaaattaaaattattgaaaatgttagaaatgattcctagtagaaaagatttacagtttggaaaatgaaaaaaaatgctatattgcagaaacaaaaatcatatttaaactaaattaaattcattgagtaaagtcatctttgcacgcaaagatatataaataaataaaactaaggggaaaaattcacgtgtagaaaattttctacttgtggtgaatgcttccaagttgtaacctttactctaaagtgtatccttgatttgtaatctggcaattggcatgttgaatttgattcgtccttaattagttaaccttttacctgtccatttgcttagtaggaatttaaaatggtttatacatttgactttgtcaaaccaatacatgcatccacgaatcatatatcatatatcatctatatattatattggtcagatcaacatcatcattagaaacaccagcgtaattcaatcctctaatcttcaaagaaatgtgtagtgaaggttcagatacagctttgaaatatttgcatatctgttgaaatatgtgaatttcggtgtgtacatacacaacaaaacaaaacagaaatatataatcaaacttctaattaattaagctttggaagtggccagggttgaaggttcataacgaagaccaggattggaacaagaaacggagcttgtcaaattcagctagccgctattgaaaaaaatgaaaaagtcaaacgataaagtgaatattaaaaaagaaccaggtcatgtacaacaatcactcatattgtatacctacccttgtttcatttgaatcatttctcatcttgtgcttcttctatggctaatttgcttatggataatgataataatgttcatatgaggttcttattccttatatcaatattcttcttcttaacagcatccattagtgctgaagataacaacaccaaacatggagtgtagcaagccatacaactgcggacaaatttccatattctactctttctggggagggaacagacccagttattgtgccaggctgccagcaacaagcaatataagctcaactgcgagggtaatcaaaacaccaccattcaacttggctcacaaagtttccaagtggttcactttgatgatccaatgaccatgacaatggttcgaacaggccttgtctatgatcattgtttctcctcggccttaaccaactcttcctggggctcaggtctatttcgttactcgacgaattttacaaagaaggtggcaacaagagtgctttctatggggacccctgaactgaaagagttcaagattgtgaaggacctaggattgaagtgtaagtaacaaaggaacatgaggttggtgaaggaattcaagggctgaacaaagctttgagtgaagggttcaaagtgcatcttattccagaggctcaagttcaacagtgcttagcatgtcttttatataatggaacatgtggggctaatgatgagtctcagtttacttgtttttgccaggatggaactgaaggtttagattgttctgatcatcatagtatgtcttctttctcttctcttctcttctctttatttatgtgtagatatggttttaaacttttaagaatagattttttatgcaaattgattacatgaattgaagcctttagctagcttgtatcaatggctgttctagaaaatctgtagaacaaggagccctctgaaaacataggtattagatgaaaatgttattggggggtgctgaaaataagggtgaccaacaattggttgcttctgagtttgatatttattttcctgattctggttgaggagaggcttctcagaaatcctcctcctacttcttcagaattttcagtcagtcatcaaaaggaatagcatgctttgaatttgtttagactttcggacatttattgtcacatttattttatcctttggtgctgctaatttgctcctcacaagtattgcctggtgatgttatatcttcctctgaatttgtcaatggtctaatcagaatttctactctgtgatttggttcttttctcccctctgcgtctaaatctagattttgtagtgtaattctgtgtgaacttgttgtgaattgttgactttgactattttgggttgcttataaatcatcatttttttctataaagtttactaataacaaatttctaactcatcaaaagtttttttcctccttcaaaataaccattaactgttttggaagtgtaacaaaatcaatcgtagttcttagacacaagcatcaactatttcattaaaaggttcattgatcgttgtcaggcaatacatgcttaattttgacaattgttaaccaattagtctctaacattaccaaaaaaacatatttagttctgaattgaaaactatcaattgatttggccattgatgtgcataaagtttaggaatcaaatcgactaatgcatattaaaatggaagatcaaattgactgccgatagttaaagccagaaactaaattttcttctaataatatccaagagaaaattaaccagtatatagtaataattttatggatcaaattgattttttcctggtctcaagaaccaaattgatattttattgaactagagttaatatttgtgtgcttgaacccattagggtcagcctactcataaaaaatttattaggtggttcgaggaattagactaatctttacataatatgtaatcaagtattattaatctcttctataacttgaatacatatacatagagattagttagaatcatcaacacataatttgaaacaatctaataattttccccaacagcaagaatttgagtagtttgtataaagtcctaggttcaaatcttgttgccttcattgcacactaaaaaaaagtatttgtgttttcgattatcatgaactgacaaggttcctgcattgtatgtgctatgaatttcttggttaggcaaacttcacgatggacgtgtagttgcagtgcagagaatgtacgagaacagttacagaagactgagaagagttgagcaattcgtgaatgaaatggagatcctaacaggcctaaatcaccaaaacctagtgtcactatacggatgcacatcacggcacagcagagaacttctgctggtatacgaatacattccaaacggagctgttgcggatcacctccacggtcaaagagcgaaacccagcacacttccttggcacacaagaatgaacattgctatagagactgctagtgcactggtgtatctccacgcctctgaaatcatccactgagacgtgaaaacgaataacattctcctcgacaatcaattgagtgtgaaagtagcggattttggcctctcgcgtctcttcccaacttacgctacacacgtttccactgcgccacaaggaactccaggttatgtggatcctgagtacaattagtattaccaactcactgataagagtgatgtgtatagctttggagttgtgctgattgagcttatatcatcaatgcctgcggtcgatatctcgaggcgtatgcatgagataaacttgtccaacatagccatcaagaagatacaaagtggggcattgcatgagattgtgaacactactctagggtttgagacggatttcaaggtgaggaaaatgataagtgctgtggctgagttggcctttcagtgcttgcagagttctaaagatgtgaggccccctgtggcagaagtgttggataggttagaggatattagaagtgatgggagttataagagcaagcatgaggtgctggatatattagatgatgctgctttgctcaagaatgtgcctcctccaccttcacctgattcacatttggtgactatttctaattctgcaccaccaaatggtagccaatgatttagtgtgtgtttgaaaaacagtaaatctaacatcaacggactttcagatgaaattatgaaaagtacaatataattgctttgacatttttgctctagaaagtgtatgattttcccgttcaacatggattcaacgcatctccaaacataccctcaaattactgggtgtacatagaatgatagagctgacttggttatgacaagccatgacgacatgttttgacatcataatggataaaaaaggaatgatatatatatatatatatatatatatatatatatatattcttctttgttttaggaagtttttggaaaaaatctcatcaagattatgtctagcttcatttatggctatcatgtattgatatatagagattctactaattaatgaaagacccctaatgagaattagactcaaaaccttgaattgatgtattttgatcctgccagttgatgcatctcttgtaatcctgtcatgtttagcgtgaaagcttacatcttttttatttgttacagatgaaagtttacatctaatgataagaatttaaaaactatattttccaaagttctatcatctctcctgtaaccttctttgtttgatgatgggaaacttgcattgctcaactcttaataaatttttccaaagttctatcatctctcctgtaaccttctttgtttgatgatgggaaacttgcattgctcaactcttaataaagttgatttacctctttttcttaatttgtttcattctatgtatccttgctctggcatcatattctgtccactaattaccaaatcttcaaagagattcttagatacttaaaatatgatacatttaaagtgagcaaaattttattgtaaaatatgataaaataacatgaaggaacagactcagtttgtggattagatactatatatattttgattgaattactgtgctacttttataataatgatcacaatacatactatttcataatggaggttttggaggttctgtattcgagtcaaaccaaagcctgctctgccagactttccgggatatattcatgatcaaatattcctaaatacatataaattaaaatattaagaaacaggaaagaggaatcaatttatgctaaagtgagttacatttattcttacgtcatttaataattttatattagataattttatagttttatttaaaatcaagccttaacttcctatataatatgactcacataaaattctagattaatccaaatttatttaattctacatttaagtatatacgaattaatgaaatatacatattgttttttattttctgtaaaaaagatctacatatatttatttatttttaccaagatttaatagaaataatttgacaattccgtcaagatctcttcattagttgggggaagagtccgcacgaatcggattttttgaggaacatatggagagagaattggattaaaaattaaattatcaatttagtctattaaattgttattcacattgtcattgtaatccttagatttaatgaattcagaaaagtcatcaaatctacaatccaagctgtctctaaatttaattatttattattatttagtccctaaacatatatcttaatactatcacttaagtcatactatgcatgtaattttgaactaaaacgagtaacaaattataattttgaaaaactttcttaaattataataattttaaagattaaattggttattaactctttgaataatataataattatttaatatttagataaaaatattttatataaaattataataattttaacaataatataaatttatatttcctataaaaaaaatatagcagccaaaccaattcttagtgttttattttcttcttattatccaaaccccccaccccccaatactgtgcaaactctgtgctgaccttagtgggttaaaccaattctgggcaaaatcctttatgaatatcacccattgccattgggttgatcgtggagtcattttcatgagtaaaaaagggcattcaaaattagccagtgtcaaatgattttgacatatttcgtttagtagtctctgccttttcatccacttgataatgcaacagtctccagcactaacaaaacttgtctttttcaacttattttcatcaacgttattccataataatttctatgctcttattctctgttccttccacttatataaagtgagtaaattggattataagagtgagtaaaatcaccccggccgttctaattttgaaaactgatttattttatttttttactattgttttatagtaattaaaactgaatattttttataaaatttaaaattaacaaaaaaataataatttaatctcaagaataaaaatgcatgagaattatgatttaatttattcgatataaattactttctccttgcctaacttttctttttttgcaagattatgcaagcgaatgtggaattctgttctatgcgataagagaatagaatataacatgacccccaatgattaagttcattttttgttgaataaatggacaatctacgctgagtggaaggagatttgtgaagaaagggacccactaaacttccatacttataaaatcaacctattgaaaccattttatacatgataataatattattactattgtaattgtcataatcaatcaaacccccaagtggattacataatggtggagaatgaaagctaaaagcaatctagagcattaatttccatccactaacatgctatcagaagcagccaagaagaccatcaatcatatttaaaaagctaaaatatcatctcagaatgaattaaaattgatgaaaaggcgagtagttatagaggacaaacaacgtgattttcaaagaaattattattacgttgtaacaaatactaattggcatggcatgttcatcttattacgtgccaaaatgtgtcgcttcgctctaaacccaaaagatatcttaaccctatagtgtttggaagatgttgcttaattattatttgggtgtggatcatatccacattcataaaataactgcacatgatgttgtccctttaaataatgtatataacatggccatatttttagctaaaaaggctgttaaacaatgatttcaatggttagattataaattgcatcaattcatcaatttataaaaaccgtgatcatggtgaaatctgtcgtctattacagggactatcaaacgcggtgacattgctacagagacatatgaaattacacacgtgacattcacgtggaggcggttgcatgtccttaattgaaatccatattctgatgtagaagtttatgcaaagaatatctatctctgcagtatactatacacttgatgagacgaatgagagtcacttatcacttaggcgtgtgatttgactccaagctaaagtagagcataagggagagaaattggagataaagattgatttgttataataatcgattaatcattgtattttataatcacctcaattatttaattgaaaaaataaagattgtatctaatctaaacctaaataaatatacatttagacgacgtttagtaaatgtgtttgaataaaaaacaattcataacatactagttctattccatgacatttaaaaaaattaaataaaatgacacttgtggttacaatataacattttagtttcagtaagcaactggattaaaaaagataaaataaaattacagaattgttctattttactctgtcctaataacaaaagttatcttctttttttttatcaacgcaaaagttatcttaatcattataaatatcattgtttgattttaattgtattatattttgagtttagttttctttaatttttattcgaatggtttgttaatagttcagatattatatcaaatctcttaagctgtgatgtgctatatatatatatatatatatatatatatataaacatattcttaagttaaatttattatatgaacttcatgatttttggtctaaaacatgaatttcatgattgatactacgattcattttctttttctctcttgttctccagtctcgttctctctctctccggtcaacaaatgtaacaaatcaaatcctgttcgtgtttctttgtacgttaccgaccgtatgaccaatctttgcaacagattcaaccctcaaaaagtgacagtgacactaaaaccttaattaacccagtcatcaagaggagttttagttatttatattaattcgaagtatttttccatctgagagtcaaggagtaattcccatatatgttacaccattttggtggggaattcaatatatgtaaagatttgatgacaaaaacaaccaagtcattcttgattcttcttctacgtgcttgattatgttccgtatggatgttcccgtgctttgcgctgcagaaacatgaacccgaaaagaaaaaaaattaatagacagtcaaataatattacataactagagagataaagagataaaaaaaaagagaaaaaatataaatatcataagtactatgatataatagaaatagagaaataaaaaaaatagatgtctaattgtataacaggtgttgggatttttttttataaaaactaatattaattgaaaatttattaatttttttagtaaaaaaaactgaatttacaatttttattctttttttctctagttaaccttatttgtataactacggactccaccctaaatggcatccaaaagcaaatgttccaaaatgcgcctttaaatatgaaagtctatagtctatacctcaatcaagtagtacactacagtgatgccttcgaacaaggtaagcaagacaagactttgtgcgtcctgtccaacattacagtgtcttcattactcgaagaatgaaaaattgaggcactcaaatcttttcagttttggcaacagacagccagtcggcaagacaaaaacatagctggctcacaaataatctatatactatagatcttgaaataattataatcattatctttaatattgcttcatcaaaattaattaagaaaagatatcagtatatccttcacatatcgctgcatatatagtgatttatttataatgagaagactagatgagaaaactctctcccccactcagcgaattaataaatatagtgagcttacaatttcattctcatgagtgataatttttcttgaaagtctttgaaaatttgtgtttcggagttggccttatgaaggtctatagctaatctggatgaaatccgtttaacaagtagattttagtatctattgaattaaggtcaatcacgtatttgattaaggcacatcatacttaccctaagattgttaattaaagtaataccaacatataattttatttcaaaaaacataccaacatctgaggaacataataaagtctcattatccatatactactacttacagcaaaagacttagggtactctttaaatatcaatcctgccatatcacaatcatttaagagtttgtttgatggtctgaatatgataaaatataagaataagataataacaagaatctattggtcacaatgacgataaataataatagtaatgatgatgaggataataatataatgttggtaacaattgtgatatgacagtgactagtgagaatagagttgaaggtgatgagatagagaactattattttattatattactttttaactcaacttttttttcatataagaaatacattgcattgatgaaataattaagatagacatacataagcaaatcatgttttattggtgcattaaacatatatatgattacaataagattctatcatattctgcctaccaaacaggtcttgaagactcccaaattttaacttagagaatatagtctatctatgggaaactgtttggctcgagtagacatctttctcatatccaatcctccttaagttcatatccataaatagcaatgatactctccctaagataaccactactacagcaagcattttttacgtcacccaatctaagtcggttgtaacatagccgatgttaaatcaagttcagtggcaaattcgtaataaattgtattttgtttgatagacaacgtcgggttttaagtgaccgtagttgtctttaaagatacgaagtcggtttgcaaaataaccgtcttagaaaggattaaacattttaaaaaaaaataaatttttttgttttaaaaatttcgtggtcggttttatttagcaccgtcgttgtattgggcctttgcaaagtcggtctatagttttaaccgactatgaatgttttgatacaaatttttttttataagaaaaagaaggaaaataaaacctattataaactttggcccttttcccccggatgccctaaaagctcaaacgtgcccgtgccccttcgacctaagctcaagagtgttcaccactggaagcctcaaagcccccttcgacacagcgattgatcaagaattacgactattgcatcctcaaaggtaggttttaacttgtattcttcagatattgcggattccttcatcgtcattgttgttgtttgattttatttgcagaagttggttcgaagagcgtaggttggccaccccgacgacgaatatcaacatcagtgccgacgacgagtggttccgccatgtagtccgccgcaagtacaagaggtcagggatccctggagctagggttcacagtagcttgaattcgaactccagttggactcagacgggttcatttgcaggtaacattctacacttagctactcatctggcactnnnnnnnnnnagcaaaggtatcaattggggcgtttgtttgacgaatttgattatattccttagaataatattcttgaaaatgttatttccatcaatcatgtttggtacatatttttaattcatgtgaatgtctttgaatttattttaatataaaaaaatattaaataaacaaatgaggttgaataaaataatgagaaattattttaaacatctttatgaaaatgtaaggttccaactcctttacatgataatgataatagaaaaatggagaaacatgtacaatattattttttgaaaataagtatgtttcggaatatttattttttgttaccttctaactaacaaacgaatatgagaatatatatttacatttttatattttttgaaatctaataaaattatgtgaaaaaccttaaattgtcaatcctatgagaagtttttttaaaaaaaagctagtcatttgatgatgctcgaattttgcccctagctagcttctctgccattagattaatgaataacaaaagaccggattaggttgaagacgtacgtgcactggtgttatagtcttatgccttgaaagcatacttcactccacgcactagagattaagcatataacattaatcaatcaagcacaaagctcctgaagagaagaatattatagtggtccagaaagatcgatagaggtgatgtagggtcagggtcagggatgacattttgctcacgtggatgctccatgttcatggctagcctagctagtctaaaaggattatgcatgtttcggttgtcccagtcatgaccctccgaatccacttaattctttgtaatctgatcttgttttgtactctagtgtctagaaatcatattaaattttgattcatttaagtcaaatcaagaaacttatttaagaaaataaaacttaatatttctgtcaaaaaataaataaaacttaagatttaagattttatttcaaaatataaaatatcttattactttttttacgagaaaagattcatgtgttacttaaacgtactaacatacacattgataattacactaattattcaagcatatcctggtttaatttgtttttagtgaatataatatttacatatataataatttgatttaattataaggattattcaactcttaaattgaatatgttaagtagataattctttctttttattttttctaattagcatctataaaagatgtatagctcagttacttaccctttcatatattttttttttaatttttgcagataaaaaaatagtttgtatttttttctattttcttcttttctacttgttcnnnnnnnnnnagtatggaagtgctttctaagtcggttgttgtctagaccgacttaatatgttatttttcaaagtcagttgttctttggggaccgaccttgacttggtgaaaaatacgaccctttctaagtcggttgtttatcagaccgacttaaatttggctattttctaagtcggttggtgatgggaccgacttaatagttaatgctttctaagtcggtttatactagtaaccgacttaaaatgatttctttcaaagtcagttcattagaatgaccgactttgaagttgtactttctaagtcggttaattttataaccgtctttgaaacttcgttatgcaaaaaaaaaaaaatacactttcaaagacgggttctttaaaaccgaccttgtttgtggtgggctttcaactacatctgagacaaagtcggttgtacaaccgactttgttggggttaaaagaccgactttaaatgtggatgctgtagtagtgaaccattcctaattttaacttaacttttctctcatataagaaatacattacattgataaaataattaagatagacatatataagcaaatcatattttattggtgcatcaaacatatatatgattaaaataagattctatcatattttacccaccaaacaagttttaaagacttcccaaaatttaacttagaatgtattctatctttggaaaattatttgactcgagtaggcatctttcccaaatccaatcctccttaaattcatatccataaatagcaaagatactctctctaagataactattcttaattttaattaacagcccaaattaccatttcaagcatttattaacttaagaatttgagtttaggtagaatataattgtcaaagtgagggttgaatataagtgtcaaaagtaagtcaaatttccaaaatgactcatcacaagttgaggaaaaagagagtcaattcaacctaatttatttttttgatgaacaaaaaaaatgacttgatctcaacctactgtaggttggtcggttaacacaaattttaaaaaaaattaaatcttgaaaatgcaaataaaattttggaaattttttaaaaacgaaaagaaaggaagaaaaaacaaactattattagtaaagccaaaaattacaataatttatcatcaccaatcttaataacatcatcttttaagaaatggttttaattaagtgatttaaaaaaaatgaaatacaagttgagtttgagggattaaaatgattttttaaaaaatctattttagttcctaaacagttgaagaacaaaaatcgtattttaaaaaaaatgagtgactaaaataatcttttaaaaaataggtaccaaaattaaatnnnnnnnnnntcattatgtataaaaaaagactttattaaaaaagataaaatttgtttcgataatctctacgcctcaataattagtttcataattttggattatgagaaccttatttccagaaagaaagaaaaatctagagttttattgcttaattattatatctatatatgcaagttttattagtatgagtcaatataaatgaatagaaattttttttgggaggcctaaatgaatagaattaataatgtctatttcttaataattccagaaaatattattggaaaattttaaatatgatagagaataaaagaaacatatatatacaagtgtatgcttaatacatcaaattcttttaagaatatttataacttcaaaaaaaaatgtataaaaaattgtttttcaaatcaacactaagtagtagttctattttttcagatttgttggaaattagtaggggcaactctccatctgaattaatgagataatgattggcttattcaaaaattgagagacatgaataacctatgaaaaggaaaacaaaaaatagaaaacttccgaagaagtacgaaatacagccgacaacacttgtggtccagtcaaagtgcatatagatagaaggaaagaagacgattgaatttgacgaacaagttgccactcacactccactacttcaatcgtacatccatgatacctctgtttggaattggaaggagatacttctactttttctattcctaagtcaacagctatgactacatatcatcttctgtgagactcaaaaagaaaaaattaaaaataaaactaactcatcaaaaatatactatatcttgtcttctatgagcattggtaattttgagaagaaaaaacagtggttcttggactgaacggggtatttataagtgtatttatagaattaatttattgaggttttgttttattatataattatttaaattaagaatgaaaatattttattcaaattataaaagtaatgtatgaccatttttttaaaaaaatatttttataataaagtgtacttaaataagcttatgaaccagcgcatttcaatcacaagtatgcttgtatcatgaggcatgtaagcagcttgttttcaaggaactaattaatacagtatactttttaagcagtcaatgcaattggattctctatccagaagaataattggccattgctcacttctctctcttttttaactaatggtgtactccctctctcaattcatattcatatatatggaaaaaaaatcatcttgtatcttagatttaaaaataaatataattaattttacctttatcaaatgatgtaatttataaaatatcttttatattgtaacggtatctagctaggtcaaatagccaaaaatgttatggtaaaatttttagatcactgaaacacatcctctagaaatgtcaagtattcaaccatgtcgaatacctgagagtcatggttaccttgtccttccaaggaggatcatgatggtatcatgtgctcgaccatgcagaatacctagacattgttgtcccatcttttaatacttctcttatactagtacaagatattcaatcatgttaaatacttgagtactattatcttatcgtttacagtttatctctcttatactagtactaggtattcggtcatgatgactacccaagtactgttaccctctaacatttactctcttatgctagtactaggtattcaacctgagtacttctatcttatcccttaaaaacttgcttaatattcgtataactaccaggtactcgatcaagttatatatccaagtaccatatttattacatatgtaacacacaccacagtgttcaggtattcagcatggttgaatgtcagatacctttatcccacgtaggactacttatttaaaagtaagattatctaaattaactaatagataaccattatggtaaaatttaaaatccctaattagaaatacattaaaaggtaaaatagagaaagggcacataggtctagggtgttaattctcatttattactctcatatgttgctcttgacaagggcgttggagtgtcttttgtatgtatctcactctccaaattgtcgaacactatattgcaaaggaagaagtcagtcaagaagacataagaaagaatgaaagttacctacctaccccggtgcaggtacattttggtgcccaccatagggcctaggtaaaattgcctatgccccaagaaaagcatggttgtgactacccaatctatggcagaagcataagttcgacaattgatgaccagacaacctcagcaagttcgaacacccttccctcatgttagtgaagaccatggggatacgagccctactagaagagatcataaacatgcagcagaggcatgttgaggacataacaacattacaaaaggagaacactgagttaagggggcagcatcactcataacacccttctcgacatgacaacccacaaccatcccaagtaggggtgtccagcatattacaaggcagtcatttgggaggaacaacttatccattcaatcttgtcagcacctcaatagctcttgaactcaggaatccctttgtcttagggatcacatatactctgttaccttttacctgaaaacgagtgactttggacaagtatgatagtgctatcgaccttggcgaggacatcgacatttatgttgtccaggtaggcctatacacgatggatgacatagtcttgtgcaaagcattccccacctctctcaaaggacaagcgttgagttggtttactcaccttccaccaaacttgatagattgttttgaaactctagctatgagatttaaaatccaatttgccaccaactggcctcatcatttcacgtatgttgctccagttagtctatgacaagaaaataaagagacactaaggtccttcatggaaaggtttggaaaagatatggagctcatgtcaatcaaattaaaatatgtaccttatttgttgattctaacaagtttatatgttctaccgaagtgtctttgtacgaatatgatcaaataatgactattacaaacacatttaaacatttgtgtattaataataaaacattttgatttaatagataatattttatatgataaataatttttttttattttacaatttaactatatacaatgttaaaattgatataatatgttaaagagtcagtttgactccaccttatcttatatattttaggtcttgattgaattgaagttagattcaaataaatcacccaatcaaaaatttgagtcaaaataaaaataaacttatctcttagtcactcctaatacatccgtaacatcccatagctatcaaaagatcactttcacatatctatatctaaagactcttttagttaccttgcactaggtaggttctgaaaagattgtaagaacattttgtaacatcaaaatgttaaaataaaaaataaaaaaaccatttatgatttttcttaaatatttaccgtataaataaataatgaaaaaattaaaatgtcatttcaatatttcaggaaaaatgcaatcgaaccaccaattcgaacaagtacttactttggtgagtggaagaacggcgacgaggaattttatgatcaaagcaaaaaggaaaaccattagcttggcctagctagtcctgccaaaagcatttgatgctttagaaagataagtcatgtatccctagatttatatatcaacgacataaataatgaagtttttatgtatattaactaagtgtcaaatgatttttaattcattttaaattttgtaaaaataacttgcattataaacatttttcctctaacggtagattttagaataaatttatttagtcaaaagttattaaagctaaccaagagtgatttgatttgtatattaacgtaagatgatcacttctcaatagttattaaggtaaagtatacaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaaaaacagcagtttctaattgaagagacaaaactgtcactctatatatacacgaaactcacgctaatcagagagaagaatcatattaaaaacacaaaaaataagaaaaaaaaatatttataaattgaacgacaaaactgtcactttgtacatgaacgaatcccacctcaactcagtagcatgatacaaaaatctacttgctttggagtggtcgtttaaactaatgagtagacgacgaattaaaatccaattggcattttaatatataaatatttaattaatcattatcaacaaaatatttaattgtttatgatatactttttaaaaaatattattatattaaataattgtgctaaataaaaattgtttaattattattgagtcaatgttatctattttacgtttttaatattttaaaaagttacttttttttttctttctaaacaaacatgctactttagaagtgtttttaaggttctttgtagtaattttgggaaaaaaaattctaaataatcatattcaaatgagttaaaaacagacttttatttaaaaagttttttttatgattgtaactaaacacgtacgtattagtactggtataatataaaaacttctgaaagataaatctttttttataaataattttttaagcacaaactaatcactcaaatatgtaactgttactgactcaaataagcaaccattaatactattctgtaacacatatcaccacttcaaaaattacctctcgaatagtgtgtattttgtccgatatgaggtaagaggggacaataatcctttattaaagctaactatcctcagtttttcagctgttttattttattaatttggtgtgtaaggaagtctatacttcatgtggattttaattgtttttcatctaaaaacaaactcaatgtaaatacaaataaacagaagtccttatcattacaaggaaaaactataggctcatgtccaatatgttatatgtgacttatttcaatgcacaattatagttttataaacaattaaaacggtgctaattaataatattttaacagtgcagctctattaatggcaaggcaaaaagaaaaggaaagacaacatgcaatgcgcaggttggaaaagatggggaagttatgggagtccatatgaatatgacaaaggtggctggctgggtcaataaatggtgaattaaaatatcttctatagttcaagctcagaatagtagaaaaacaatatcacctaaagcataaagctaaggttaaatattgaatacaatgggaccacctcctttttgtagtggacgcaaaatgaccattaaggtattcctattttatttttattattattattattaataaacaaaaataaaatacatttttatgaaagaaaatttagaccacttgaattcattatgatcataacaaatctaaagactcaactaatacttataaaagtatttacacattatctatactagtaacatataatatctgagagattagttaggacaaactatttaaaaataaataaatctaacttataaaaaagagaaagtggttcaaataggcaaaaataagagatataaattattaatttttaagacaaataatcatgattttattaaaatacaaagatatattttgtttactcttatattaggttaagaggttaaatacataaaattagaaaagtaaaatataaaattttaagaaaaatacatgtaaaattgttaaaatgaaaaggtatatttatccaaatttaaagaaattaaaacctctgttattagtaacaaaaatcaaacgcactcattattacttggaaataaatacttataccacatatttatgctcaagtggagactttacagtggagtgggaccatgctgagaatttatgaagataaaagatggataaaattatcagccacgatttgattttattagttgtttcacgttttgtgtagcagcatgccttatggttgagtagcttagctggtgggtcttggaaggtaaagtagtgattgcttttcttgtctatgatgtttggtttggtcattttaacaacatcttctcacagtcacagagacagagagacagacacaacagacacgttcacactaataacataactgataattagccccttatcagttaaagctaaacagaacctcaaattcgacaaaagacgtggttcatgccttcatgttatctgactttcttcgacccctctctttctttctctctcttctattcttctttcccataacataactctctctctctctgtgatcttatctccttttaattattcactcacccctttacactggttgatgcaaaaaaacatggtaccctctattgttggttgttgctgatactcttcatagtcacaaagtaggtgactagcagtagcatgtgagcgaaggagcctgcagttttttttatcgtactatactatgtttgttatgtaagtgcctcttgttcacccatctcatcacctaaagatttgtttttggctatgcactttcttttgattcttccatgcattttgagccattccttctgctgctttttttttttccttcactcttctttttttgtttcacttttgtttaattattgtgctacttttccttttattgggttttggagtttcatggagctccactttggcttgcaagaaattaaaagttcatgttgaggattttgtgtcttttgttttgtggtaatttgaaaccgtttttgagatggttaattatagtattgtcagcttagtgacgaaagagaaggattaagcctgctagttgtgtatcaaaatttagatctatgatttaaggagcaacggaaagcctctgatttgatgtttaaagcatctgttttctgtaatttgtattgtttagtgatttttgtaactcttaattccctactgtttttcaccttcttttctcctataaccattctagaccataattaattaccttctttagtttttgagtgtctgtaatcttttaattacctgtttgatttccatatgatttggagctgcttttgggtggttagttagtctactataagaaagctatctttttagtgagtatatcatgtcaattgatgagacatgttgtaattatgtggttaatctctggatataatttacttctatgaaagcacggaagagataaaattttcagatttatggagataaccccatctgattaatccgtaacttctgttaaacctatcttatataaacaatacatttttcaatcttaattttatcattgagcaactgctggaaacttcttgaaatgacccttttcatctcaatataatttgaaaaatataatctgcttttgtcagcaaataaagggtttatgtctgtaaaatctggcatggtactctaccttaagactcgtgatttgagaaggacaattctgcaatttactaatgatgaaggacaaaatagttgtagttcacaacaaccgacaataccaaaggctacttttatgcttttgcttaatttagtgcatcatagatgcaacttaaattagcaacaaaggggaaaaacatgaagtgggaatctacagtgtctggaagcaatggagtgtactgtgctatgatcaactaaatagcccttgaagttgtcttattcacgcacttaaataaataaaaatggtgctcaacatcaacagactagacagattctactaattagaaaaagatatgaaatgcattacataataatactcatttaagtatatgataaggaacataacgtacaccttgcattcaaggctcgtgtgtgataaggtccataaggtacattttgcatttaagtcttgttttatacaacatatgcttcttttctgttgtacgcaatgaagaaaacaaaaagataagaaaaaattatgaaaacatttttgctacattgttgtcatgaaaaggttaaaaattatgaaataaaaaagtcattataattcttcataggtggaatctgattgtgtattcccccaacccctcaatttgcttacattttttaaattgccttgtcgtagatgcatgaattaacatctggattcatttaaggaccctgttttttaggggaagaaccaaattttgtttgttgtaacttaagtttcaaattccctagcaagaaaggttactgctaatatgatagtttgaaggtcatttcctctttttggtaaatataatataatttttacccaagcataattattgcctttccttaagcagtttaggtgagtatttgtgttcatgctggttttagatcaaagttattttttcagaaataagttttcagtagaaagtgttatctaaattggttttccatagagaattaaactacatccgatttattttttatcgacaaatgctactttgttagttgttagtttttgttaatgtttagttggcctgcaacagtggcctacaacattagtggacaggagagaacaattaactagcatgagtaactgataagtggtgagtttcttgagttagtgtgttcaaccaactaatggtgattgttagttagtagcacagtacgtgggtaaggtggcaatgcatagtattcttgatgtttttctgtaaaatagggtctgcaacaagaagcaattatatttgtctgcaaagtgcttctttttatttattggataaattcctttgaccagaactccagaagtttccttagacagttacttctggtgaaataaatgtgttcttacactcagctttcatttttattagtgtttggcctagacaagtttctgtatgtaaggtgaggtattacaacagtagaagggataagtcataagttaaagaggtttaaaatagaaggcagattcaatttggaagaaaatcttgaaatggaacaattcatcacctggtgtgtcagaggctatcaggttaaaacaaatgaaattaaaaagcaaatgagttaatctagtattgcaatacatcggatagttagtttctttataatagtatcacatgtaatacgatttccatcttttgactttctttaatagaggtaacggccctctttaatttatgaagaactggttggtaagcagaaacgatcatctatcaaagatggttcatgtcagctataagaagtataagcttgtgtatgcttgtaatccttaagaagaattctttaggtttagtctttcctatttgaccttcattcgccaatgtttgtttctattacttctatatatattacatgtcttctccttattctcatatcctagtatttttctatatttacttcccaagtcccgtttctcgtattgttatatcctcttgtgcaaacaagcgttgttcttttctgctataagtttgctgtttcatatattgttatatcctctggtagtctggttcataacgaagaaacatacttaggtttgtcctctgggaattcttttagaataaaagtaataaagtattcagcattaaccaaatgttttggattcaaagggactgtgtgaacaactgtataactgacatttagaaaaatacatgtggtaggattgttttatggtttgaatttctattctcttatgctttattcactttctatcatccatgatttttaagtctatgaaaacggataattgttagataacaaaaaatttggcaactttttttttttggtgagatgttgttcagagaagcactacggtaagtgaaactgttacatgtgactgtgataatggtttctcttttcattctaaatcatttctttgagatgttcatgcttcatacaccgagcatgcatcttgatgaaattcaaatatgccaattattactttgttctgttttgctcaaggtttgagctatgataactctgtattctctctgtttaaagcacttgagtaacatgactcgcattatgttgaccatgtaaacatctcaaaatgtatctgatttccttagtcttgtggaaggaatgttccatagaattatcatcagtaatatagaaatcctaacatctttttatgttcctgcaatgttatttttttattttattgatataagactagtgtatatgttttgctccacatgatggatttccatgcagttacttctcatgtatatgattcaattggaaatggtctgatctactttaattgcatattactgccaacttcatgttgatgcttgaatttgttccattttgcatggttaatcaaaattcccaactttacgtagcaaatagtgtatttaatcaaaatgtaggtaatgatatcatgttaagctgactaaagtcacagatttgttctatcactgccttcagggaaagaagttaactcatagcaggttcacacaaacatgatgactccaaacttgaacttggaacctgaaaatcattcagaaggcagcagccaagtggcttcaaatgtatcctttcatgaagcatctcatgatcttacaaagggaagcaccaccacttcctcctgtctcacaaaggatgaaaccgatccaggttctattacccttgacttgacactcaactttagttccggtgatggcgagttgaaaggctcaagtgatgctagcagtgaagtcggagctgaaactcctgcttcagcatcagcaactccaagggttttttcttgtaactactgcaggaggaaattctatagctctcaggcattaggtggtcatcaaaatgctcacaaaagggagaggacaatcgctaagcgtgcaatgcgaatggggatgttcactgagaggtatacaagcttggcatctctacctcttcatggttcacctttcaggtctcttggccttgaagctcattctgcaattcaccaaagacacgtgccgtcctccatgacagcactgagggctcctgaaatgagagctgctgcaaaatttgagagaaaccaatttggatcactgattttcgtggaagatgatgatgttggattcttttggcctggcagtttcagacaggtagaccaacaaggagctggtgttaatgtaggacatgctcaaagttcaaatgctagtttaattccaatggtgcctcctccaccacaagcttctacatctcctgatctcacattgaagctttaagtttaaggcttaagaatgatgatacatacacaagcaaaggcctcacaaagtaataaataagtggctaagaattgactcatccattgctttgcattcaggcaaaattttctcaaccactcattttcattgtgaggggtttaattatcagagtttttatgtgtgtatgtatcacttctcttgagattttttagtctttgatttcattctcttcagacatgaacttattaattaatagggcgtgcattgtacagtgagatgtgtatttccaatggcgattttaatggtttcctctcatgtattttacttcattatacatgaatcatgatactgcgttcaggataatggactaatgttttatatctaaaaaatgtgtttgtgatgcactgtttgacggaaacatgaggtatggatgtgattcaattagcaataattggtggatttttcttacaggagttcgaatctaaatggaaattcctatgattaaggtcatgttgtcacatgttcaagtgcggaattgatttctcaactcacctcgttaaaaactaaaaagattgtagtttatagagattgtatgtaaataacattttctagtttgtcacataatcctctggggacatcatatttaagcgaaatatagaagaataaaatctccaaggtgataactaatagtaacagctttttaattaagcaccccaaaaaggaatcaggtaagtcgtataaattctacctttaaaaagtagatttaaggaatataaagctttgaaagcaagcacatatattcatgcagtggtaaacaatcgtgaacgttatattacaactacgaatatatttttttcgtctatgttgacttttaagtgttatgttttgtttcttcggcttgaagttgttgtgaagtcattccaattgaaagtgagcatcttaagcatcattttgatataaagtttcgtaagaaaccaagttaaattaatgtatttctgattacgttctttagttagaccttactttattgtggacccttaaagcccagtggatcagctacaatatattgtgtagtatatatatttaagagttgggaaaaactttatacacccatattaatacaccattccaacttttttaaatggccaaagtaccctcgtgaatccgcaagtaagtttttttttttaatttaaaaaatatttctccaaataatgacttcatgttattaacacgacacttcaaccaactgagctaataggtcaattgtgctaaaagtcaattaatgttgatacatataacattaaaatttttaatatatatttaatacacgtataagtttacataataaattttgtaacaattaattttgatataataattaaagtattttttacatataaaaatcatagatttaaataaaaatcataagttcaataaaaatttgcaggtttaataaagtataaatatagatataatttttaatttaacctataaatacaaatataatttttattagacatgcaaatttttattaaaattatgattttttttaaaactatgatttttatatgtaaaaaaaatactttaattattatatcaaaattaattattacaaaatttactatgtaaacttatacgtgtattaaatatacattaaaaaatttagtgttacatgtataacattaattggtttttagcataattggtctattagctcagttggttggagcgtcacgttaataacgtgaagttctcaaatttgagacctgcatgtgctattattttaaattatttggaaaaatatattttaactttaaaaaaaaaacttacttacggattgggtaatctgtatggcccatacggattgtccaatccatatatctcaaaaaaaaatacggatcataataaaagtgaggatatttttggaaatgcattgttcagaatcgtgtattagtgggtgtataaagtttttcccttaagagttacatgtgattttttcttttggtcaacttgcacatgagtttactggtgtaaaagtagggaagaagatgggcttaaagactagtggatcagctacagtaaaacccagatggagcttaaacaattgggccttgacccttatttggttcctttttttctcatttttctaaaattacggaatcaactatggaacacaaaatataacataaaagtcaattgaattaacacgattgattgaaagataataggagcacagagaagagaagagaggaagggtttaaaaaataaacttagagcatctccaaacaggaatcttcactttaattcttaaattactttcttggaacccacattaccgcatcagctttcagaattttgttaacattttgcttcaaccatgaaccttcacttcatatcagtggtttttccggtatcctcacatagctgttactcgatatctttataaatgcactttaagtggttagattagtaatgttattatggccttaagataagaccagggctttgacccttgctactttagagaactcgattgagaaatgggcaaaggcttgatcaatgacctagcactaagtaggcatacgaccaagaggatacataactctcaacctcaagcacgaaggctagaggaaagtcatacctgagcaggtacaatcaagtgactacacaatccttgagactcaaacttaaagacacaaaggataaaagaaagtttttttacctaattagtgtacaatgagaaaaatacacaacttctaacctcaaatacagaggcacaaaaagactaaaggaaaaccacattgatcaatgtacaatcaagagagtacaattttgtattatacaaatacgacattaagtacaaatatatctttaaaatacatactcacttttcttgctgttatacttcttttcacttttatcaatctaaaacaccttcaaaatctattcattctcttttgtctcttacttctttctattctgttttttcctatcaaaatctttaattgttcagacgaaacattaactcatcctaaacagatacctcaatagaagaaaaaaaatctaaaataaaaagaatagaacgccataggttgggtgtgtcctttattcataggccggaaataggggccgttgctgttgacatatacttgatcctgaattggactggacctctgggactgggtcatggatgaggtgtattgaacctagtatatgcttcattatttgaaatgccttggtcaaatatgccaatgcattaatgtaagaattttatgtttattaattaatcaaaatgaaatgttcgaaggtagaaagaattgtataattataatcgaaaaataaattgtataattagatcaaattaaaattcatttgattttgaaggaaatgaaaacattcacgaaatctatttattcaccttttaccctctttcatttacatttttctttcctaattaagaaaagtgtagttatatactctgtcaaacttattatactattcagtaaaaaaaaacttattattctattaattaaataaataaagatttaaatatatataattttcaaagtagctatggaaaatgttgacttactactcacaatatttacttctgttttgacttgatttgattactcttttttcttgtgtacatataattggttaccactgtatatatatttggatcttcacttggagtattttaggagttatattctttcttagtaagtcatatttcatatacaatgagtatttgcttttacttgttatttattttattttatttctttcaaacactattgcttaaatttattttcagtttttaattttgaatcttaatatactatataaattaaatcttgagattatgataacattaaggaatcttaatttcagtttggtttttaaattttgatagataatatatcttgattcgatgatctattttaataatttccttttcaattttagaagtctcatttatttaatttattattatataataaaataaaatatttattattaaagtaaaacatcgattattttttattttttatttatatattttattttaattaaaaatgcttatacagtattcggtaaacttgctagctataaaatagataaataaagttgctattcaatgtacaaattgacctctataatatcatgtctgattaattgtgacaaaataattattattatttgaagagaaaagtcttaagtatcctctttcaactttcaaaaaacaaaaaatcgtcttttgacctgtatacatttacccattacaaaatttggaaggaaaatgaggagagaaaaaaaaaagggggacattgactttttgtttgaggtatattaaggctttgtttgggagttaggaggggaggggaaggaaagagattcaaggggaagggaggggaaggaaagggaggaaaataagggaagttcctttatccttgtttgggagttaaaaatatatcaagagagggaaatagagagttaataagaaatttttacaattttttcattatttaaaaaattaatacattatatattttacactggttatggtagggtagtaattttattaacactgatgatataagataataattttagttatttttccttctaaaaaccccccaaataggggggacaacaatttataagctttggaggatttcagaggagttttgaaaatcctcaaatcctttccctcaaaaattaaaactcgcaaacaagggaatgactctccctaaacctttcctttccctcccttcccctcctaactccctctcccaaacataccctaaatgaatcgccgtgtcgtatatttatggggaatttattgtcttattattttcccatttggatccatccatccacctgagtttgcataccaaaagtaacacagcgttggccaacatttgacttttttgaaacgaaaggaagcaacgtcccattttccgttcatttgtgaaataactcatacaccttcaatttggatttgtatcgcagcagtgtcaatatctaatataatagtcatgcattaatcataaaattattttatgaggttaattaattacaatctattgtgttaaattcttatacagtaaagaaccttctaactgcttggacggtcaatcgaacagttccactaccgaatgttcatagtggagtccatctcaggtcactaactgctatacttataaatggagagtagataaatgcagtcacaccctcaaatacatcttttatcacattttttttcattgattgacctcattttattttttaatgagttatttgtacaatgattgaggttataacattttataattttttattttattatttttattaagaagaagataaaattaaattattattcaatattagactaattaacacttaaaattcttagtgacttagacattagaatctcttttagagagatatctaaatatataacatctcacttagatttggagtggacattagatatagaatcaagggatagacttaacaaacacnnnnnnnnnnatattccaatgactacactgcagcttctttgtcttactcttattcccaccctttctctcacaatccaagctgttcactcacccgcaattcaactgataattttgattactcagtgagcaaagatgaccaaatttggaactgtggagagggcactaatggctctgtgcatagtaggttcaagcccattggagatgggttggttggtttatccaaccatggtggtgctgctggtggtattagttcctttatgcaaggtaataatagtcagtataaaactaatagttcagataaccattcttttttcccttcagagttgcctgcaaggccaaggtttgaggctcagtcaggggactcaagggggaggaattctgagaatctgagaatcttggaaggcttggatgatgggaaggtaaggaaaatttctaagccagagagaattgttagggaaattgtttcagagtctatacctgtcatggcattgacaattcaggagcttaccgatgatgtcatagcatcaactaaggaatacttgaggaatctcattgagaagcctgagaagaaagaggaactggtaagcctccagaaccggctcgagagaagatctgaccttactaaggagagtctttcaaagtgccataaagtgcaattagaggttttagtggctgtaaagacggggcttgctagcttcctatctaataaaattcaattgtctgagatggtagaggttttcttgtttaagaggtgtaggaatgtaacctgcaagcatttgnnnnnnnnnngtgttgtccacttgtataaatattttaatttctttttattattagaattgagatttagttatatttgacattaatatagatagattattttttcttatgttagaataagatgaagtaatcagaaaatgggttgatttggtggggaggagaattacacctcctatttatataaaaaaaaaatagatttaaatatgtttttggtttatgtaagttaacattttttatattttattatctgtaagtttattttttgaaaattttagtccatataattttactttttttcatttttgactaatgaaagatatttttcttatttttagtttttataagtttatacttttcaaaatttaaatttctataaataaaaacttaaaactattgatgaaaaaattagaatattaaaaagaattattttttaaaaaaaatacaagaagtaaaaaaaattaccgaaatcaatattgaaaaatagtctcacaaaaactaaaagtaaaaaattaaacttacagaaataaaaaataaataacggtaacttagagacacaaaaacacctttatgccaaaagaatattttgtcctaataataatgagtgaagtaaacgaataatggtaatatgatgcaaccggcaaagaagttaaaaaggcaatggatgaggtttgtattgaagtggtcgttcattcactcactcactcgtgcttggtggtggtgaggtggctgagctgcgcggagctgtttgatagggaaaagtaaagttgcagtcaaataaaagaggtccacttgagcgtaattctctccgctttcaagggttaagactgtaatctcacacatccagaaaaaagcatgccctttatcgccgttttttattacaccccttcagtgtgaacacttgaataatgacattccggccgttgcttgcagactatcccaaactaaaaccaacgttcccaacgtaacaaacaaaagaaaaaacctctggttctccctttattctcttgccatgattagaagtaaagattgtgttgctgactctgaaggtgagaactccaggagcaagctctcaaggcacaattttgaggccaacaaggagtacccagatgaaaaaggtgttgaatttctgagagattcagaagtgggtggtggtggtgttgatggggttcttcactcaaaacccaccaaggttgttgttggtggtggtggcagcagctcagggttgcaagagttgaccctcagctacctttgtgacttcccaaaattcaatcttgctgagaaagagattcctggtaaaagcctgctgaattccttggaaaaaatgaaccacaaaggaaaagaggttctggtctgtgagaattcaaatcaagatgggaaatgggtggaaagagattttctcagcctgagtgagccaagggaagattcttcaaagagatcccttgaggaagttgttgagacggagactaatagggagaagaagccaaaactggagacacttaacctttctcttgctttgcctgatgtgtcactttcccttactgcctcaaacgccttgcaaaacggtgatcaacaacaacaaccaattaggaccaaaccttgcaggccatccactactactcacacttcatattccaatgactacactgcagcttctttgtcttactcttattcccaccctttctctcacaatccaagctgttcactcacccgcaattcaactgataattttgattactcagtgagcaaagatgaccaaatttggaactgtggagagggcactaatggctctgtgcatagtaggttcaagcccattggagatgggttggttggtttatccaaccatggtggtgctgctggtggtattagttcctttatgcaaggtaataatagtcagtataaaactaatagttcagataaccattcttttttcccttcagagttgcctgcaaggccaaggtttgaggctcagtcaggggactcaagggggaggaattctgagaatctgagaatcttggaaggcttggatgatgggaaggtaaggaaaatttctaagccagagagaattgttagggaaattgtttcagagtctatacctgtcatggcattgacaattcaggagcttaccgatgatgtcatagcatcaactaaggaatacttgaggaatctcattgagaagcctgagaagaaagaggaactggtaagcctccagaaccggctcgagagaagatctgaccttactaaggagagtctttcaaagtgccataaagtgcaattagaggttttagtggctgtaaagacggggcttgctagcttcctatctaataaaattcaattgtctgagatggtagaggttttcttgtttaagaggtgtaggaatgtaacctgcaagcatttgcttcctgttgatgattgtgactgcaagatttgctcaggaaacaagggcttttgcagttcttgcatgtgtcctgtctgtttgaactttgattgtgcaagcaacacttgtagttggattggatgtgatgtttgttcacattggtgccatgctacttgtggtattcagaagaatcttatcaagcctgggcctagcttgaaggggccttcagggacctcagagatgctttttcattgtattggctgtggacatgcctcggaaatgtttggttttgttaaggacgtgtttgtgtgttgtgcaaaggattggggtcttgaaaccttgatgaaagagcttgactgtgtaaggaagatcttcaggggaagtgaagatcgcaaagggaaggaattgcatgctaagactgatgacatgctattaaagcttcaaactaaaatgatatctcctttggatgcctgcaattacatcatgcagttcttcagctgtaagtgtctggactgtggtcttttcaattcatatttaaatttgtgttaattttttttaaaaagtatatatttacttcataaatacggcatttaagtgctaaggatacaatcatagatacagcatttaagtgctatggatgcactatgaatacatcatgatatgcttggtctaaacaagaagaaaggatcagtccattatcttcaatgggattgagttaagaaaaacacttgatatgttagtctttcagctcttaatactgtatattctagtgttacagttagatgaaagcattttcatatgatataaagggtctctttgtagtacgattatttattggaagtgagcaaaatcagtggcttttttatgtgatttggtaggatgtgaataagggaggaacaaatatatgctctggtggagagaaggattactgttgataaattatattgtgcttctgacagacaagagatacagtatggcacatatcaataaaatgagaagctcaattatgctctttttataaattatggaactttgaaccccatttcgacttgaccaacaaataattatgctccttagtgtctggctgtccaaggccaaaaagtagaataacattgagaatagccaacctcagttttccttttctggcaacatttttttatttgaagcaggaaattcagggcaagttgagaaatgatttgtactttaagaatgcaaattgaaaaccattgaagttaatgttttaaaatggattataagcaggtttgcttttcattttttaagcccaaaaaggaaaattaggccaaaatctcctctctcttgaacattttgattataagttttttaaaaaacaaaagctaatcctagcattcattatatgggggatttgaatatcattttataaagtgattcgagactgctggatgttttatcaacatcaagttgttctttgtcaatcaatcaggcttgcttatttaccacaaccaattcactttcactattcagcttggatatttacccccaccccaggcctgttatttcctgtgtagttttttagtgagcacatgctactggcatttgatgcccctaacagatccaggaatcatcttgtagtttttaaggcagtcgagctcagtattacatttgataaagtttaatatgtttttatgatagattgaaaacataaaggaagaggaatgttgcttttcacactgaactgcctatgcatcaattagttatggtcttctgatgctcaatttgcatggataatgaattatgtgtttgatgaaactatttgcatctttttcccttcctggttaagatattttcatcttagcattggcattttgcactgaagtacttcatgagataggaagcaatggaatgccattagttcttgagaattgcagtggtgggtgaaactggaaaaatgtgtataaaactgttgcttgtatggtacggttgccattatctctttggctttgttgaatatgtttgatgtaataattcaaactacctgtgaccctgtgatttttttatcaaatgtccttttgtatagaaggcccttttccttctttagcttagttattgctaatgtttttttgatgaaggcatgttttctctaattaaattactgacaatgatatctaactgttgagagattttttctgataaacagacgcggacagcatgtcagactttcatacttctggtatttcttcaaaggatttgccagcctctcaatctaaccttacaaaggatacaccatctctttcaaaacctatttctctattaccaaaatatggttatgacatgggctattctaggtcacatcctgatgccatgtcaagtgatctacttcagaaagacctcaaatcttccatcttaagtgaactgaaaaatgaggctgatttacatttgggggctttattaaggaaaggtggacttgaaagtttggagagcattgtgaggataaaggaggcagaagccagaatgttccaaaccaaggcagatgaagcaagaagagaggcagaagggttccagaggatgatcaggacgaaaactgcgcagatggaagaagagtacgccgaaaagctttccaaactctgcttgcacgagactgaggaaacgcagaggaagaaattggatgaactgaaagtcttggaaaattcctattttgattactataaaatgaaaaaaagaatgcaagatgagattgatggtttgttgcggagaatggaggcaaccaagcagcaatgggtttaaattttatttttgttgcttttccttatgttttcttattgaggatactgctaaatgtgtaatttattgatatgtgatgtcttggtattctggtggttccctgaatggatggttttcaattgataaaatcaagctttttggtgtctcatctttgtttctttttccttcataaatggagatggcacaaatgtcaagctggacatgttaggtgtgaaagctttgcacttcctgtcgctgtttatattacgactttgaggctataaaacctgtaaattttttcgttatcacatcattgttgcacatagatttgcatcttcctttattataacattttccctttaagaaattgaatccttttctccattttatatacttagcatctatctgtatgtttagatcatattatttttaaaaaacaatttctgtcccaaaaaacaatttattttttattaaattttaagagaattgagataaaacaattttaagtaggtcttaagcataccactgagtgccttgattaactggtggggttattttagtttagtaagtgatttcgagttctaaactttatatccaattgtgttaaatatttttttaaaaaatttacagcctatactaattacccctaattccagtaagcttatcctttgctaaggatacatgtgatttcgaagagagaaaaagaagtttttctcaagcatgttactattatacaaagatcctccaataagtaggagagagaaagcttgacattattaattttgttactcttggtggatgcagcataaaggaggacagtgctcaagagcactttgcttgaatattatttgggttattcgtttatttgctcaccgttgattgctgcttcttaaaccataatttgcaactgtttgtgcttatgctgtgttttgccacttccagcattggaactagttccaccaaggtgataatgaaagggaatctgcacacattcatattagtgtgtgacatccaaccaatcagctctaattggattccattcgatttattattatatactaccatcattttatttcctgatcactaagctggttgtgtaatggtgactttcagcaaacattatcaatttgctattatattaaggtagaatcgaattttcatcatgcttgaggaataatgaaatcattatactctctaataccgtttttataaactactagtataatttaatataacgcttaataacaacttacatcaaagttcagaaaaaagaacttacatctcaaattgaaattggacaactaacaagttagatagttgagttaattaactatttgattaatattcgacttctagtaatttaagattcgatttctgattgaatgtataaaaaaatattatatccattttgataatcaatctctgtctttaaaagactaatttatcctgggactggaagtacatataaaaaaatatcaaagttgaatcaattgataaaaagacattataataattatatgttgacaatcttaaaagtcacttagagagaaaaactatctctacaatgtttggatatttaataccttccaatattctttcagccaatgggaagcaaatcctggagcatgcctacaacagtaaagaggtatgtataatcagtgatctatttctgcggaataggttattgaaagcgtatggatgcagaattcaagactggtactacgagggacttgcatatccatatgttgacgatgcgtcctgatatttgtatattctagatatcttcacgatggatcttgtgagaatgacagtaagtggtgtagtattgtaagggtcttgttaatcagtaacattgattaaaaaaataaaaatgaaaaatatttattgtttaaattagagtataaaaaaaattatgaataattcaatttcttatctcttaataaaaacatttctattataaatttcttgaatgttatctttagtacactggttagcatttgcttaattgtaaaggtttgtatctttttatatgctattccgtggtatataataagattctgaaagcttgtgagctatctgttaaagatgtggaattctagggttgtctgtattctgttggtagtctactcagtgaatatcttaagcactgggagacaatagtatataacatggcacttctggtgcttttttatcaatatataaatatacctttgcttattaaaaaaataaacataatgaaattaaatgaaaagacagaagaaaaaagaattgnnnnnnnnnnnnnnnnnnnnnnnnnnngacttaacaaacacttggtgagaataatatatatatatatatatatatatatataatggattaagttatttcaaaaaacactttaatagaattattttcaattcccaatattttttaaatctaatgattttaacgaataattattctttattgttagatttcaaaaaataaaatgtaaggatgaaaagtatcttttttaagattattcatgcaataacttaatctctatcttaagtaaccatgagtatatttaagtctatttttttatcatataattgatataaaatgtttactagttttatttgtgaccatttttatcaagaaacctggttagtcacttttagtaaaatcttttttttttaatcatttttttcattaacaaaacttaaactaaaatcttttcttannnnnnnnnngttgtctgtattctgttggtagtctactcagtgaatatcttaagcactgggagacaatagtatgtaacatggcacttctggtgcttttttatcaatatataaatatacctttgcttattaaaagtataaacataatgaaattaaatgaaaagacagaagaaaaaagaattgaaagtataatttatattaattatcttagtacgatgttagatgataaaatgatgataatgacaatgatagtggaagactaggaggagaagataaagaatttataatgattaattaaattataaataaaaatagatattttgtcttttgagtatttgataattaagacaaatgaaatattgtatgatttattctgtgacaaaaaatggaactgttatcctgcccatctttatctaatttgcaatatttcatttttttaaaattaaatattatattgtttagtacgacaagttttagcaaaacaaagttaattgtgtcattcttaaaatttcgtggagccatgacgaaaaaataatttggatcattttatatttaagtatttcaaaatataaatatatattaaaaaatagatacatgattttattagaatttatatattttcttatattaaacaaataacataactttaataaatctctaaataatatattatatttttattcaatttactctagctattatcatctaatatcattcaatatatttataaaataattatataacataaatatctatatataaggtagacatcacaatgacataagataggataggtttaataaggatcaaatttgtctagtttgagtcttcaaatcaattcaaaccaatttaatcataatcaaactatcatatctattattaaaataatgaaaaaatgaagaaaaaaaatagaaaagtgattatgatatcatgcaattttatacatttaactcaatctattttttatttactagtctaatatgaaacatatgttaaatttcaagctaaaagttaagtcatgtcttacattataggacctgcatgggttgggcttatagcaaaagttcttagagtgtttcttcctgcaccattcattttttctactacaccattgatgaacagtgcatttccaaaattgtccttcgtgtttttgcaacttttatacacggatccgtatgattcatgcttacggattcgtcaatccgtaagattcttacggatccgtgaatccgtaagaatcttacgaatttgtcaatccgtaagtttttttttttgcatgtacggattgggcaatccgtaagcccaatccgtttgtttttttttttgaaaagttaaaatatattttagaaaataatggtgcaagcaagtatcaaacttgtaacctttaagttattaatatgatgctctaaccaactgagttaatagaccaattatgtcaaaaattaattgatattgatatatatatatatatcactaaatttatttaatttaaaataatttattatgttaaaaaaatattgtattaaatatacattgaaaattttagtgttatattagcaacattaattattttttaatgtaattgagctattaatttatagtttaatttattatgttaaattttataataacattatatgttaaaattacatgttgaattaatgcatgcagacatatctgtaaattatatgtaaaatttatattataatttacatatctgtgaaattatttaatgatatgaaataaattgttagcttcaaataaggataaaaaacattaaaaaatgtttaagaattaaaagtgaaatttacaaaaagtgtagaaataaaaaaatatattaaaaaannnnnnnnnnnnnnnnnaatgtatatttaatacaatatatttctaacataataaattattttaaattaaataaatttagtgatatatatatatatcaatatcaattaattttttacataattggtctattagctcagttggttagagcatgatattaataacttaaaggtcactagttcgatacctgcttgctttttttagtatgaaaacaaaccagctcaattagtcaacttatatcccacaagagtccaaaagatagtaagaaaaaaaattacacaaggcatttccagcaaataaaaacacaattaaaaaataaaaataaaaaaaaatgtagaaatgctggaccaatcgaatttgaataaagtacatggaagtggagaaaattaaatcaagagtaatttcgggcataacgggccaaacccactgacatatctacaaagactccaaacaagagaatagcaagacccgtgaagttgattaaatgagattctctctggtgtggggagggttttaacatagtatacttctccatcaaccctgttagtgcagcacaaattgccatgaaaaatagtgctctaccacctgctacgtgccatggggccattgcattccttgattgtgcagatccttgaagcataaaccccagtcccataagccactgcacccaacaatcacgacccaattattaaagttttgacatatatgacctatattactgagtaaattatctctaaggttttgtcaaatttgttctgatgtcttttgtttttgtaccctcacacagtcacactagtttttcttaattatttaaaaacattacacatgacacttcgtattaattattcaaaaaatagtattacatagtgtacctctataaaaagaatgttgtaaatattaaagaagcatgaaactatatacaatctccataagtttcagagagtgtcaatataatttactcaatacttttagattgtcactacagttaaaatcatatataggcgttcattattgttaggatcatgtacataaaatgttttttctaaaataaattaaacttttgtttttcatataaaacaaacttgtgcacttaattttaatagaagttttcttatctaattttgttaaaagttgagacgcagatgttgatttatgaaaaattcaatttattttatttttacttttattttttctcccgtgagtactcacaaaaaaagtttaagattgtatagactaatacctgcaagccaaccaagcaaaaggtgccaatgccaatccatgaatggaggctggttacgtcctcccagtttaccatatcattgaacttgaaaacggcacatataccaacaatcccaagaattatagcaatgaaatgaagtgtcaagtgaatgatcttctttgtttctcgtggccctggcaccgtttggtatgacagtattgctgctcaaattttacacaccaacctaattaattaatcactgtagaaaatgatacgctatacacttttgtgtatatatgtatgtatcacacattaagttgttcacatcttgttcagatcagtccaaccataaataagatctaaaataaatcttaaaagattttttttaaataaaagagttatagattaaatgtttttattaatatatgtgacttttttttaacatatgtgattttttcttaatttataaaaattaatagtaattttttttattagtagacttaaaacttaaattttaattactttatttggatcgatccaaacaattaatattggtgaattaagtcgtgaaggaaaacaaatatgctaaactgggataacaatgatgaattgaatgcagtatagaagggacatgatgtgagagtaagataccttgaccaataaggaaaatgaatccaacgaacatcataaaagggtgaacctgcaaggtggaaaaagactcagatatgaagtagaatatgatttttgtatataaacacaagcaagaaacacaagaaaatagtgttaattacattgaaaacacgaagtggattttcagaatcatattcaatgccctcacgataatgcagcaaccaaacaagcaagaggatgagagcaagaagcccaaacaagtgtgccaaaattgtggtaccgtataaagtcatcttaatggattaggtgggagataagatgagagaaaatttggaagctaggagtaatagagtgagtgaaattttgttatagtacaatgctggttctgacatggtgttattctgctgtggttcagtcttatagagtttaccttttgataaagttcacaaaagaaggaattgcttgatatcttggttttggaattttgaatgaagaaacttttggcataagccaactctagcagtttctaaagtatatattcgtatgttagaatggtttccaatttttgtctactatttgtataatctttttgcatagggattgatgcccacggtgtcagagactcagagtattatacactacaaaccacgtgtaaatgaaattattttctgtgtaaatgcaacttttgaactcacatgatataaacatttgaataccaaactattttcgtcttattaaataattttctaagagttgtgattaaaaaattaatagtaataaagttttgattaaaaatcttgttagaggtgcattaaaattataataaaggtattttaataatatttttagtcatttttttaatttgttaaccaatattctttattctctaattaacacttatcatgtatttttagtgtacatatatcagagatgtttcaaatgacaacatctcttataatgataaatgagaacaatcaatgacaacctttagattacaattgaaaattttaatgaaagagattaaaataattaaacacgtgactttctcttcttcctcttctttctccacttcacagttcacaagttctaaattctaccacattcaacgcctctttagatattgcagatatagtgctctcaattctagcacgttaattgaatgtttgtggatcaacatgttaagttcttttgttttttttcttcaaatattgtcattacacaacgcacattcagattcagaggttgggctgttacaattgccttttaccagttccaagataaatcataaaaagttttgtaaaaaaaaaaaaagataaatcataaaaagtagtagagacgaacaaggaaatcaacttaagaggtaacaataaggaatgacttgaacgaggaatctacccatacatatgaggtaactaagtgcttctttatcttcaagagaaataaaattggttttaaatcattcgaatatgattgagatgtctgtttaaattaatctcaataataattttatattgaaacatgttcattatatggaaaaaatatttttgatataaaattaacactcccgtaatttgattcagatttaaatatatgctagaattaaattgatcttgaatacgattttttaaaaaaaaaacttaccccgtcatatatcttacaataattaatcaagttgtgcatgaccggctcaacttatatctaaacttcaaagtgaattttaggcataaatctcatttttttctattatatttgacaattattttattttcttatattaagttttaaaagtttatctttcttattttaaaaaatgttaattttgattaaaaacgttagagttttgtttatttttacattttaaaatgatttaatatctttttttattcattatgtttcgcatatatttcactttgatacattatgttttaaaattatcattatgatactttactttttcaaaatgtatggtctttttttcaatttttgttagaaatttagtgtctatcaatattttaaaattttagaataattaacttaacatagtggcaggtaatatgtcactatcttttttatttaaaattaaaaatcactaaataaattgaagaaaaaagaaggatttgcaaccacgaacaactacaataacaaccttcactcttatattattattagtattattctcttcattcaatttaataatttaataacgacaataatttcattcaacaattattctcaatcacaatgggttatgaccctttcttcttttgttatttcacctctcaccgttgacccaaaacgatcattgtctcgccctcacttttgtctcatcatcgtttctaacaacaacgcgttgataaaggcaaataagaagatcgacaacgcccgattgtggatggggtttgactagtcgggcctttcataaacatcttccaatgaaactcattgttcgacccttctttgtgttgcatatcttgcctgactcggttgtagatgtcggatggaaaacttctctacttgcccgggcttgctcatagacctcacaaagagtcacattgtgacttccaagttcaaatctgggttaattggctagttaaggtcatgtttttgtctttcgtcgaagataactcttgctcttatctctcctacttctgttttcaatagcataactctgtgaaaggttttggttttcgatgaaaagtataagaattttttgtggttccagcgagattacatgttgacgttgttcaatctatatggtgatgcattttttaccttttcaaatctagaagaaattggaggagatgatacttatttttggttgtttattttttaaaaaataaagatagtgattgtttttagccgccgctatgtaaaattaattatattaaaatgcttatatcatttttttttcattatatcttgtagttatttcgctttggtacattaaattttaaaaatttcattttgatcttttatgtttcgaaacgtatcattttgaacatttttaaaaatttaaaaattaatagaacactagtgtttttaacgggatattaaaaatgatcaaaatgatacatttcaaaagcataaaagacaaaatgaatcttttaaaatttaatgtactaaaacaaaataattgcaaaatataataagccaaaaatgacattaagcctaaattctaagatataaagatataattttttaactaatttaaataatttattaaaattattgttattttgcttgaattttcttataaaaattaagatacaaatttacttagtaattattgtattcaattttattttatgtttattttttaattaataataaatcgatttacttaatcttattaaagctttattattttaagtaatatttattaaaaaaaataaaactgtatttatattgaaacggagataaattttgacaatgtttcataagtaatatatacataataagtatttaatttttatatgacaggagtgtctggcaagacatgcaattggggggcttataagtttagtcgactacttaagagagagaaaaataaaagaaaataaaaatatttatttaacatagtagtataatgaagttttttttaaagaaaatatttgtttttaacataatatatatgttaattaagattattttttttatttctgtctgagcggaccatgaagttgtgaattgtgatattttgttatcaaaagacattgcgaggctaactttaaggccgagaaataatgattagataaagttataaagtccacttaaaaccacaaaacatgaaaataaataattttgaaagtttcgaaggattttactattattattgaaattaatttaaatagacatcatatatatatatttcaaatttgtaaaaaaaaaattaatttcattatcaatttattagtgttaatagggtaatcgatttacatacaactttacatcaaacaatgtaaatatgtatgtgaactgtgaactgccccacaatcagacaaagggcaagcttttacaggcacaaggaatcaaagaaaaagagaaagctagtgagcaaggtaaagaaaagaatggggatccaagatgcaacctcccatttttaatgcagccagccctagttttttcttctttcgatgattccaatgcaacagaagttcaagtgtctccatctgtacacaagaaatagaaatttacattttttttcttcttaaaactttaagtagcaattactttttgagtgattagcaagtttgtgtttgtgtgtatggaagagtattcatatgattgggctgttgagttgggttgtgaaacctcttcgtcaagggatgcgctacatatatcatataaatttttaatacatcatttatgaatagtgcatttctaaaaaatatgatgttctaatcaattgagctaatagaccaattatgttaaaaattaattaatattgatatatatatatcactaaatttatttaatttaaaataatttaatatgttaaaaatatatgtgtattaaatatatattaaaaaatttagtattatatatatcaacattaattattttttaacataattgagctattaatttatagtttaaattatatgttaaaaaatactttaaactataatttaatagctcaattatgttaaaaaataattaatattgatacatataacactaaattttttaatgtatatttaatacatatatattttaacataataaattattttaaattaaataaatttagtgatatatatatcaatattaatcaatttttaacataattggtctattagttcatttggttagaacatcgtgttaataacttaaaggtcacaaattcgatacatataaaaaaaaactcttacaaattggagaatccgtaaaattcttacggatttgtcaatccgtaagtgtgaataatacggatccgtgtataaaaaaatgcaaaaaagcgaaggataattttggaaatgcactgttcataaatgatatattagaaatttatatggtgtatgtagcgcatccccttcatcaattgggctatttgggtccggcccaagttgccttaatcagtagtgcactttgtttgctcagatcagggacaccaaagtattaggcctttttcataaggcttcattcagacattcactactttcggctttacaaagtaacataattatgatcaacagataatacaacaataagaaaactatatatccaacaatcatgtacaatcacacttatttaatacagatattttctggcagtggaaaatcctacaatgaatgtaatattttacttttaaaaaaaattcttaacaatgaatttttttccgctaatattgtataaaatttaaaagaaatcaatttcagaaaaatacaaaaagggcatgcaaacattgcagggatggctggacccagaatgcatgtagttttaaagctctttttctttgttggctcttattttgcataaatattgttgcctttgtcttcgatcctagatttccttcttctttttcttttatatcatgggaatgccaaataaaattatgagaagcgtatacaatatgctagctgcttgtcagatgaacataaatactctggtcgagacattttgcttaatctactgacatttgctctaatatactagctttcgatctagtaataattatcttctatagttctgtgccatactctatagacattagacatgagatgtttttttttttaaatataaatgatatagaattctgtttctaggttagtttagtagtacttgatcttggaatggtttgttacaatacataaacttgtagtccacgttaatatattcgtatttaatatggatgcaatatatattttatttagatttttcagctttgcaatataaaattgtgtgtacgtggacaacctcttaactgccacagattttgaagtaagtgaccaaatctcaacacggttaccgcattgtttacacaaacattaattagtggcagcttatgacgtttctcattgaatggatatctatcaatcatttcagttggcaaaagaaaaaggaaccaagagggttactaaattatactagcatatactatgaattattatttgggaatttttaagaataaatgtgtagaattgcataagttttttactaggttacctaattatggactgtttgtaaaagtacttttcaagattttctattggaaatataaaaaaaattttaataaaaaattctcaaaaacacttgtaatcttgtatctaaacaaattctataaattataatatataattttttataataataacttaaaaattaaattaaacatgaatttaatagattgacaatgtaaaaacttacactaaccatacatatttactaaactctgtttttagatactaaaaaaatagtactggacaaatataatataccataattcacaaattaccaaattctttaaatatgttttcagtggtttagtccttagatctatctatatacaagaataaatatgggaagaagttaacttcttaaataaaccttagtatttcaagagattacttattatctttttaacagaaaattttttgggaaaaaaaactgtctactagagaatactctgggttccaaaaaaatacaagtaaacatcttttcaataagagtggaaataattaataatatatgaaattattgaaataccttaaaaatatttaactatctaattaatatgctgggtgaaaaaatcggaggttacttatttttcatactttaatatgaataaaaacagatacatgagtgagaattgtgttctggtgtcagtcataatttcatatacgtcaacatacaccatatcaacctcaatgtcacttttgatttgtgctttttcgtcgaaagagctagggttcaatgctagcttcagtctcatgccaaacttgagagggttaaatgatactgatctcattatcaaactcttgtgacagttgtgagaaaacaatgtactacacattcccaccactcaattaatatggatgacttcaaattcatgaatatatataaaggtgagtgatactttaataatgtaaaatgtaaacatattttcacaaatattgagttatccaaaaatgacatacaaccacaacacatccctactatccttcaaacccgcatctataacagaacatttctcgttcgcatttagaaaaaaggtttttagttaaaccccctttggtcaatcggccagtgtagattattatcattatatgaattataaatgaacctgactgctgataccatatggaaggctttgtactaaaagaattaaataattaacttaaataaaacaaggtgaataattaaaattataaggtgacatagtaaaaagggcacaaggaactataattttactgttagttttgtatgaatcgtatacaattaacaaattaatacaagtatatatcttgaaactaattttcccgagcctcctatgcttgacatatatataacgtgtggagattacaatagagtacaaatttgtctacgtacgcatgcaatggataagacgaactttgcttttagatggacccagcccaatcaaggtatacataatatgcaaatatagacaacaacatattagtgatcgtacatacattccccaccaaagcacaacaacatcattcttcttaattctagccctaccaagggaaccttctcaattctaagagattattttttcccaaaccgccccatctgtctgcatccttgactagaaaaccacccattaattatcttgtactactaccattttacatattgagctccatccacatgtagaaccaatcatttaacttgggatttaagcaaggaatagagtaccacaaactacaatgcatatgatggcttgcaaaagagagaatagggagagctgacctggcgtatgagttggagttatcttatatgttagggtgtgtcaggaataaatgatgtgtaatgagggagggcctacagtagcattcctgaaaaactaccccaccatgaatgcacccacgttgtagagagattgttacctccttttcggcctcattgttatttgttaagtatgattgaatctcatcacaaatgtgcatgatcagatactactctatcttttcttctataacaatgatatcaagagggataattaaagatcatatacacaagtcaagaaaagagaaaaagcctcgcatagtaatattgattaataaaagataagaaaataatgtatatagtgggttgttatactaactattgagcactaacaacacgtaattaaacaaaccaaattgtttatatatatgagaaatttagagagttctaaagttgatttcgaactcaaaaaaccctaacgattctcttatgtgtgatctaattaaagaggtcacaccctatttattgaatgtgattagacctacatgtctaaggcttacttgttataagaagtccttaataggttgatgcacatacattctgcttaagtgttgagcccgaaagacataagtgtttgttatgtttgaccaatttatccaaataattgacagtatctctcaagtcttgagtttaaaagatgtaagtatttgctatgatcagttaatctgaatagtccacatgcttcatcttctactaagattttttttttattgtcttttgttgctcccccaaaagttgcgttactttggtttgcaaggtattttataataaactcacaactaaagatcgttgtttttgtcttgtagtaaattttttgatcgactcttcactaaaaacaatctacttaacataaagatttcatttcaaaattcatatgttttttgtgccttcttaacactagtgttaaaacaacaaatcatttaattttacatgctcatttccatatatatggtattaggaaaaaaaaatatgctttgttatgaaaggtttttatgactctatcaagatgagtaaattctcactttcggtcacattttggtgttaagaaatataaggactacaaaaatattttggacactcttatagtaatatatgatgtattctttatgattgtcttaacaattggttatgaatttatgctaaatttaaaaatgttataacgggttattatagtaaaagaattttttttacctcaaatttttaggcatcgttagcatcatctcatatgaagtattgtctgatttgatatttggtgatacattatggttttgttattagtaaaaaggtgccttagtggattaaggggggagaatatttataaattatagttgatttcgattactaaatgatgtgagactttagacatatcaaaataagtctttaattgatactaagggacaagagtgatttaggtgtttcttttagtgtcaatggtttaatcttaaatcctcaagtattgttatgatcatctcgtctgacataatattcacttccatacttgatgttacgtcggtttcatattttctaaaaggaagttcaatatgttaagggaggagataatttataaattatctttgaccctcacctcttaaataatgtggaacttttaaatgaacaattttgtttacctattcattacatatattataaaaattaactttttcttccgtgttaatgtgcatgcaacttattaaattttttttatcaaatattattgttattatgggtaggactatctcttgtattccatagtcaatacattttgttttataaaaaaaaaatgtagattgattaccaactgcatgaattattaataaccgagactagaattatatattttgttttcaaaattgaacccctgaccggcagtttcacctgtatgcctaagaaccaacatggtgatcaatgattaactctaaaagatcgtacaaatttagaattggtgaaaatcggtaaaaaaaaaaaaaaannnnnnnnnntattgtattttattaatatttttataatatatttaatttataattttatgtgtgctttgaatattaagaatctacaatttaatttttttataaatattaagaatctaaaaatgatattttattttaatttttaatgttaaaaaattataacattatatttatttaatattattttatgcattaattaattattaatattttcattaatactattttaatcacaaatcaaaattgttaaatcttaaactaatgtctttatgttggttgaattttaaagttactgacatttttaatatgctttttattgcacaaacagcactggcggcggcataagcttataagttataacctttgactttaaccagtgcaccgaaaggtacatgctctcttttttacttttttatatataaaatgatttccattccagtataaaataaaaaaaaaaaataaaacactacttgaattatactactttataaccttgtcactaatttcagaatttgttagctttatgctgcgtactcgcacattctctttctcaataccaaaaactgtcaggggcactacagttatatttcagttgatataatttttcatttaatgaaaaaaaaaattattaatacaatttatgtggatatacactgaacattgaaaatatatattagtttttatttcaacaaaattatttattaatattaatttataatagtgaaaatatatattaattttatatcatcatactaatattaatattttattttaattccataaaaactatatcaaattaccaagattaattcaatatttagtatgacaattattttataatgcttcttcagtaacaaagcttgggggatcatgttcagtgcagtgcataaagctaactttattttggttacataaacaacatcactatatcgatcaaaagactcaaaacaaacagattgacgtagtaagcattatatgatagaaataatgagatctaatcatgtgaatgacgcggtgtataagatctgattgttgggaagtggaacgcaattatatttttttataatttgcaattatttaagatgcacatggaccatttagcttattcatgcatgtttgcttctaatggacgattctaaataaacatgtagttcttgattatgcttttaatttacgaaaaccaatttattatccaaatgattggaaagatagaatcattttctctatctatttatttatttaattgcttctttaaaaaatctatttatttaaattgaatttttgttattgtatatctatttatttttaggttaaattataattttgaccctttataatttttaattcatgattttatttttcttttcgtaattttaatttaatcctatttttttatatttttttgttttgattcaaatgaatcatagatctaaaatattaatttaagataccatataaaattatttaattaattaaaatataaaatatataataaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgtaatggtgaactaacttaatgatcaaaattatttattttgacaaataaaaggactaaatgttttgatttaaaaataagaagactaaaatgacttatttaaaattatagaaaaccaaaattataatttagtttatattttaaaataatctctaattataaattattaatatattcgctttaaaaaatgagtgtagattagcaaatttcaaaaatatttagtaacttacatctatttatttatttttaattacaatacgttatcatatcataaatgtatttaagattatttgtaattataacttacttacacattatgaataattaaaaaaacatgagggtatgctaactaatatataacaaatgttcaaagagttgttaaaagcggaccattaccgagatattaagtaaacctcatgactatcttgtattggtcttgtaaagaaaagtaaggaaaaatgaagaatatgttttgactaaaccgaccttaacatgctggtccttagaatgtcccctttgctttgacttacaaaggaaaattccattgatgtagttcaaaggattttttttgacaaaatctcgtgtaactgttcatttacaatggaattcaaacgttgattttagataatttttccaccatttcatacaatggaagggaaaaaaataagttccttgaatcaatagttatttttagacatgctagcttattttgttccttccactgaagcaaggaattgcatacgaatgcttgccaaatgtacgaagactacaacttaaactaaaagaaacactcatcgtaagataagatattcgaggaagaagaaagaaagtatcaaattgatgaactgtatgagaaatagtttcagaaacgcacataagatattaaatattatattttggctcaatataattaaaatatttaattttaaatttttgttaaggaggcagagtagtagatcaattctgatgtgcgggggggctggccagtggccacaaatgacatatgaaatggataaacctgatatttattatttatttatttatagatttttcttgagtggatgggaataaatgaaattaatatatccaaaacaaaaccacaaatataatacctgaaaaaagaataaagatgccgcgatccgcgagagtgacctgatgacgtggcggatatgtgtggtgaagcagtgacgcgtgttgacgaaagtcactgttggaccccatcccctgatttatgggtcatccctaaggcaaacataccctttattgttcttttgtttggctttatcttcaccagctgagacttctgcatgcacaatcttgtaaaaggacaaaactaccccttccccattattgctattactgttgtgtcctactccctcttcatcacggtccggcaacttgcttgcttgcttgcaactaatctgtccgtgaccctcgcttttaatagatagtacttttttcaattgtttttaattgtaatagtacaaataatgcatgttcatgctgttcatttgttgtactacccactcgataactgtgttcctaacacaccctaagtttaagacaaaaatcttaatttgattttgcacaaaatatatttttaaagagaaatcagaacttaatcttaaatgtaattaaatctcaaattaattattaaattttatagtctatttaaaaaaatcaaaatttatgagattctttagaatttcattaaagaataaaaaaaatgcttaattttatgattataaaaaaatgtgttcttgtagttggatttaataaaagagactaattctttcaaatacattgaactgagatttaaattttaattaaaagagaggtgtaatatttagtctctgatataattttctttgaagaagtatagctgtataaaaaaatgtgcataaggtaatattgatgtttcaatttaattgataaattttagtttaaatttgaataagtaattattctaaatattcaaaagaaaatacttcatcataataatattctaacttgattagaattagcatctcttaatgtgttctgtgttctgcataaaaataatgtcaataataatgttgttttattttgtttttatttttctaacggtccaaatttcatcaattggagactaaagagaatatttccgagatacacgccattgttaataagtcaatcatatcaatgggcaaaagaatctaaatgattttttttctaaattatttataaatttgaaattattttcaaattatttatgaatatgaggcttttgacaaactatttacaaatatgggacagtgggtcgtgtccaaaattgggcgtgaccgaggcgcgacccaccagatatcgatacgtgttatgatagatggagtgatgcgcatataaattttggacggtcataacttttgattgggatgtccgattgagacgaaattggtggtcacacgctcgaaattaagaggagaagccctaagcaagttcctaaaggggacttggccaaaaattttccccaaaagaggcctctaaatgcctcaaaattgcgatttaatctttgaagccctaaaaaatttcttgttttctaattttttatctattcaattagtgaattgtaagctattctttatttatctaattacttctcttaatttcgagcattttaacataaaatacgtctccatcggacattgctacgagaaattatgactgttcaaagttatatgcatcatcaattttacagtataattttgttcaagagtcatggccacaagggttactctgagagctttgaacagtcataatttctcgtagcaatgtccgatggagatgtattttatgtcaaaatgctcaaaattaagagaagtaattagataaataaagaatagcttgtaattcactaattgaatagataaaaaaaattagaaaacaagaaattttttggggcttcaaagattaaatcgcaattttgaggcacttagaggcctcttttggggaaaatttttggccaagtctcctttaggaacttgtctagggcttctcctctcaatttcgagcatgtggccaccagtttcgtctcaatcgaacatcccaatcaaaagttatgactgttcgaagtttatatgcgcatcgctctatctgtcatgacaagtgtcgccatctagtgggtcgcgtccaaaattgggcgtgatcggtatgcccaaattcaggcgggaccagtcacgcccaattttgggcgcgacccactgtcccatattcgtaaatagtttataaacaaccccaaattcataattttttatttaatttgtatttttttgatttttttcccaatttctgcaacaattcacctcacatgcatagataattcaattagcattggtggacgtttgatgtgatataaaattaaaaatatttttttaagatattaaatatatttattttagtataatattttccatatgaaaataaaagctattccaacattctaaagaccaaaagtattgattaaattcctagaaaaagtatggattgaaatataaaattgattctattataaacatttactattattcatagagttttacgatagtttttaagaaaatatatttattactaggacacataaaataataaaattattaaaaatacttgtttttacaaaaaaacacttgttaataggacacaaaaataataaaaacacggggaaaaattaagtcaaaataatgataaattattaagataataattaatattattatcttacaatattagagatataaaataaaaaaatatatattgctaagaaaagttatgtgtacatctattaaagaataataaatacaattatagtaggagtatattgaggaaaaaataaagagaaaaaactcattttcgattcattacttaggaagctatttgatatttacgcaataattttttttactataaaaaacggagaaaaagaataatatatatatatatatatacgtatatactttttatttgacaattaaaattataacttttaattgaaataattaatctctctggttaaaattattttttgagttcacaattggattttatatttcttattaattccttttatatttattatataattatttctattttttgttatagtaaaatataattaaatagaaaataagtaatgtcatttgaaaatatcaagtgaatagaggtaatcttttttccttccaatcaaaccgaaataaccagagaagattggaatcagaagatgaacggccaagattgatgacccttgagatttccaccaaaattcacgtgcatgccatccacccaatacagcatcatgcagcttgggaaccagtgagtgaagatccccatgtcactggaagcggcgttcgctccccgtgcagtttagataatttgcgtctgcatggtctaaaatacgcccggcggaatcgcggagacgacaccgttcggaagtgggctccttacccacgaagcgcgagtttcccaatggacagaaaaggacaactttttagtcttaccataccaaatagtactaataaaaaagaaaaaggagcaataaaatgttgaatcttatcaagggtctttagaatattaattaaatttttaaaaaatttcaaaatttataagagcataaaaaattaaaaataatataataattttatgtattttaataaaaaaattaatttttaattaatatttttagaatacttatgcgtaattatctaaaatatttatttatgttcgttcctacgcgtgaattaggatgggtcccactccggtttgcagggtaacggcgttgtgaagggacgttatgaagagaatggaaaagagagagttagattagactccgtgaataacggggacgcagcttggattgcgggaatggaagtggatggtggggtccaacatgggtaacggctatttgggtgatgacctggactagaggagacagcatgtatcgtaagctgtcaagcaccaagttgcaacttgcccttcaagttccacggagattgatggacgtgtatattctgaaaactaggcaaaccaaacacaatactaaaaaaagtaaaatggaaagaaatataaataatgaaatacatttagttgtaagagactgattttaatgatcatgaaaataaaaagttgatccagcttataaaaattaaacttatatcctataaaataagtttaaattttattgttgatgaaaggattatgttgatacataatttataaatatttttataggctcaataaattttaagacatattcttctcgttaagttttaaaacttaattggtaaatattatgtcttcttatttaatttttttattttattttattgtgatgtttatcttattaatatgttttaattattaattaacataatttagtatattttaagaagtcattaatttcataatttataattattcttattgaaaaggtaaaacataattataatttcatttaagaattttagtgatactaataaatgaaaaatattattatggcaaattatctgtacattcttaaatttttaaagtgacaaatatttttaaattgtttttaaaaaatattttgaaacaaattaaaacatggaaagagatacataatataagatggatagatgataaagtaaacagagttcaattttaatagtgtcaacataaaaaaaactttactctattacttaattagaaattattataaacatgatttttacaataattatgatacaaatatgtatattgtttcaaaagaaatattttgttaaatataattagacattaatataaacatatatcttatttaaaaatgaattattggttcattttcttgcatgcaataacttaataattgaactaatcaagtagtaatgattaaaaatttataaatttgtgaagacgctacttacttaatattccttaatttggtaataaaatataataagaggacgtaaaattattttgatcatcaacttcatagtccataaaatctaatgcttagatgagctaaggttatgcttaactgacatgtatatgaatcatacgttttgattgggtggcgcgtcaaattcgccgccaaggaaaattgatagtcacgtggcgagctcactgaggcgccgaattttgaacgttggcccacgcaattctcattccttcggagccttcaactttttcttccatttaatgccctccctatcattcctattcacgcatttgccacgggtcattaatgtctttctactttgaattcaactgtgacacgcttggtgacaagacctcagggtcggttctgattgcctcatccagagtgcacccacatgccctaattccaaatttacccttataaaggtactaccacgtctctttttttggttgaatgaaagaaaagtagaaaaaatgaaaaatttaaaatttgaattataaagaaaatgataataaagaaaaattaattttttatatctataaaaataattttttcttctatttttttaaacaagcaaaaataaatattttattaatagtattttctgtcttttctatttttttctttcactttctttcttattaaactaaccattaaaaaaaatatataaaattatattgatataattttgataattattatattatttttataatttgatatagaatattattttaattgatcaaattattaaattatatattattaagattatttatgttaaattttattataattaaataactataaaaataattaaatgatctattttaaaatatttattttgtgtcgatttaaatttataaaaatgatataataaataattttaaatcaaataaaattttatatatatgatctgtatgaaaataatttttaatccaacaataaatttttaaaaatattatttaattaaaaattataaaataatataataattattaaaattatattattataattttaatcattctatttctttaaatatactaagaattaaaaaaatgtaatgtataaagttgttatcctttttgagagccaaaagcttgtagaatattattattttctctataatcattcgtatagctctgctgtcctctacttcatttgttcctttttagtacttttgtattattattgtcatgggttttgccactttatcccacccccaagccttcaaattttgaattccaagcttttagtagttttttttattttaaagcatcataaatcacattcaccgatgttctaattaatattttttctaaaagaattctttggaggggcttaaatacaagggtattcatccgttcaatgaattatgaaaatagtagttggttcaaattttgaaaaaaaataaaattgaaaagtaaaatgattattatacttaatattttacttcaactagcatgttattttaaccacttgcataaaaaagctagttttattaaacaaagaattgagtatgttactagacagaagacaaatataaacttgannnnnnnnnnnnnnnnnnnnnnnnnnnnnnnnnnnnnnnnnnnnnnnnnnnnnnnnnnnnnnnnnnnnnnnnnnnnnnnnttttaagttatatagaaatatatatttaacgaagattaaaaataggtataaattgtttaccaattattatttttttttcttataaaatatataatctagtcatttatattcaatagcatatctacatggaggataatgggagcaattgttcccacaaagtaattttttttacttaaatatattgaataaatatttttttactcctataaataaatagatattgttcccataaaataatttttataataagatgaatgtaaatagttataaaagataaaaaaaaagaataaattgatactaattttattcactttatccttttaaattttactatttttaattttttattatcattatttttaatgaagcttatataatttttgtttgagaaaatattagactatttttgcctccactaatttttttttggattcgtcattgtttatataatttataatatttattatnnnnnnnnnnnnnnnnnnnnnnnnnnnnnnnnnnnnnnnnnnnnnnngtacatttcatatattttctctacaaacaacaaaacaatttttttcttattcatctcaaattactttctcttatatctatctttaaacacactttatcttcttaaatacgtgtctctctcaatttatcctcttttatatcaactttatattgaattttaataatgtttaaagttaaattatgaataactaaaaatacttatatcacaatttaaatttattcactataagtctataactttaagatgtaattttaaaatacttatttattttaagttttaattatttaaaaatgttccggtgacaaaatgacaggataaaaaatgtttattcagtataattttgattatataaaaaaatattttacataatataaaaagtaaaacattacttacaaacaaatgtacacatggctaactaagaattagttattatcttttctaacatgcatgagccatattactgataaaaaaaaacatgcatgagttaaattaacgtttagtaattaatttgagaaaaatgaaacataaaaaaactgcagaagaagaattttccctgtccagattcattttctgtttcagttcataaatttattttttgcagaatgataaacagggtcaaaagaaatgagcgtggcttaaggcagaaggggacagagaggatatgttaactttagaaacagagccacgtgttgaagcctttgtcaacaagtctttgtactcatcgaaaacaaaccagaaaaataaatcatacagctgagagcttgttgtaaaatttgtaacgtatttctcattttccacatcaatttaatattcatcaatgaaaatgagagtttcaattaagtactacatttctcttaaaggaacgtcaattaaaataaataaacactgtagtatttgtctacatttggacacagctcaacacagtctcacgaatacaaataagcttcgtttggccgtgtctttctctctaaccaagcccttttcgcctcgctctatcgcttctagctgtagagattactattattccaaacctctctctttctctcaccatcacccttttccttcttcttctcttccttgcaccactccttatattatctcataaaaataactcttgggagaaacacaataatcaatcatggaagggtctcacatggggttgttgctcttcttttcttccatgctttttgctgccttcccttctgcctcctccagaaacttgcctattataccctttgatgaaggctacgcgcccttgtttggggacagcaacttggtcatccatagggatggcaaatcggtccatctttcactcgatgagagaacaggttttttattttccttttttttttttttgccatcctttgtttttggtttggcaatctatgtgcagttgtttgttttttgttgagatggcgatttctgtggctaaagtcctcacctttttgttttttttcctttccatttctggggtgtgtttgcaggttcaggatttgtgtcgcatgatctttaccttcacgggtatttcagcgcttctattaagttgccttctgattacactgcaggagttgttgttgccttctatgtgagtatttttgcctcaattcggtgattatatgaaagtgatacccttttttcttatttatgtcccatttttttataaaaaaaactcaatcacccatcgtcatcaccagcatacgtgtttttctgttcaacaaagatttctccttcacctcaatcaccaagctttttttgtctttttataccattttttcctttgtgtgttttaaatcactgctagtatacttcaattaattagtaattttttttgtgatttgattataaatcacatagttatcagttctcactttcatttttaccaatggagaatgaaatttaggatttttcagacatttatcaaaacaaaatttaaggacttcttacttgggcaaaagtgtgcagttttgtttgtttgaaccaaaagggtcattctggttttggtttgaagtcttaagttgcatatccggcaaatgggaaaagagtaattaatttatttcatcacattatctacttgcagatgtcaaatggtgacatgttccagaataaccatgatgaaatcgactttgagtttttggggaacattagaggcaaagactggaggattcagaccaatgtatatggcaatggtagcaccaacattggcagagaggaaagatatggtctctggtttgaccctgcagatggtttccatcagtacactattgtctggacagactctcagatcatgtgagtctctatctacatatactatatttggttctattttgcatgttatacacttgactattgtatctatatcttctctgttatagtaatttttttccatcattcttatttgttatgttactttactattacctcttattctcattttgcatgtcatgtcagtaatttgatagattatattgttttgaatggtgatgttatattcaaaaaatttcctgtagttttcttgttccctttattaaatcccctgtttgatcaaacaacctgtttccccccctcctgtaatggtattttgtattatatgtgatgctttggctacttggttatggataatgaataaaaccagatactaaggtcactaatattttaattttaaatggtatatattcttttagcactcagaataatttgttttctctacctaaattcataaggttgtaaataatatgttccttgcatggatttttgtttttcttattcaattatgctaatttctacttttggatgtcacttgttgcttacttattttcataattgcgttcttgcttatccatgtgcagattttatgtggacaatgttcctattagagaagtgacgagaacagaatctatgggaggagatttcccttctaagccaatgactttgtatgcaacaatatgggatgcatctgattgggctaccaatggaggcaaatacagggttaactacaagtatgcaccctatgttgctgaattctctgaccttgtcctgcacggttgtgcagtggatccaattgagcagcacgtggccacgtgtgacaatgctcaaagctctgaggcaacaattcctccttctggtgttactccagcacaaagaatcaaaatggagaattttaggaagaagcacatgacatactcctactgctatgacaaagtcagatacaaagtccctccttcagagtgtgtcatcagttcccaagaagctgagaggctgaggaggtttgatcccgtcacgttcggtggtggccgccgtcaccatggaaaacgacaccgtcgcagcagaggaagccagacagaaactgctgcttcatcattttaagagggttccataacttccatttagtttcactacctggggtttatattttcttcttttaactttggtgtatagagaggaggggcatagaattcttgaatatgatgatagttttgatatggtggttattgctggtggtggggtatgtgtatagttcatacctttaggttctcccaggtaatttgtttgtcattcatgtcttatggtttacaaattgaatccgttgatttttgtatttagaccacacctctgtttcaataaactatttagcataagttatctatggaatgttaggtatgaattatttcttttaactgctaatcatcatgtatataaaatgttggtgcaaccttttttttattttaaatttctctcgtccacaattgtccaatatacacacacctgtctgatagtttatgtggtcatatttgtcagttagacttggacatgacagttatttaataaatcttaatgagaatccaaggtcaagctgaagaatggaagtgttgctgcaggtcctccacttaattttgaccacagtttatgtcttcactttttttcttcaatgtgttttggtacttttgtaacgttctggtgtattatgatggattgaattgggtagttgagatctctatggaaacattatggctagtttttgttgacttgtgtgtctgttgtgtttaaaaaaaaaaaacatttatttttcactttttaacaattgttcttgggatctctgatctcactgcatcttggtaattactaattgagagatttcacaacaataatttttatcaagtagaaagttaattataatagactgaactatgaaacggaggaaacgagttatgaatttcaagaacatatggtaaattcaatacaagttttttgcgtgcttaggttatcaatgcaggttacttaatgttaagcattttttggccgccaagatatttgatgaaaggtaattaatcgtaaattttttaagaaatttccatgtaactttgtaaatatgattcatcattatcaaatatcaatgttagatatcctagtaaatgataaatttttttcgtacaagtaactgaaaggtgatccactcttcttttgaaagcaattaagataagcgattacacctgtctgtagaatatccaaaaaattcatagcaaggcgattttatctaaggttttccttgaaaagcaacattgctcaattgctttaattagattgattaatactaaagcaaatatcatcccggcatcttgtgtttcaccttgtagacattcttttacgcttttcttaggaagatgagggagaaatttaatgatttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatatatatatatatatatatatatatatatgcctctcatacatacgggcgtattttcttatctaatcactcaagtaattttttagacttttaaatttgtttttttaatatcttcttatctaatcactcaactatttttttagatatttaaatttgtttattttatactagttttttgacctcttaagtttttttttccttcattattttaatatctaatattatcaagtgacttatgtctattatctaagtttcttttaacatctttggtaaagaccttggacataagaatctttgaatcaatctctaccaaaacatcttcatttaacttgatttcaatgaagatattttcaacttgactctagtcaaaacattcttagcttgacctcaacagggaaatcttgagtccaacctcaacaaacacatccttgatcccgacatcttgacttgacctcaaccatgacatctttggcctagtctcataatgtatgtacatgatttatctacaaaacacttatataccattacataaaaatgaagataaaataattaaagcttaatttgggttgccattggcccatgggaccttgtaggcttttttaagtgattttttttaatcattcacatgaaactgacagctctacctccataataaacataaggctcttgcaagctagtactctaaacgcattggttaaaaaattaaaagagaaaaatatatttgtgtaaattataggagagtataaaaaagatcatgaacaatataattttttattttctaataaaaatattttttctttaaatttcttaatcaatatccttaaaacattcattaatatttacttaagcttaaacaactgaacacccttctaaaaggtattaactcatattagcctcggtaatcgacaaaactcatgttcacttacatgcaagcttggtattatacttttgtaaaaacctcaaatattttttatttgaaataattttgattatgttaggtaaaattattataaacattattttttaaatatttaatgcaattatatatttaaattcaaactaaaaaattaatagaaacagtccaataccaatttatcaatccacttgatttggtagtatttaagtcgtatggatttattatagggagaatccaatagttaccaaaagacgacaaaccgaaccgagattctgaaccgaccattttaattgggacttttttttttttggataaagatttcaattgtgacttgagtgcatgttttgttatctgataaatctaacgttaaattacatagtatattgaatatgaaacataactctgacacaacctaaacatgtctttattaacaccatttaaaagtttcgtaagcagaattttaatgtaacaaaagaaatattttcgtcaaagcattaaaaaatttgaaagacatcattcatatcatacaatgaatagaaaacatgttacttagttctgcatagtcaattccgcgggtaggtatggagtacaagcggatacgatgcaagacaaaagtgacaatcagaattttctctttctttctttctggtatcatgcattactaattactattaattattgcatctcaaattatttttaattaataatgcattctggaaatacactcaattaaatattttcatcaaatcctcatcaaatatcacataagggtttgttattaatttgagcatggaatttattgaaataagccaagaaaaaattattttgataaactactccctctaatcttaaatatataaaaaaaaatccttttcttgatttcaaatattataaaattttaattaactttatcttatttaatactattatataaaatatcattcattaaattaaggtgctagtttcaatgatttttttttattttttatatcaagttttaataaaagataagttgaaaaaataatttttaagtaaaatttatacaattaaatgtgattagttaactttctttaactaacgagacatttttttttatatatttgagacaggagagagtacaccacaaaatttattgaaataattttaaaaatttataagagttattattaaaataagtttccctgtaagtttttttttttgaaagcttaatatatatatatgtgtgtgtgattaattaaatatttaaattacgcatactttaaataaatgaaataaaaagtactactgatttaggagctaataaataattttaatcagaaattatagctcgattatattgataacactttttatgcaagttttttacttttaaaattattcatgatttatcattaattattaaaatgattacaaatgaatgcaatttgtgaaaagtttatagacaagtggagttttaatagttgcaatgaatccatttgtaaaccacaatcctattgtttgccaaccaggtttgaactggaggaggcaaaggcaatagtcaacttccgtcatattcatcccttgagccacatatgactcataattattccagaatcactcatcatatattattgtcactgaaatccttgtgttgccaaatactactactgcatatttccatactgggacgaaatcaaaatctcttcaactactactgccaacctgaaattttatcacggaatcaattccatggcctccacaaagatttggacctttaaacttgtgactataatactcaattctgttctagtgatattgcattgcattcataagtgaagccttcgttcaaagcatattgttataacatgagttaaaacttaaaagaatatctgatttatattttgtttccacccgcctttttaaatagttgcaatcaatccatttctaaatcttttttttttctttcacaatatttccattatttatttatttccccatttttttcgtaattggcttcctaaaagttttgtcctcctaaatatcattcctttgtataagacatcacagtatgacgaatttcctcgtttcaaactgtacagtaaccttttattctctcttgtttttgtagaatttatagacatttcagcttgagttttatttcccagcaggcattagttaatacagtgctatggttgagttagactaaactattcccttgtggcttcgtatacactttcaaagctaaaactatatatcgttcatgtatgtaatgttaattacccaaggccacaatattcttattattctacaatgaaccacaagcttcctctcattctataagcttatggacaatgccttgccttcgttttttatttgttatataatgctattgggatgaaattgtactccatgtaattttgaaagaccagtgaaactaaagtgataattgattacagtaatgtgtaaaattaagaattttagataaaggcaggctaaaaaaaatgaatgagcttcaaatcatgtggagtaactctttacagctagctaggactgtttcagactttcaggtgagtatttcatttaatgtgatcttaattaaaccaccaaagtaaagaaacttcctattctttttatttttttaacccaaagcacatgatattaagagttcaacctatatacactaacaagtagcaggggaattaaggaggacaagataaaaagggttggaaagatctgaaataaaaaaagcctattaattgcacaaagcgtgacttacctgaaaaggtttaacagatggtggatatgcaaccttaccccctagtgcaaagaaagtttctgtgatttgaatttttcacctctaggtccaaatacttgccctctggggaaaaaagggtctattaactataagaataatttatttccaggaagagatttaatttgacaaaacaggtaaccgaataggttgatctagggggaattacactagtaagagttatttaggcttacgaatgtaagctctttgaaaacttatttcaataaatttcacagttaaacttaaaatcgatcaagctctaatgtgataatattgaataccacttaataaagttgtttgccaaaatgtgttccgtctagaaaatttactggcaagtaccagaagttatacagagaataagctactttattaggctagctgacaaaaatacttcgggttaatttttatatatagatagagaatggacaggaaaatcttgacttatacagtcaaatacaccatttatcaagaatgaacctgaatgaacctgattacactatttccctcaatttactggtaaggacaatgaatttttttctagctacattccaaataaatagcatgatgataatttatcctctcctatattattgacaccacaccatttttggtaagttaagccattatatgtatggttcaaactgataaattaatcatcaagtaacaatactcagctaatttattctttgtaggaggatattcttttatgttcgatttatgtattgaaatctaaaacatcccatcattcagttcaagatatgttgtacactatgctgatacaaatagtagaatattatagttgatgtataagatgttggttgatcttagtgcacaataagacaattagtggagcagcctccaggaactacaagaaggtacctgtagatgcctatatttctggtgttataatataagaacatcctctacccaagctgttacgtctagctaggctcttgttcttcgtcaggaaatgtctccttttcaatgacaaggctgtaaggcaagaaaggactgaaaatgacatcgagacaatgaggccaaacaatgtcagaactaaggaatagcatagactgaagagaatgtagtagctgaataaataaccaacaaccaattctatgacaacatatctaaaaattacaagcaacaaatattatcataatacaaacctcaaataagaccatacttttgataatattaatccagcaaataatccatcttctccattctcatcataatacaccaaacaatttttttccatgcatgacatcaaaaggagaatgtaagggtcgacccaacagaaaatgaggccgaaaaattgataaaggttaaaatgcaggatatgcttgctgctgaaaaatgaaacccaagtttccacctgtgagaaaccacaataaaccataatagaaacagggtagaagagagaaaaatagggaaagaaattaggcaattgaaaactgattattgattcaactaaaccacagagtcagtagtgatgctagctagtcacacagccaactcagtattatgatttatgacaattgtctaccgttgtatatatcaccagtctgaactagtaaaaatatgttgaattggccttcagttcagttgaatctgaatgaccacagtccgcagagacatggattcgggttggaagtatactgtaaagcagaaaactagtaatagtgtgtttgttttaggtgaatccttgtgtctccttgaattcacgttcatcgtggttcaacagattcgtataagctatgtaactgattaactttctaactcctaggttgataaactaaccatgataaactaacgatgacaagagagaatgacatactttttttttatctacaaatgttagttgtcacaatgttaattttgttagcagagagaatcgaataagtgacctttttttcccttccttctttcttaaccattcaattcaccttatattttcagaataacatactctaacacaccagtaaaatgtaatgatgaacaacacacaaatatatcaagaaaatattacactcaacttatatgcaccaaatatatcaatggctaaaaggcttagctaaatcctagagggatcacctccaaaagttgccaatgcacttcaatcccatgcacacaccaaacatattaacaaaggtatatttggcccaagttccacaaccgtttgcaatggcctgtgtacgggtcattgcaaagactattctaatatttataagtaaaacacaaaattttggatttatattgtttaaggaaagatagtgattaaaatgaaaaggatataatgattactttttcgaaaattttcttttagaaaacaaagaacacaaagacaatgaaatttatagttaacctttattatgagagagtgagaatagaggccaatcataatcatgaaaagttcagattaaaaaatagtcacgcaaatttcttaagtggtcatgtaatcattaaataacttttaatcttatctataaattcatatttactctttttagcctctcatacaaatgctcttgtcatttgatgtgtcacacacacagtcatataattgtagtgaagctattaagatttgggagaaggaattctatgattgaattgagtaattgactgagttcataatacatgcatggctcatgtacgtatatatacagatacaactctcgtagtgtaaggcaattgaatcaagctggtgtaactaattctgaccatagagaaactaatggttaacaacaacaccattattcatttcccaataccccgcacaagcttaagggtatattttttaacacgctcaacttagcaaggaaatgtgcaaagaaagagtgaagggtccaatctaatggcttagtgatgaagttggccagttgattgctagagaagaataaaaacaaacttggactaaagtttctccacaatgtgacagtctttgtcaatatgtttagtctattcttgaaaattagaattagaagcaataaacgccttactgattgactaccacagtaaaaaaaaaaaatagcaaaaatgaaggagacatgaagattgtgcagtcaaccagtaactgatcatgcattatttattttgaatttttcgggttgcgttcgggtcacgattatatgatatgatcagtcctggcgtcctgcacagaatatgttgaatgagaaatcttacatcgtttaagaagactttaactaagattttaattaggttgttatatttaagtgatgtggtcatgtgggtatgttagttgtaaacggtattgattttaacacatgacttgttaggtgtacctaattctaattggtcacgtttcataaaattgaatcatgacaattttataatagaatatgaataatagaggtattggtttagatcagttttgagccaaaaagtctttggatcaaaagattaaaaaaaattgtgatttgattcagtttggattgctttcttaaaataaaataataacaaaaaaaaactgatctaatcctataaaatgttgcttagattaattggatgatgatttggtttttcctggtacatctttaccggcaatttaatttcctattattagatgtctttagctttactaattgttaaattttatagcatgatcacagttacattttatatttaaagtttctaactcaagtatgtgatcctaaaatgtctgccttgtttcatttaaatcatctatacttgttcataaacttaaatcaacgtgtaatactatgagcagtaatagaaagatgaatgttcgcaattctctttttgatattctttttttaacatttttttattaactgaaatttattaaaaattatcaattgttgatgaatctaacttttcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatataaataatattactctatagaaattctaaagagaagcagtaaatattaaaaataggataattataacgttaaagtgatcaattttttttaaaattagtaatctatatatttcttaaaaaatattttttattggtttttttgcttaaacttgctatatacaagattacaaggcacatgcgaatgcattgcattttttatgatatacaggacaatgccagtattttcaatgtagtaatccattgattgaagttgcataattttaatattaatgatttttaaatgagtccaactatggtatattggtttttctannnnnnnnnnatatgtgtaatacaatttgttatactaactaacgcgcgctaacggtgtagtaaccctttttgatactatcagctaaaaaagaaaaagaaaaatccctttttggtacaattatttactaaagtagtttaaacatatgcgcgcatgttagagatgcttttaagttttaacactttttcattaggttaatgtcaaggttattcatgtttgatttcttttttaaaggaaaaaaaaaactggaaaaaagtagggagaaagagagataaaaacatttaagattaacatatatattaatgattataaaatcaataattatcctaataaaggaaaatcaataattaatattattattattatttccataaattattatacatatattttagtgaaatgaagctctgttcgagtttctccattcgaattaactggtacgcaaacgcaatttcattgtaacacaattgaattataaactttcactgttaagagattttgtgggcctaggataaatgcataggtttgtacaagtggaaatgaatacagtaatgtgatattttttattcttatttaaatatacttttaataaatataaaataaggttttaataatttgatttcgatcattattttttttataaataactttggttcttgtaaatattttctttaaaaaaaagtatactttgcctttttagtgatgagatagtatgcagtatgcatttacttgtatcagtacacttgtaatgatttaagtaatataattagatgtatgtcatgtgattattaagtagtaattggattcgggctatgcagcaaacaactcatggttatggtggtctcaacctgattggaatcacattaatcattcgtcttagcttagttttttttttccaaaaaagtattaagtagtaatgaaaattattttaatatttaatttagtacttatttattaaatattaagaaaattttataagagagtataatgtaccgtaagtcttatttaaaagagtgtcctcgaaaatcgcaattgattatttaaacaggtaagaattaagtaaatgtttgaattgaaattaaaaatattgtgtgtacattttaatgtaaatttaatgaatacaaaaataagagtttgacaaaattatttttgtttcaaaagtaacttctttttttttttatattgaaaatcaagcatgcactgagaaggttgtttccaaagaagttcatgcagaagagctcaataaggtatggctaattagtttactattattctcaacacggtatgaatgaatatgcgccataagcacatcagttattccctttataattagctcaatcacgtagggtaccctcaattaatattcaaattcaaattacatactagtacaaattaggagtgtttgtgattttagtttacatttataattatttaaatttaaatttaactggattaatatttgataatatatgagataagatagcttcaattttatttattgacataatatattgatactaatattatgtttgataaatcacaaatttaaaaatataaaactaaaattaacatatatttaaaaataaataaattttatataaatattttcgcgtgttatgtcaaatgttattttattaagtgaatagattttattattagtatgtaattattaatacacatttaatacaaatatagatcaataggtctagtggaatgactcaaaatatagctaaaacttattcttaaaatatattggtttatttatttttaattcaaatatgtaaagattaaatttaagccgagttagattagtgaaataaaatagattgtgagtactcttaatataattatcactctctctttttgaagaatttcatccataaactataaattattttagtttaatgcaagatgttagtgtggaaagttttatatatcaactaataaaaaagtcacaattagggagatagccataatgaggtcaattgattcaaagatgaattgctcaagtatggtgtagttttggtcatgcacttaagaaggttgagttttggattgtaagcatataaaggaggattgtaaaagaaactattttacaaatgtgaggttattaaactcattagggatgagggtgaggtgtgtatttatatacaaacccaactccactcttgaaaagcatgaaaaaaaaaatcgaagctgaatctggtcaaagtggattttcttatcaaagtcaattcattaaatgagcactcacaattttaggtgtaattgtcatgcgtaaagacactcattatatccgtctaaaaaaatacacgttctaatgtaaattgctattgataaacctttttttttttttttatctttgactgttggaaaatgatgcgtgggcttgtaaacatctaggaaagaaatagatagaataaaagaaaaaataaagtgtatataatttaccaacgacttgttgcggctgagtttggattcttaaggcggttgatagaaaatatcttactgaagattgttagctagaattgcattaaaaatatagtgattaataaaatcgattatagttcacacctacatggtataaaagaaaagaagtatataattcatacatatatttattttaaacacaatgcgctccttcttcaaccatacgcttctgtctgtgtcaaagcataccaattttctcatttctcaagtacttcatttttctccttgatttgtggcgcataacgaatttgcggaatccaaaaccagaagaaccgcaccttgataatggccctaccctaacttctccattctatacgttgcattgaacatcaaaacttgtctcaacaaaaacttaagtccagttagggtggtttttcgttttttttttaataaaaaaatcagttttaatttttagttttgagtttcgatttattttttatttttagtttttagttttgattacaaattaaagataaataaaataagtcaacaattttattttatttcaccctactatgaaataatgaaattgacaaaggtagcaatttgtgataataatggttatgacaatggtggtggaatgaaacattggtgaaacgatgatggtaatagtgatagaatgaaaatggtgacgatagtggtggtggaatgttgatgctagtattttaaaattcagactaactcggtcggttgaatcgattcaactgtaacctaaaggtctggttggattgagttgcctattgaatcaactatgcattgatcctagtgcaacttggtacgactcagccaagtttgatatgttgactcaatgacctgggccaggtcatgtccaagggaggaaacacactaattaatacatgtcaattaaggtttgatataaaattttatcattttctaataaagattaggtaatgcaggtcaattaatgattgttggtttgaccattgactcagtgaccaaatgtcttgattgagttaatcatcgattttgtttttaaaattatgggtgacgacagggtggtataatggcaatggaagcgatagtgtgatggtggtggtggtggcgacgctagtggtgacagtgacaataatgatgatggtgacaacaataatgatatgatggaataatagtagcaatgatggaaataacgatgaaagtgataatgataatggtggtgaaatggtggagactatagtggtagtggtgaaaacggtaatggtgtagtgtggtgatgacaatgatgatggtgatgattgtggtagagacaatgatggaatgataataacgatgatgcaaacgatagtgatggtggttaaaatgattttttttttaactaaaaaccaattcataaaatattttttttcttgattttgataataaatataaaattattttgaaattgagttaaaaaccaattcaactttatttttatcaaacatattttattttgaaaattgaaaacaaaaaattgtaatcactccaaagaagaccttaggaaccgttaagtgtgggtcaagtggtactattccctttctacctcttgcattagtatttgttttagattttttggtacaatttgtttttgattcaatgaatatccctaaatatttaggggatttgtaaatatttattattaacttattaaaataattgctaataataataagatataaagtttaaacaagaaagactatgcactcgatcaaaaaggaaaatatgcacacacacacacacttttccattatcatcatccaattaaaaattattatttaagataagtttattatattttattaaattattttaaaatgttagatcaacgtttatttataattttttcatcatttatgataaatttattaacttttataaaattatttaaaaatatgatattaataatgatttataattaaataagtgtacaattattttatattataagtgttctaccactaaattttaaagttaatattaaatctctatttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaaaatttaaaatttatttcctatcaactgtcctctaaaatcaaaattctcatttttaaatctctgttaagttttttttatataaaaaaatagtttatgcaatacaaaagatcaatatttatatttacataattaaattttacaataaaattaaaatttatgataaataaatatttttaacatataaattatattttagattcatgataaataatttatattataatataaggttattttcaactatttgatacttgtatttttttaaaatattgagattggatttaaaaataaaagatgaaaaggataattgaaaaagataaatggttaagaaaattaaatatatagatgaagataattgaaaaagggtttgagcattgaggtagtctataaaaattgtttgagtcagtgttaaataaaataaaattaaaaatttaaatcgagaaatatatttaggaaaaagatgtataatatatgatattaggaagatagcatgtatttcaataagagtatttttttttactgcatctcaataagagtaataaccactctaaatgtgatttaataatttttttttattaaggacttccattgaagaataactcataaatgcattattattgaagatgactttaaagagtagagaattaagaaatatacatggtagtattaattttataattgtaaagtcaattactattctcaaagaaagaaggtttaaaaagaactatagtagttgttttaaaggcttaatctcaaaccaacatggctaaatatagaaaggggaatgaccaaaagcccccattttcttccagaatattctttgtaaaatccaaaatcagcacccaccagtcctcagatgcacagcaacaaatatatatagagagagagtgcgttgtttcgtgacttgtgaatatgagccaccatttaagactacaacacatgcgtgatcaataagccataccctttgttacacattcttcattaatctcaaccctagatcttcctcttcaagcccctccctttgcgtcatcccaactcaaccaccacttcaccctcgttccatcactcacccttttcaaaccccagatctctccaattctcgctcttattgatttcaacgccataccaaaatttcatattattcgttttttcactcttttttggccttaatcacttctggggtggtcttgtttcttgacaaaattgctgcttttttgctttatttgttctcaattctgcgtttcttttagtggggtcctcttgaattgcactgtttttgttataaactcgttgtttccttgcttagatctagttgtgtttgggtatgctttatatgcggttgtagtgtattgttgtaagtgagttctcatggcaatgccatcgggaaatgtggtaatacaggacaaaatgcagtttccaagtggcggtgccggtgccggtggtgctggcggagagatccaccagccccactaccgccagcaatggtatgttgatgagagggatgggcttattggctggctgcgaagcgaattcgcagctgccaatgccatcatagactccctttgtcaccatttacgcgttgttggtgaccctggggagtatgatatggtcattggggccattcagcaaaggaggtgtaattggaaccaggtgctgatgatgcagcaatacttttctgtggctgatgtggcgtatgcactgcagcaagtggcgtggatgaggcagcagaggcctctggatccagtgaaagtgggtgcaaaggaagttaggaaatccggttcgggataccggcatgggcagagatttgagcctgtaaaggaaggttataattctagtgtagagtcttataatcaatatgatgctaatgttacggttactggaggcacggagaaagggactccagttgttgagaagagtgaagaacgtaaatctggtggaaaggttgagaaagtgggggataagggtttagcatctgctgaagagaagaaaggtaaataatgggtcaatcagtctgtatgtatttatacatttatttgattatgctacaacatggtgaatcatggactgattgactgtcgatattaacagtgttttgtgttcattataatccaagtagtagtgaaatgagagcaacaatttatagaaagtccgtggagataatcagatcattttatgcatgtgtttgcatataaaaatacaattttgatgaggaaagtaaaagatctcttatttaagaatcattgtggaaaggctaggtactagcaggaattagtgtcaaactagaatacttgcaaaagacaattcatggagttgttgctgactaaaaattcaaatggtcaaatgttaaaattaaggctgttttttttttttttggttgtttcttatgatctggtgccttctgctatccaattaatggaaagatagaggataagttcactgatcattaatacacaagaaatgcctgcagtctattaacttctttgctctcttgcttgtgtgagcagatggtataacatcacatcaaactgatggcagcctgaagagcacaaggagtactgaaggatattggtccaacttagaatctgaagctgttgtaaatgatgaatgtatgtctaatcctaaaggtcttcttcctcctgacaatgatgatggtgaagatatattatagatcttgtttaacttaaaagagtttagggcagcagacgaatgctagttgcattgcattcatgaagtttaggaaccgagaaaatgatatttggactgtacccatcaccccctccttttgtcacatgaatgcaatatagttaaagtttgggtgtgaaataacacaaatgtaggtgctgactcttgtttgatttagagatacactgagagtcaattctcatgcagtttataatcatagttttctgtgctgattttttgtttaatactagtatttgtttatatcaatccttatatttataaatcagtcttcaatcttggatgtgaagacatttttattttattatattctcttgctctgtgtaacacactgacacatgaccttaccattatttagcacttatttttatatttttgaacattttaaaattattaattttaaaatgttcttttatattgatatttattttttgtctaaactatcctgttacattaaattcaacttctcaaatctcagctataattacttttaaatttttaatattaattttattttactttaaaattgattctttttatttttatattttaaatttgctcgctttctctgaatatttgtgttttagatccatactttttagttaaatgacactaaactcttgtgaaatgtgtttacagggaacaattcacattctgtgcaaaatcaacatcagagccaaagtctttctaccaaagcaaaaacttttattggcaatgaaatgtttgatgggaagacggtagggtcctttaaaatgtttcttcacttttcttgatgtcattatttcaggatgggtatatgccttctcataagttttcttttatttttcgtctatcttttatattctatattttaagatgcaactttatattttttcacttttaggtgaatgtggttgatggactgaagttgtatgaagatttatttgatagcactgaagttgcaaatcttgtttcattggtcaatgatctaagggtatctggaaaaaaaggacagttacaaggtaaatgtactatctgtgttctatcttcggactgaaagattgttactgcttccctttttaatagtacttgattcatagcaaataggtgtggccatatgcatggcaggccctttgcccatgttcttaaagctcgaggtttctgtgtaaaaaggtggttgacttgtatctatttttctttggttcatctcagtatttgaatagtcatggacagataatcagcttgcactattctcagttaatgacaatgagtagtatatgagtcatgagttctaatatataatttgctcatggtaagtaatatgaatcatagtatgtgtttttcccaagcccaaaaggggagtgatctgataacttgctgtcaggggagtcagctggttcaccaatggcatttatacgtgtggatcagattcaagaggtgagggatagagagatagcagcaaaccttgaggcggctatgtttaggccctttttataacttctttccttatccttagtcttagtcactaatgtgttcattggtaccctaattattgcgtcaagcactcaagccctagtccagaacagtgcatttcctgatattcatctttttccttactattgctaccattaattctatgtctgttaatgattaaatttttttgaagacccaagagaatgcataagcatacacaggaattggacagtaaggtttgctagggacagacaaggagaaaaggagcaaaaagaatgcgtattaccctattactgtattttatccgacatccgcatgttggttgatgctcaatttgataattgggcacttgtaatacatatatgctgatgttcagattgattattgtattttatgttctgcggggaaatgatttttgcttttgttgtcaccatagatcattcaagcttttgttttaaattttaaaaaatgtattgttagttgctgaatatcttttataagcaggaagtcaggcatatatagtttcaagaaggcccatgaaagggcatggaagggagatgattcagttgggtgttccaatggctgatgccccagcagaaggggaaaatatgacaggagcctccaaaggcatgttgtattattattatgtgattttctttagataccaatctactatagtttacaaaagtttattatttggagtcttttttaccacccttgtaataatggttttttttttttcaacttttactgattgaatctggcagatatgaatgtagaacctattccttccttgtttcaagatattattgagcgtatggtttcctcgcaagtaatgactgtgaagcctgattgttgcattgtggatttctataatgaggttgatttttctattctactttttatgagaaaagctagcaacactagttaacacattttttcataactctattattgggtgaaattcatgtgagtcctactttcaaaaccctatttagtaggtcacatggatttgatctaataattaatggtgtgtggaaaagagaatggtaaacagtgtattgctagcattctaaatttttatttattggttatcagatgttttaacctgacctggcatcacaattgtctattgcctatagggtgatcactcacaaccccacagttggccatcatggtatggaaggcctgtttatatcctttttctgactgaatgtgaaatgacctttggaagagtaattgcctcagagcatcctggggattataggggtggtatcaagctttctctagttcctgggtaatgcttgttaaccttgtcttttactatgataatgcacctgatatttgttctataatattgttcttgagaaattacaattgagtgtaatttggctctggtgaccatgattatatatgtgtgtaatgcacaagagaattctccattttatacgggtgacaatatttgtcttttgtcattagttgtaactttacaattaaaaggtttccactattacttaatcttatcacaaggtgccctctttgtttgctaagcgggagtctgtgggacttgaatgttttgggtcattccattcttggaggtgattataaagttggaaaacctttgtagagcatgcttactttgcttgttgctgttattaattttgggagtagactctacagcatcatgtgcattctgggtgtgcagaattcattgtgaggggagagcttcttgttttaatgtgttacactagtactgcaatctgcaagccgtctacctgttatgctgattctatacttgatatctgatatgatttttggctttggctgttataggtcccttctggttatgcaaggtaaatccagtgattttgctaagcatgctcttccttccgtctgcaaacaacgcatacttgttaccttcacaaagtctcaaccaagaaagtcactatcaagtgatgctcaacggcttgcctcgacagcaacatcttctcattggggtccattgccaagccgatcccccaatcatgtccgtcatcacgtaggctccaagcattatgctacacttccaacaactggagtactgccagctccacccattcgaccacaaatggcagctccggttggcatgcaaccattgtttgttactgcaccagttgtacctcccatgccatttcctgcccctgttgcaatcccactcggttctactggatggacagcagcacctcctccaaggcatccccctcctcgagtccctgctcctgggacaggagtcttcctacctccaccaggctcaggtaattcatctcaacagttaccagcaggtactttggctgaagtgaacccaagcatggaaactccaaccataccggagaaggaaaatgggaaaactaatcagaatagtacaaatgcatcaccaaaaggaaaagtgcaaaagcaagaatgcaatgggcatgctgctgatggaactcaagttgaaccagctctagagacacggcaagatagcaatgacaaagctgcagcatgtcattgagctgtaccatgcttacagagagatagagagaggaaaagctaatcacacgaacactataggcagtgaacttgagtttgaagcaaatgtaaagcgcggcaacacgagagatatcactatactgcaggggagaacaagggaaggagggagaacttttggttctctctgtaatcctttctttgctccattccttttttgttgtcttaaaaaatattaactattacaggaagggaaacccattcttaattctaattttagcatttcctatcttaattattttattttaatgcatcttgctgttaatattgatcttgtggtagtgtttgcgtgtttcaactggatttgttaaaacttaactagtttaagacatacaaaatggcatgttgagacggaatcaaatagaagttggcaacttattctattgaaaatgggtaaatcagcttattatatcatgttcagttccatttgaaacttgtcaattaaataattaacaataccgatacaacaccagtttagaaactattgtaatattgccctactatgttccaaaaaccattagacatttgtcatgtcctaaacaagaaggaaattggacatccaaacctaaattctttgtcaaggtttgacaaacaaacaagtcaacattattgagctccttaatattaagattctacaaaaagcactacaagatagaagctaactcttgaaatctttggaggacgttcaatctcttctgaataaaattagatttcgtgcctgttcaatatatgaatttataaaatgatatattaatttcttattgtgcagtttattaataatgatattaaacattttgttattattttgaagatatttatatagagatgcgaagtcaaacggagacttaagaagtgtctaatagtaaacaaacacttattttttccctttatcatatttttttcttctcaactttcttgtatctattaaatagattttcaattaaagtttggtgaaaaaatgtattgtatagataatcaatctgcgtaaacattctctttgcgataaatatattgcaaaagtacatttctgtcttaagtaaaaatctttgactttgaagtaagatatttgagtagggatacgaaagatatttcacgtatctatttatatcattgaattttatattttcttttattttaatggtgcattcaaaattgttttgtcgtgatttttttatttatttataataattgtactgaggtttgaatgaatatgttagaatttgattactgtctagatcatataatttctttgtatttgatgataggttgatagttaagttgtattttatttaaacatttaaaattacttaaaacattttaatataatgaaatacactagtaatataaaaaattatattattattatctaattatcaattatcatatgttttaaaattataaattgtaattataattacttaaaataatattttaatttttttaattaattagaatgtaatagtttttacggtcacagtatattaaaattaaacgtttttaatatagcttgttaattttgattctttttagtttttatatataaacataaattttgcagttgaagagcttagccctaacccgggtaagaaaggtgggtaaagtacgtgataaagcgggtatgcggaagcagtcagcaattacgcagagagtaaagtttcaactttcaaagacatgacatgcgaatccgatccgtaggtaataataacatttgaagaagaaacacaaacacacgacacggagttcagtagcaatgtccgaggttgagtttgtacctcaaccaccacgcctcttcatccccaacttcctctccctcgacgaatgcagagttagtttctttctttgcttgctttaattaaacatttgctctttctttttattctgattttgattttggtgaaggaattggaattcatccacaagagtagcagcacggtgggttacagacccaatgtcttctccaccactctctcccatctcattgctaccaattcttcccacttcatcattccttttatacccatcagaggtacttttacatcaaaacttcatttttagttacccccacaatttaacaatctctttcaagtttatttgtttttatttgtttccgaatttggtggcagaacggttgaaagacaagttagaggagtttttcaagtgtgagtatgagctcttcgttgaattcactggtttaatcaggttggttaccttaccttacctcgattcaatgtctggttttttattctctatttgataagcatttttaccatcttgtttaatggtactatgaatcagttggagcagaggagcaagcattggatggcatagtgatgataacaggccctacctcaaacaacgtcacttctcagtgagtattattcaaccgatcaacccctttttgaggtattgaattcttgttatgttattcactattgatcactacctttttctcccttttggtaataccatgaaaggcagtctgctatttgaacacttatggccaggatttcagtggtggactctttcacttccaggatggtgagcccaagtcaattgtgccaaaagccggagtgagtttttccttcttttttttttttttttttaaaaaaaaaatgtaattcaatctgctgttaacattcttacggtggcatagtatgtcttgcgaaattcgttattgaactataatatgttcatttatcattccaagtaggaaatgagcagtctttcactgtgtttatctttatttgaatttgaggatgattggtttttatttcaggatgttgtgatgtacacagctgatgaccgtaacattcattctgttgatgaggtatattcaaatgctctcttttcttttgagtgtctatttatttacttggttgtacatgttcaactttaatattaaatcataatggaatctttattgcctcctccctaactcccgagtccaagaaaaagaattctttgtaaactaacatgatttggcttcttatattgattattgtttctctcatcaatcagcctcaatcaagagttgatcttgattattgtcatgccaacaatacatttccctaattcaaacgtgattcatttcccttaatcataaacagtgtataaatatgttgtacatcattcataacatacataagaaattattctatccatttcaaatgagtgcaaagagtaagtaggctgctgttatctattaaaattttaattgcatttataacctcatggcttctattaaattttcaacaaatatgataatagaataaagacctttctgtttcatttggacaaaatatgcagacagaaaactttcatctgttatggactatcaatagatattgaatagattttgagattgatgtaggtaacagttgtaaataattttttgaaggactaaatggctataaaatcattctttcatggagcgaatgatagttcaatcatcaataaatatatgtctcttaaatttttctgatatgaagttatctttttacagataactgaaggagaaaggctcacacttgctttatggttcagtcgtgatggctcccatgatgaggatatgaagctcatttctcttctttcacgacacctgttgcatgactacatggctgattcatacctacctttgccagcatccagtaatatgtactggttttctaaggaccaagctttcgattatcagttcggttttaatatatgctgggctagactgcatgttcttggatatgacatatatatttctcaagacagtagctgtgagtccgatgtctctgaattactggtaaagccggtgcgcttagtgaggggggatgagttgctagaccaggaatttgtcaatattatgcatgcacttcaggtattttaaagaatcctatctatgtttttcacccctgttaatattaaagatcaagtgtatagcaaatgcacgtaactatacattgaaagcctataagaagtgaccatgatttttggtcttctttctcatccttcacaaaaagcagatttataaaaaccactggtactcaatcctttgttgtgcttggcaaagctgtcaaagcaaaacaaaactaactagaaatttagttttccactttacccaatggagagaatcctttttccgatgttagatattattattatttttaaaagaagagattcatgaggacaaagagataattataagtttagtagatttgattgatgaaaactatcaatgtgttatgtgtagcacaatcggaccatccatcaatttttattttcttttgataatgaaaactttatgtgattgggtcccaggggctcaccaggatcagggcaagcctcaagcctcaatgagcgcttatagaggtacttacagattacccatcaacaaggtcctcacatcagcagcgggaattgaacccacgtccttgtgggatatgagtccgttccttaccaattggacaacctttgttggctgatcatgcatcaatatatatgtgggaaattcttgctatttattatatggagaatgctttctagaaagtataggttaactgtcaacctgagtgcattgcatcaactaggactttctatatcttgatgttaagaatagaaaatatagcacatgtttttggaattttgttgtaaaagttgtctggatgtgtttcttttctttttagtaactctatttcagcacgactatagaagggatcttgaaaaggtaaactgggtcccccaagtttctttaagagacttaaaaatatatgtacctttgctcttatatttgcattttatgatgtaatatggtcccttcatttttctttaactgcatttactactgttgtttatgcatcaatgatttcttgcaatatataatcttgatttgttttggaaaagtttctgcaactactctgattcatgttctttgctagaacaggttgtccatttctattgttggaaaggatcagttttactgaacaagatgtcaaatatagactccatggtagtaaaagtgacagatgtgcagagagagaaaatcagtggtctgaattctgtacttttgaatgatgatcattttgcatccaaagttttctgcaatatgccttccgaagaaaatggatgcatttgctttcactggtcaggaattgtggctgccgttgctgcttgggaagattatgcgatgaacttgagcaaacaaattcatttacaattaccttactggagaacacatgaatctatatatagtgcgcaattagatgagtagtattcatgatcaacgtttccaagaaaaagtaaccacctacaattgtgcttgggttaaaaatttggaaagaagcactggtgaaacaacttgaaagtagtttgtgaaggtttgctttaatagcattttggaaagttttaaggcgaagcttcttggggagacatgagaaatgaaactgacggatatctcaagatttatcataaatgtaaatgttatgcatacttgatgtagattgggttgccctgctaagtagagcactcatggatttttctgcatcaatactagattgcaaatactacaaattgtgtatgcctttgtttctgaaacgttcttttttcttctttgctttgttacaaatagtacatttttaagtttccctaattgtcagccagaggggcctccattttcataacatagagctggtaatgtgtgtactttagcttattatatccaggctgctacgttacggtctttggatatgctccatgtatgcaaaactttgccaaaagcatcataaaatatgatatctgctttgcttttggtgatctgcatagacatgaatccttgcccatcataatacaacttcagttcttccagtttccacggcttgacatcacccgaccatgcctttgatccacctccacttgttataaagtgaattccactggattgtttatgcaaaccacagaaacttgaatgtcagaacagtgatgatgttgaagctaatcatttaagagtaagatatatgcttacctattattgtcaattatgtgctgcaagcagtggtcatgtccatttatgtatgcatcaacatcgttcgcctggaccaataatgaagaaactaactattctgaaattataaagttttcatgcaacgatttcaaccattataagggaattaaagttttaacatggtctcagctaatttacttatgaaacctggttaactgacctagtagttacactatgtaatatgtatcatctttaacaaatactgaagggggcatttggtaattataagatatcttggtgtcttagatatgcaaatgtttggaaaatggaatgccgacatggcagcaatgtacttgtcatactaaaaacacgaggaatgttaaatacgagtaattaacgtattaatatgagaatgtgatttgattacctctaagatgggaacaagtagctgtttaagctcttcggtgttaccatgatgcccagcactgttgatggtatgatgacccaccaccatcttccattttgcttttgattgagccaaagctgaatcaatatcctacagaaagatttcagggacagtccataatttccctccttttaatgttgcaattaaacgatagatgtattaatgcaaatttaaagtctttgatatcttagtggtaataagttttttgacttgtttaaaacgatgttacattttcctaaaccatgtcataattttcaattgtgaattatttcaagaaaataaatacaaaaatggccgtttattttattttttttaatagtttttagaactcactaagacattatttcttgacaaaagtcaacaaatttgaatttgtaagttgtaacttgtaaccaaccttcaagagttctgaaaggtaagttaggcgaggaagaacgccttcccagtcataggtatgctctcccgggtctgtgaagtactcgtctacaaatggagtcgtgtccacaaagaaaaattccacaatttctacataaataacgggcaaaaacacaattgttacaaggtttaattcaataaatgaatacttttattatgtaatcatcacaaaacattacagcatcaattacattatttacaacaacaaccaagtcgtatctcactagatgagatcgattacataaatcatataacgtaattcaatacaattaaaaactatagtttcaccatcgttttagaaagaaatatgttgtgaataattcatgttaagtataacggtttcgaacatcaattacataatttcatttaaattattatttcttaaaatacaaatgtgtaaattatacctccatcgagaataaaagatctcatgcaaagccatctgctatctttttgttttagaattggacttagttgtgcctcaacatcacctctgtagtcatggttacccagaactatcacagtaaaaaaagaaaaagaaaaaggaagatcaattgcttaattagcaaataattttataaaattggcacaccaaaaaccatgcttaagtatttgtattttgtagtattaacttaccagtgtaccatgtcttttgcaagctcggggcagtgtacatgtcgacgaatgattggtagaatgctggatcatcaaccccttttagtccatcttcgtaaaaattgtcaccagtggagatcacaaaatctatgtctagtttctctcccacaattcccatctaaaaaaataagcaatgaagagttactacttgatacctcaaaagaggaagaaaaaaaaaccatactagcaacttaaaaatgggattggctgtttgtaaaatctaaacttaattatctcactttatagtagatgtgcatacaacatttttggagtcaaatgcgttattaaccgttcaatgtcaaaccctcgagcttaaacatgatagaaagcaggaactgccacatctaaatgtgaggaaataatagcttttcttttgtgaataatgtagaagaatgtaaatgtaagatggagtacattagcgtctcaatttcttaataagatcttggaggaatgccatatattattctgtcaaacttgtaagttcgttcatgtgtattttgttttattctagataggatggttttataagaaaaaaaggttcttgtctatttctgcgaaaataaacttctatgatttaataataactaacttggttttgatgaatttgagtatagttattgttttatattgtcatctaattatactttgttatatttttagaaatattgagcacattacataattattatcattgtcaaaatttttaataatatgtgatgctatttaatttaattatagttttttatataattacaatacacaggaacagtttttatttacttttaaaaatgtataataaattgcacaatttaaattagatgcagtaggtggatcgaaacaatttggcctttatatgtagactgaacagaacacatgggcttatctaggttctatggggttgagtcaatcacaattttctcattgagggctagatctcatcgagaaataacttatttggaatttgcttacacctcaagagtaagaactcttgaatcattcaagtgtctaactcaatcaagttaatttattgagtgatgattgtctcttacttatatatatatatatatattttttattgtagacttatttctattttatatctaatatttttagacttagtgtggagataacatgatgtgtgacttttttaatgaatttaggataaataatgatactatcttagaatatgaatttgaatctagctcaatcctataaactagttcataaagtaaaaagaaaatgaataataccaacaaatcaagtttacacgagtacattgcagaattatatagcaacacctaataatcctaatatcctattatctctggtatgtttttaattaattttatcctttttgtctcttttctctcttctatattataaattttaacaatatatgaattttttctaatatatatagttttttttttacttttaaaaattaatagcaaataattttttgaaagacgtatgtatgacttgagtttttagattgctttatttttagaccgtcccgatcaatgtgacgtgtatttcaattgttattattattgttatttttaaaagcatcattttgttgtattggaatatgccttggaatatacatatcgtctatgttgtattggaatatgcgtgggattatctccacaagattaaagctttgatgcttggccacgtcgttgtggtggtttagaaaccataggtctcacaagtgttgtccaaatgcattaaaaactctacagtgtctacactatatgaaggtttcatatttgattactagacaaaggtttgggaccatagttttgggggagagagattatcagaggcagaaattaaaatcgcgcatcccaaattctaaaagacaccactataaaaattaaaaagggcaaaggtagatgagtgatgatgacatgtatgttagtatcattaactagtggaagacagggatagatagatagaagacaaaaaaaagaagtaactggtcaaatgtgtaacgtccactttgttttgggggtggatgagggagtaattggaagagtaacattataaaaaaaaaaaaannnnnnnnnnnaaaaaacagaagagaatatacttaatgcatgttaatcaataataacctgataaagctaagggaaaaagtgaatttatatattaagaaacccgtaaagctaaagacgtgaattaatgctttaaaatgtatcagcatctatgcgaagcatatggaatatgcctcagatttatatatatgtttgatgaaatatattaacataaaaaataataataaatcaattcaatttaaactgatttagactagttaaattgaattggttttagatttttaactaaatcaattggacgatataatgaaaactgattaattaattgaatgaattgatttttctcgttatcaattctgcaaaaatgctattagtttttgtacatagttcgactaaacatacggatactgaaaataccaaagtgcactccgtatagttagcatcaccattgcttttagtcttaaacaggggttatacttatgtgattaactaaatatccataatttagactttgggtaagagcattttttcatgtgaactaaccgatcacatgttatgtgcaggtgcatgcaaatttaatgtgcagaactataatatattccattgaattatgctttgtataattatctattgattatatatgacaatgagattgataaccttctaacaaatatgtctaagaaattaaaaatgaagatataaaagaagagggagattaggcaaaaattaaacctgattggcgaccaaagattgattgtaggttccttttcttccccaatctccaaggatcaatatattaagagattgttgtttttttggagggtgtttgaatatgggaagttccgcaatagaaggagttaccattaagcagaatataccaactacgaacataagagggaataacatgcgttggtttaaagatgaagccatggtttaatttttaaggacctgcaagttctccaacccagagaatgagagaaagagagagggagggatagagagattgcaattttatgagagaagatactatatatatacatacatacaaatttgaacgtaataaataatattttttcttttaagatagaatattaaataacagttataaactgtactgtatattttatacaagacatatacgctactgttaatttataaattataaaactatgaaattaatataaaattattaaaatattattttatttctcatactcaacacttgaaattttaattattttatttataaatattttttctagtaaatcttaatcaaactaaaagtaccacataattttttttttaaaaaaaagtgttacgaaaagatgtattttaacataaataataatgcaaacatagacaatcttcttcctacgaaaagaatagcgtacacgattgttaatccaagaaacttctgatggtattcttttataccaacagtacaacgcatattcctatttcccatttccttcggaaggaagagaggggaaaagaataaatatctgacattctttattttttattttttattggccttttcacatttacttccttttcagatttaattgtagttttaattctaattgtataaattaatggcttcctaattaaaaaatttaaaggataacattttattataaacatcatataggaaaatacataaaattcatgaataaaacaattttacgaatttcaataaattttttctttcaattctttaaccaatgtctcaataaccttatggtactaattaatatttgcttataaattaaaaggagaagttcatttaaatttatcaaagaaaattcttttcaaagtgttaaattatttaatgtcaatatttagtttactaaataatccaactataaattaaaagaattcaattcattttttttaaaaaacaattactttttaaagtaattaattatttgttgtaaatatttagtttgcctttttctttttgaaacagaaagctcaattcatatctgcattaatagatagcatgaatacactggtaccggtgtatgccaaaaaattgaattgaactgcattttatatatcaattagtaataattttgaccatttttttggcatataaaagttcatcactatcttttaaccaatttagagttttttcacaaacaatttactgaaaatatgcacaaaaattgtttacctgcaaatttgtttcaacgtttggaactcgtaattttgttcataatcagatgttattttattttagtatttaaaaagacattaactaactaaatggaataccttaagaagtgggagaaaatgtattaaaagttcttggtgtcgctatgatgcccaacgcttttgattatatgatggccaatcactaccttccaggtcgctgttgattgttttagtgccaaatccacgtccttaccaaattaagcaacgtcaatggtcaaatacatatatcacaaatttgtttaaatttatttattgaaataaatttttattttaataatatatatatatatattttagtatggttgtctaaattatttcctcttaaaaaataattttttgtttattttaagaagtaaattcaatctgttttttaaaaaagttatataaaatacacttattttaaagttatttttattttttttttaaaaaaactcacccataaataaaataattttccttcggtcgaagagaatacttaattaaaacgatatcgtattaattaggtttattcaagtttgaaatggaaattatacctcgcaattccaaatgtcaagtatgtatttatgcatttagaaagaagtttgacttctcttcttaattaaataaaattaaaatatatcacaagtgataagaaaggatatatcttttgccactgcctacccaatatatatatatatatatatatatatatatattttttttttttngaaataaattcccattatattaaatataggagggcttatctttcttcacatttaaatgttttgtattaatgttttttaattcataataaaattaccttgagaaggttagaaatgtaaagcttcctgggtagtacgcctctccagtcgtagatatggccttttttctctatgaagtatttatcgacaaaaggtgttgtgtctacaaaaaagaagtctacattttctgccaccaaataaagcaaaattatatcaataaattctaattgtaaccactgaatatatcagaatgtattgtactgggtaattaaaattctaataacgtccttatctttttgaaaaatgaataacaatttttcttctgatgactgaaaaatatgaaaaaaattataaatatccatcctttttattatcactttttttttatcaatcacttatctcacatataattttttttcatttctcttttaactccattccactttgagatggacgttaatcagaaatttcaaaaaatattataaatttttataggataagaaaacatgttttatatagttgtgtaaaaaaaaacatgttttatatagtatgcagtaaataagagtaacaacaataaaaatcccatccaagaaacaattgttatctaatattatttataggctaaaatgattacactacaataataaataaagagcctaaattttttcatttgaatcataacctgggtaaaagtagaaagattattaaaacagtaagaaaaggattagggaatttatttataaaagcaacatgaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctctatatagataattgctaatgtacacttccttatcttaaaaggagtatgctaataaattataattgtgattaaacttatatttaatttaatgtcagatcaagaggttgagtaagattcaacaaaaaaactaaaaaaaactaactcagagtaattagatcggcatgggttaattataattattcatatccatgaacaccttatgttaaataaaatattaagaatacaaatataactctatcatacttaataaaatgtacacttaaataagatgtctcctttctttaaaaccattatagatatataaattgatattatgtgcattttttatttattaaacaacagcgcaagtaatatataataaaagagttgattagcttgttttcttaactttagatgctagtttagtttagccttttctgtttggccaaccgtggtgttttacttattaactactgtttcgtgtctatgattcattaataatagtgattaaattagaacaaaataacaatggtcttaatcaagacgagctttaataggtatgaataagatgaattcaaattcgcttcttgttactcccttagtcccaaaatattcggttaggttatttaacacagatgaagaaaaaataataaatagattaaaaaagaatgataaatttacaaaattaaccttatatcatcattaattcattttaaaattttgtagttcatcataatatataaggaatataagtagaaaaataattaatattacattaaaaaattaaaatcacaattattttaggataatttttttttcttacacaaaaattataatgagatggaggaagtaattattaaagaaaccaaattcaattaaataaataaatagagggctaaaaaagtaggttagtttttttacagagtttatattcttactccgagacatcaactaatgacaaattagaactttgtggtccctgtaacgctccatctactcaacttctgggttggccatgatggtggaccgcagcagtggaagctcggcccaataagagtccatgtttttgaacagaataagagtccttttttagttagtggtccaggtagttatagtagacctcacactaaatgaaaactttcagcctgtttagaaagggaaactccactggatgaagagggttccccacaaaaaggaaactcacaaccaccatttttggggtttgggtttgagcatgctctctatctctctttcactacgccattgtcatttggcaagtttgcatgttgcaaacgtttcacaaggaggaacccaattttaaggaccaaaacgtccaatgctttgtggccattggttcacaataggctcaacgctcaatatgtcagtcaagaccagaggcataccaaaaatatacttaacgtctgttatttcccattgagaacattcttttaccacaaattgtttttgagaaaatgtaactcgaactttgtattaagaaatgagtaaatcccatttcattttgttgtcaaatgaaatggagtttaaaaagagtcataaaaaaaaggttacagaactaaaagaggagagtatttagtgtgaaaatcataaaagaactcaaaaaagatcatatataatgcaattttttgtatctcccaataaaaattttttattttaaattctttaattagtgctctgagggtactggttagcatttaccaaaataataataatattagtgctccggggtcttggaatgctaacatggtatgacaaatgccactggatgatacatatttaatcagaggcaaatgataactagtgcatttaaggtactgcttaaaaaaactaaaaatataattctttttatagaaatgcgtaaaattatgttgtccatgatttttctttttcaatctcttatgattttcataacaaatacttatcctttcagttccttaaccaatgccataaggacattagcccttaattagatatgcctctttttttatgggtccatgcttcagaacttcctcatctctgtaaatggtcaagatatccaacacaaaaagaaagggaaagtctaaatgctgaggttgattgtatagacttgcagtaccgtgttctaaactgtgtaagttctctatgcaatgcaatgatcgattctcaagtagtcaaccaatcaaagaactataaatatataaatttcaagaacccattatccactggcatcatcaacactgaaactcctatcaaatgcataatccacaaaactgtagagaggaaagactcgttccccatacttctcaaatccatccaattcttccttagcctttgctctgagctcttcagctttttctattgccttttcaactccataaacctctgcataactattacccttgtttttcctgtcaccacgtccctcaactttcaatctctcttctataatatcatccataactgcatacaatactccaacagctctcccatacctccttagtctctctatctcatcatcttcagctccagctaagaatcctccacacactgcagaagactcccccatttcaccaaactttttttcttgtataaatccaactgcattgggtcctccttcaaggtccaggaactgccctgcagccattccagtggagcctacagaacgggcgatctcagcaatcacgcgaaggaggtgcgattcaggcacaaggtcagatggagtctgtgaaacaatgtgctgaaatccaaggggaaagagtgcatcacccgcaagaattgccatgtcaacaccatagatggtatggtttgaaggctgaccacgacgtgagggggagtcatccatgcagggaagatcgtcgtgtatcaatgaagctgcatgaacctgatttcaacagaaatataagattaataaacttataaccatgtatgtttaaaatactcaaacacattcagtttatagtcattatttttctagtgaagtaaatatcattacttcataaattccattttgtatcccatcaggagttcaaaacataccgatccagagaatctattttgttaaagaacaatgtaaattgcaaatgtaggtatttttaaacctaaagattcttaacagttcatctaaaggtcaatgtaggtaggtaccctatgatgcaaataaagctagagctagctaaagatggaaaccaaaacacttatttgcatgaacaacacaacacacctacaactaaacatgcatttaatgttattctaaaaataaaaaagaagagggaatcaggatcaggtttataatgaaaagaaaattgtgacaatgataaagcaatctctctcaaatgtctcaagtataataatagaaaaacaaattacaacacaatcaatattaccatttcaagggcacaggcagtggggaaggcggtaaggcggctgcccccaaagagttcacaagcagagatgcacataacaggcggggctcgcttggcacctttggcaaggactgaatacctcatagcttcatatatctgcggaggaaactgaaccggaatagcttcgtcgagcttctgattgatctgcaccattaggttagcccagtatgtcttcaaatcaaagtcagcagcttttgatcgagtggaaaccgaagtttgagaagacgcggcagtagagcagcgaactcgaaacttcaagtttgtgggctttgggaggctgcagatgtgagaagagggcagtgttgcaaaagcaaatggagccatcctcaactactctatatggaaaaaaagaataaagaaaatgaattcaatgttagccttaatatccattccatcaagcaactggtgggcatgaaattttcataaatacgaacctttgcttcattctaatttaagacacaaacaaacacacatagtaaggcacaccaatcaacatggaaaacaactcaaactccaaaaacaaagtccctatgatcaacaatttcaaatttcaacatcatagaaccaatcaacttcagggtcaaacatttctattctatgttaagccaaatagttgaacacccaccacccaaaatactaaattgcacaaaaataagtcaaaaaagaaaaagaaaaaagattaccgacaattgaatcgcaagagtgaatgagatccggcaattggggggagagagagttgagtgataaggtttggtttgggagtcaatgggcgattgcgataaggttatggtatggtacactgtgtatggtacagtgttggcgagaccctgcaaaatacaaatgcggttttttctagcttaaaattggtattttagtttattaatttcattggataaatgtttaattttacataattaaaatttctaataaatattttcttaaaatataaattagtaatatggtaattaaaattcataataaatcattattacttatattttagatcatttaaatcttgatataagattatttttaattataatattttaaaatattaaaatttaaattcaaaaataaaaataaaagactatacattgataggaataagtaattaagataattaaacacataaataaacacacacacaaaaaaaaaaatgcttttgaatatccaaaaatttgaatttgagttaaaacaacttttgattcatgagttaatgataaaaaaaaaagaggataagttcgaaaaggttgagagatttttttaaaaaactaattacaagaatactatataaaatgtgcatctaaaaaagaaaaaaagagagaatattaaaaatggagagtaaaaatcctactttttaaactgtggattctaatttagaagatatgaatttataaaatatggtgactgataaatgataatcttgcaaaacttggaattatccacgactttagtgtggacctatacgacattccttatgctatcctttccttggatttgttagctgacaatcccaatgttgtttctgttagctagttgtttgtttttcgggatttagcccttgtatccagcagaacaataataatatattaatatgtaagccatacaattctattagatttcataatttaaatttctctaattgaatacttatggtttaaattttttattataaagtttttaaatgttagcattataaatatttgttaatattattatatagtatttttatgaattgaattaaaacatactaatactataatagtttttatgccccatcaaccataaatgaacatactattaaaaataattaatttaaaaaatatatatatagagagagagagagaaagagagttatatgttaactataagaatgaaaatatttaggttggcaatttatcaaagttacactcttttataaatatacatataatttaatttttatccattgttatttttcctttgtgactcattatccattataatgtatatatttttatactatcaattaattaacaattattcaaagtataacttttaaaataactattatgagtatattgaataaaaacataaaaaaaataattattatgaaagtcaatatatgggatagtactaaaatagaataactctttacttgtaatttcttttttaaagggattgtaatgattcgatgaaagaaaaatgagatgtagaataatggtgtcaaacaagtcaattcaatccaacctatcttcaactcattgaaaaacaagatgagttgagtttagctcgtttttatattggattaaaattttcaatccaacttaacatgtcaacccattttttttataaaaaaaagatttaatcattgtacttgtcttaatttttttttcaaatttgataatcaaatataatttaaaaagagagaaaaggttacaaatctaataaatcaagaaaatacttataagattatcataaaaatataaacattaaatttagtttgagaaaataaaaaaataaaaaagttttaccgattgaacatgtgaatccaacaagtcaaccttacccacatcaagttgggggtttaacggccaaattaaattacatacatacaaattaatgagttgaaatgtgtaacacaactcaatccatttgtgtggattacatggattgattgattaggtcgaatccattttgatagtgctataatgtaaagagtttagaagttaataaaaatctttcaatgtgtcttttatagtttagtaaaatttattattagcttctaatataatgaacacattgtcttttatatgatttttttttttatattttataggcacaataataacccacaaatctctctttctttccctattctaatcctcagagtgagtccttttaattattaagtattttagaaccctaagttgaagggtgtatgagcagtaggtgttgaaatgatttagtttggatatatatatatatatatatatatatacacacacatgaaggaaacactgcaagaaattcagtacctgttaaccggtataggaatcgttgttgtcaagaaaaaaccatatatttacgtgaagggaacattccaagaaattcagtacctgttaaccggtatagatgtattttattagtaacaaaaattaaaaaccaatcaaacaattaattttcttaaaaaatgattcctaacaacgaactacgattatgtatctcaaaaactgatttcatctatataataataatgcatgaatcatgatggtcatttctacaataatttatgctaccatggtttggtgaattattttctgtgttatgaattgcttcccataagataagaacagaactcttttaaaattaaattaaaacacgtagcaatgatacgatatgatacgatttcctattaacaaatggaccccatggcccatgcgtatggtgcttttctcttcttctccagttgtacaaattgcgttataacaccactcagttagtgttgtttgaaaataccctcctagctcgtcattttcatctggaagcataataagtatatatataaagttgttgccacttgcaatactcatcaatcaaaatccacacccaaagctttcttttttctccatcaaattctctgacctcaccatggggatgcagcttgtttcctcgacagtgcttgagcggtttgaatgagcacctaaacaagatggatcacttagtttcttggtcattgaaaattggggaagaaaaggagcttacaaccaatccgaagttgcattccaagtaagttacattttaatacacaccaaccaattgcatgtcgacaaatattagtcattgttagtatgacatatctctttcctcttttctttccattcaaacaccaaaccaaccttaaaaccgctcaagcaacaatgatagtctatatgagtttggtgcacttaatgctgatcagcaacaatgataatattcatttccctccacaaagtatttttaatattttatttcacttcatttctttcttcacaactttcttctcctcctatttctggcacggtgtgtttacacccatggagtgtataagtacgaatcatttaatttccatgcaaatgcaatcttaataatttagaatgaatttaaaaacatttaggtagtggacaaactagtggccattgatacagcagagaaaccccaaacagttatagcagaggaggagcagccaatgaatatcgtgcttttccttgctatacaaagtggtcactgtgtacagattccttacactctttttgtatccattaattaattaataacaacaaggctcctaaaataataattataatatattaggccaatcatgcagcccatgcacgcgccagtagtttagttcttatttggcccgaaacatctgcatctgtattatctcattgattattttacaaaaatgatttttggcatgacactgtgagagaagaaaaaaaatataaatattataaataatatgataggatataataaaaagagagaaattgtgaatgttaataaagatgataaaattgtagtgttcaaatattatataacctattattttattagtgtgttgaaaaagcaagtggtatattataatgagttaacgactaacgggtaactataaacaagtatattaaatatcttattgaataaattatttaaaaataataaataattttttgataaatcttattaaaaataatacatacatttatattatttaatcacaaacttatatatatatatctaaatttattaattttataataattattttaaaaatcatattaaaaataatttatgattgactaactttacaatttttgtatggcacacttaaattcttgagtgatgctatttgttaagaatggtgagatgcaggaattgggcacggaaactgatgtgtaatgctgacatttttctaaatcaaacattgactagctaataaattaagaaaaatgtaagaagaaatttaactgaatatacagtcgtgtgattttgatgaaatatattcgtcataaatagctagaatttttctaaatttgtgtataaataattattttgtcatggaattttattaaattttattagtttttttatactaatttgaacaatttaatttctgagcaaccaattttaagaattgtttggaccaacaatccaatccaattttatgtctgcaagcaaattatggtcaatttttcatgtgtctttttgcctccgttcaataattaattctgaaaaagaagtgaattaattttttttctagatgggagttattggagagcaattggacatcgatttcgtgatttcaaacggcgacaatttttatgacagtggcttgacaggcatagatgatccaacctttgaagactcatatattcaccaaaatctacactgcttctagcttgcaaaaacaatggtacagtggtaagagttcaatttcataaatcttatttaatttcaacggtacacgtgaaaggaatgcttattagtgcgtgtttaaattttagttggaagaatttataagtattttcatcctacaagtaacaaattcgtcttttttttttttttcattttatgcattagaattgtaataaaattagcaaaaatatttttcaaactttaatacaaatcttgacaagagatggctttgcttgagatcttttactgtaaatgcaggtgtagagcaacctctcttgttttattcttcttcttaatttcaatttatagaaggcttcaaatattaaattcaagtaatataaattcatgtgactttttacattctttgtttcagaagttgcagagtttttctttgtagacactactccgtttgtggacaaatacttcccagaacctaaggaccatgtttatgattggagtggcatattgcctaggaaattaatagtgtgccataaacaaaattgttaagttagtccaactccatatgctttgttcttgaatgcataactaggttatgagctagagccactgtgctcatattgtcacaaaagatcactggtgtagtgtgtttgacttgtaattcagacaacaaagtatgaacccaagtcacttcagcagtagcaagagctaggcttctatacttgatctagccataactttctgcttcttagaccaccaggacacaagattaggtcctagaaaaattgttgctcctgatgttgatctcctatcattggggtctgaagctcaatcaacatcacagtatgcctgaagagagaaatttgaagaggtagaaggttgtcgccttaatccaagattggtagtaccatttatgtgtctgagaattctcttcatagctatccaattttgttttgaaggatctgacataaattggcatactttattcacaaaactaatttcttgtcttgttatggtggcatattgaagtaccccaacaattgatctgtaaagagtagggccagagaacctctttaagcctgatttagagagttttcaacctaaacataggagaagcaatgggatttgcttcatccattttagtctttgctagcagatccctaatatacttgattaagagttcgagagccatgagcttgattagatacttcatcctttgtatagaattaatttattaaaaaatgctagtggtgataaaagtaattcagataatgacagtatgaaagtatcttggaaagatgatatggatttaattacttggaaatattaacctatatatgttaaaccatgctagctctgaattacatggttccataagaaagaagactccaaaggaaaatgctattgcccattaggtcatgaccatttagttgccaaagcaatgttcttggaaaccaaacccctggtaccgacctaccttccattctgattgaactataatcagttcctagatgagatacgcaaacaccaaagtttgctaacataagttaacgaggatgaagagtttatttttgataaaaatagagaagcataaatagagatccgtagcctcataaatttctataaaactagtaaattcgataattttgcgaagaggttttcatagtaacagaaattttccaaagaacagaacagcttagagcaggggggccaataatagtcccagtccaggactgcatgtagatatcatgggcatcatccattccatagctaacagttccatctccaattcccttctcacctctctcaagctcttccaataatctgaagttcctaggaactgcatacatagacaaaaaagtttaacaagataggtgcaaattacaaattaaaaaaaaaagttacaataaaagttgaacacaatcaatgataagttacatttacaagtaaattggaaaaagggagcataagcaaaaacattaaattgcatcataacttgagtatatatttggtcacttctcaatatctgagttcacaaaagtcccaattgacctgcctgaatcttgtctattgttccttcaaatctaataaaagaaagaaccaacgtcaaaacagaaatcccattaactgatctttagaagagtgacaattttacagtacatgttacacaaaactatgtttagcgtttcatataacaagtcaataacaaagagagggggagtcagagagtgcattaaaaatacattcattttcagatgatttttaaaaaatcatcgtagaatgttaactttttaaagatgattttcattatgaaagtttttaagatgatttttgtgttacgaaaatcatttttattgaaaaactttgtattttcaaaattatcatcttaatggtgactaaaacaaaaaaattgttgcaactacgtaaaaaaaccaattaaagcattagaatttaaacatgtacttgtgcatccacacgttgtattagtattagaatttaaacatgtaattgtgcatccacacgttgtattagtgttaaaagtaattttttttactttttttaaattttttttaaaatgtaacatttatagttctttatttcacttatcactttgtaatatttcaacggttgataaaattgacccataaaaaatccaacaattttatacttgcatttattcacgtcatgacatgatctttctaatattaattaattattttttattcaccttatttacttgatgtttttctactattgataagactactaattaattgcttcacaattttcaatcattctcttgttttttttatggtatataagcaaccatatactcatgttatttttttcccctcatgatgtcaatttataccgctttatcttacctttttcccaactaattattaaagtcaaaccttgaccacaatagttgcctgtgaagatttgcaccctggcaatttcttcgacagcacacaagaaaatgacatttgagcttcgagcaaatagggttttatgtaactttctcataagtttaaatcgtcaaatctgttctacaaattaacaatataataaccgtttaacgacaattaaatgtgtgaaattattaaagaaggaaaatgcatgtatcttttcaaagttctttggttcattaggcaagcaaatgtaagtctaagatcattcaaaccccggcccttttgttggagtctttttcttggtttagctaattagataaggacacaaaacttacttataaggatttgaccttttcgatcgagtgattatttgaattttcattaccagcaataattagtgaatttgaacgagaaacaagagttagagtgtattttgacttcctagataaccacaatcgaggtggattattgcatccttacttccatgcatgactaaatttctagaagcatatactatatttatatataaaaacatacaccgagataattatttcactcaaaaaggaagaaacaaaaatataagaaaataagttagcaggtcaatggattgaagagacctgtatgttttcgagctttaagtagtactattggaatcgttatttgcacgtttctgttacccaaatttccttttattaattgtactaataaaatctgacatagttggtaaataattagtcccataaatatattaacagatgttgatttcaaactgtgcgtataaaaaaaaccatactgaaaaaaagttatatatactctgaacaaaagacaccctaagtacataccaaaaagaaaaatccatttattgttgaatttatatatttttttgaacagttattgttgaatttatattggtgagtttttataataatttatcaaataggccttacgtaataccttacttcataagttattctaaattaatagtctgtgatgctaatgatatataacatagtaacctgatttgctaatttatcttaagcacctttcttccgttattctaaaactgtcacccttagcctgcacctacttaatttgtggctcttggtaaaatcgcagtctatttcgttttaatgtgaatggtgatactaattaataaaagagataaattaatggtttgggggatgaaatgaaaaggaaacagggaggaggaaatagaaaagagtgtgtttggtaagtagataacaattaagtagggagaaaaataaaaaagatgtgtgactctaacattattatttttctgtaaaaaaatgaatggaaatgaatagtgaaaggctagaatcatgactttttatgatgataagtgatggttttagatgtttattggtgtgcttttttgttttctgaaaaggatgtttactgatgatttaaaatcctaaaaaacgtatataatcgattttcctacgaaattaaaattcgcaaaagctcatcagtggattaaaattcacacaaaaaatccgcagaaaacattttctgcaaatttttaagctaactccgcagaaaaattcgcgtctaattttttttttatgaacaattggagaagatcaaagcatatatactttgtaatgagcattggtttgggacgatacttgaaccaattatgtacgtgttttgagaatactattttatacatttttttttcttttgatagtactatatttgttttatacgttcttgttgtttacaactttaattctgccttttctcttttaatattttattaagtttcattatgcccttgaaaagaaaacaacacactttttggtgcttttcgttaaaaaaatacatagctaaatttattttatcaataaagtttttccatgtacgcagttcgagaaattaaaaaagaacaataataaattagagcgcaacacttgttccaatatcttggtagtgagttgagttaaattctagaacctggtgtaccactaatataagttagtattttgcaaatgatagctacaaatgatggatgtgcctaatttaattgactgaatactaataatagagaaataatttaattgaacaaatgactatggcttccatgcaaaggggtttttctacactgttaattagtgtcttagagatcaaagcacatgcataacacgaatggtgtattggtgtgtcattcactatatacagcactaggtgctccctccgatcccttgccttgcccctttgggcattttctgagtcccacatacctaatttaggttcaccacttcactttcatcccttatgaatattaactgaaacacaaaatcttaaattgttggcagaagaaaaattatttaaagtccattgtctctacccaaaaaaaatgtaacagtatgttatttttttagtttttaaagttaattatgagtagataagattaatttaagtgtgaaactaataaaaaaaattaaatcatctatatttagagctcaaactggttttactttatcatattaataaagttaattttctaattttaatttagtgaaatttaaaatcgtaagtcattgattgctgagtttgcaaggtcatgaatcttgatattcattggatggttttctttctcaccattaaaaataaagaataatatactattaagttattgatttaagtgatattaattttaatcttcttaaataaagtttgaggtcaaagattaaagaataataatatacttttagtacggtacaatagtagaagacattgtaattataatattatttttattgagaggataattgaaaaggccaggattaattaattggaccacagcgcaggagtctccaaaatgacactggacctataatgttgcatcggtataataatgaaactgcaacatgatttatttgagtgcgtgatattaaaattaaaccatagaaacatcattgtacatacgattcccttccctcttgtcttcttgttctttttttttttttgaagtggaaatctcggaatataatgcaatgtggtttcatacatggaaattttatcgtggggggcaccgagccactaatatcaagggagaatgttgtccatcagttcgtatttattttgtaagtttaaccaattattcttctaaaaaaattaatangaagttttatcgtggggggcaccgagccactaatatcaagggagaatgttgtccatcagttcgtatttattttgtaagtttaaccaattattcttctaaaaaaattaataccatacacaattacacacattttttaaaattgattgtatatagttggtctatatatattttcataaccggaaacagaaattaaaatgtaaataagtgattcaaagtaagagcaaaacgcaatgatctatgggtgtttgtaatttgcacgtcagttgcagcaatcaaaaaaggtatgtgagagagaaataagtttaagagaagagataaaataatttttttattctttctaaaaaataaacacaaaattactggaatgttcctaaattaaatttggtaaaacagaataactaatttgtttcatgtgagaatatgttaaaatatgagtacgtataatttgtccattcttagataaaacattgggttatataccctcactcacccgtatcaaatttgatcccgatattctaaaatccaatctaaacaactatcaccagatagccggatccacactcggagcgtttgagagttgaaaaaaatttattgaaaaatttactggtaattgaaagttgttaaattacctaattaagttatattatttgataaaattatccattatagaaactaataaatgtaaaatatgaaaatatacatatttatatgatatttttgtataaattttaaattattttattaataaaattaattagtttttgagagtatttataatttttggttttttaattaactttaaactcttgtaattttttatttatagttagttattttaattatatttttagtttcaattgcgatcttttttatattgtgtatattctattattaatcttgtcacatcttaaaatattttcaatcaattttaaaacaaaataaaaacaacataaacttaattagaagtcatatttttattatgttgatgttgattagtgtaatactctatctaaactcaaatatgaatgaaattaattaatgtctgggtaatgtcatggaaatcaactatcacatttaaaaataacttttttttatacttaaaacatcattgactggaacttgaattatttttttatgaaaaatcattaaaaatagatatcaattaattaaaggatgtttttaggatgatatcattcaatattgataaaaataattaaaaattaattatatttgagtccaatattttttgttgcttatattttggtccagagagaataattaatataatttaaaatatataagataaatagtgtaatggttaaataaataatatattatcaaatactcaccgaacatttttattttattataaggttttaatatatttttgtttatataagttcatattttttaattttggttttcgtaaaaaaagtttatttttaattcctataaattgatatttttaattttaattcctgtaaaatattttgttcattattagtcgttgtaaatttatatttttttaattttgatccatgtaagtgtgaacttatgaagattactaataaaaaaaaatttaagatcttaaagggtttaaaattaaaagatacaaacttataagaattaaaaatgaataaaaaaatttatagcgaccaaaatttagaaaatattaacttacaaagactaatttttttaaaaaaaatcttacatgaacaaaaatgaaaaaaatgttaacttactcgaaaaaaaaatatttaacnttagtcattgtaaatttgtatttttttaattttgttccatgtaagtgtgaacttatgaagattactaataaaaaaaatttaagaacttaaagggtttaaaattaaaagatacaaacttataagaattagaaatgaataaaaaatttatagggaccaaaatttagaaaatactaacttacaaagactaatttttttttaaaaaatcttacataaacaaaaatgaaaaaaatgttaacttactcgaaaaaaatatatttaaccctttttattacaatccgcaaaacggcaaaaggacacccccttgttgtagtccatttttcttggattgcttcatatatttttgatatatttgatttagaggagagaagtacgaaagatataaatagaagataaataatttgaaaaataagaaatagagtagaaatagaatgatattttgtgttgtttattttgaggaaaataagtgagaaatagattaatcataatattatgaagttgttcagtatgaatgaaataagaaagagagaattaaactttaaaaaataacattatgtcctagaaaaatggaaaggacagacttggtcctctttttttcgtctgatgcacagaaaaatacagtatgcgggatccactcttttcaaaattgtttctgctctttctttgacaccaaaagcagattattcatttatatctggtcaattgtttccaatttccatcgcccataataaaaattggcttcaagcacaaataatttagagtaacaatacatactcaacaattatttatatattttttattgcattattcattttaactatcactcttctctttcgttatctctcttaacttataaaatttattgtataaactgatctatgaatagcattatccaataatttattcttactgtcccatcttttgggattgaacattaaattatcacgggaaaaagtcaatcttgaaattctttaagggcttccagcagagttcaatgtccttacaagaaaagcgcaggttcactaaggaaaagatataaaaaaataatatcatcaatagattggtgtattaaagaactatttttaaatttaattaaatatataaataaatttaaaatttaataagtaattcaaataaaacattaaaaatacaatttaaaaatatttaatttaaaaatataaaatatgcatgattaattttaaaaataaatttgttaattaaaaagaaaaaaatgattaaagtatgcgattaattaaaacatgtatttaaatttaatatataaaattaaaattttcaaaaataaaattataagaactataaaagaataagaagaaaaagaaacaaggttttacgacttttattttcttcttcttctttaaattatgtatgataagttgtaataacaacaatatggtgtcaaatttcataaaaacaaaaacaaaaatggtggcaaatagggtccagagagacgccggcacaaaactgattggcccctaattgtattttgttattcttataattcttttttttatgcttatattaataattcttttaaaatacctaaaaaagaatcgataagatgtgtgcgtattggccataaatagatattgttaaaaataacgtatgtgaccttgaaatagtatctatgtattcattctatacactgccgtggaaaatatattttttaatagttgcggtatagttagtttctaagatactaattcaatgccttcttacatattatttttaaagatttgatttttttaaaattaatttcttaatttagtctctgaatctaatgttatcaaacttgaagtgatgaattgatcatgaacttagttgaaattatatgtcactattgattggactgataaaataatatataaacttaaatgtgcaataaatataataattaaaatgttataatgagtatatagttgtgatgtaataagtaagaaaaaatcatatatgtattaataatgtaaattttatattatcttcgattattttatgagatgttatcttttaattaaaaaataattatagtaaaattgttaaattttataagaattgtttaaaacatatataaataatattttctatttaatttacaatataagaatttttgtatcggtagtatgttattaaacataataattaacatcgcttgatgagttaattataagtgatacgttaaaatttcattcatactcttctaaattaaattaaaatatatattttttgaacaacaaatcctaaatcctaaaccaagacatatatacccttgtaactttagctagcaccatcatctttatcattttggaatgcaacacgaagctaaaaatttactacaactaattgcttttccttatcacattttctgacgtttattgtgattttatatatttttacataagagaaataatttctacaaaaaatgttcgataaaatatgaagagaacgtgtattaataatttctacataagaaagaaagaaatatattatataaatagcattaccattgttgaaacttgaaagtgggtccatcgtttacaactaaagaaagacaccctagcgtaaagtatttaaccatgacatctacttcaattaacttgaagatgtagttccatctcaacggatttccgtctcaaatataattcttaataacttgctaataaccattggaatctgcagaatatctcgtttagttgggcacaatcctcaaaagcgatgtatttttttaatgaaaacaatgcatgccacaagaacgtttatatatacataattttactaaacaaatcgtatcgtaatacaaaactttattattattataacgtgatttgtcactttttgcttcagaaaaatacttgtacaaaacattaagacaataacataagttgccaataccatacataaaactctttaatgaatcataatgatgaaaattgagagatatttagttccatgataaagagtgtgtttgtgtgggaatttgaccaaacgcaattggcgttccagcgaaaacttttctcgtgtttggcgttttgtgcctcggaaagctaattttctccatttaaggtggtttggacggattttcaaacacactcacagcgagtccgtttcagtagaagtccttccagcagccccccttcccccaaagaaaaattttaagaacaaaaagagaaagaaaaaaaagaaaaaggaaaaacaagtcacatattttattcttatgtcagccaaaaacttgactacctgtagatggggcaataataactagctatttatcacatttcctagctaattgcctattttgttatggaccacactcccacttgcacccatcttcaacaatttaaattaggtaataaacattaagatatcctttaaaatctactcaacaaacagaagaattcaaatctgcaggaaaggtagacccatgtttaatactagctttctctatctctctcccactgggacattaatgttcctatatttcaaaaaaaaaataaaaaatatatatatgatgagcaatgcagccaaaggtgcatcatcttttacgtcacacgaaagcctgtcctacctcttcaagctgcacaagcctttctctttcccagaatgattttttccttttcttgttattattactccttttggactttctatataatactttctatatatgttcccaataataccacattactcatgtgcctggaaaagaagcagcagtgagcacctagcaatagtgctctcaccttctctcaatcatttttcatttgtcaacttttatagacctcgatttgtgtatgcaaatttctttaggacatgtggcctacattagtggctaataagatattcaagaagagacttggaagcagcaattttatagcagattttcctagttataaagaacccttgctgggcatagtagacattgatcagaactcaaaacccattcttaatgatcacaaggacacacaaaaatacaagtaagaacacaaatatcctcttctagctagtacttttctatcttatgtatcatcatatatagaaaagttgtagatggctgaagtatatgcctgatcatttatcaagttcaattctattctgggttggttctgctttctatggttttgttcttctctctatttttttttctttcaatttttctgatattgttttttacttcatgtaagggtatttgttagtacatggaacgtaggtgggattgcaccggatgaagatttgaatatagatgatttgtttgagacatgcaacaactcttgtgacatctatatactagggtattgtcagaactgcttcaggttttctagcatatatagaaaaacacgtttttaaatgtgtataaagaaactgaatctttgatctgacaataatatttttattactgttttccaatccaggtttcaagaaatagtgcctctaaaagcatcaaatgtattgggatccgaaaacaatgagatttctatgaaatggaattccaaaatcagggaagccctgaacaagaaaacacatcaaaggggcaaagatgctaaaaaacaggagctaaagaacaattttcccaataagaaagaaaatccagctaagtgctgtgaagccccacatgatttccaatgtatcattagcaagcaaatggttggattattcatatctgtgtggattagaagagatctttgtccattcattcggcatccaagcgtgtcatgtgtaggctgtggcataatgggctgcttaggaaacaaggtgacccaacaaaccccactcaattgatgttacttttgcacctgatcgaatatacgtatttgttttgtcctatgcactcatacaaatcattactgtcaacatcaattttctataaagcacctaaggcactcttggtaaagagccatgttaagtaaaagtttatcacataagagtttattcataagcttcatgaagcttatcaaaataagctttaaaattattttgttatagaaaatttagaaatgaactgaaaatccttatagaaaagtcataaacaactattaaaagttcaaataaattatgtataaactcttccatatgtcttaattagtgcttattaatagtcaatagtctaaagctgatcgcatcagaattggctatctaaaaatcctaattggggttttttttttttttcctttctgttttacaactccaattaatttgcagggttctgtatcagtgagatttcagttacatgaaacaagcttctgctttgtgtgcagccatctagcttcagggggcagagaatgtgatgaaaagtacaggaactctaatgttgctgaaattttttctcggacaagttttcctagaggccctttgcttaatttgcctagaaccattattgatcatgagtaagtgaagtttgaaaccgtccaaactgattctcaataatttttgcccccttgctttttgtttaataattatggtccttttccaaaaaaatcatgtaaacaaggtgcaaatattaaatacatttatgtttcgtttggtttgttggttcttgaaataaataatttgcttaatgaaatgaagatgcagcattaatgatcatctccggttttgaatttgtcccatagaaatcatgccaccaaaacattaatatattattcttcggtggtttaacattttaaactgaactgcacctacaaagttaattaactttgataatttatgaagaaattgttctgatacatatagtggttccgtgagtaaacaaaagttgtcaaaaaagacaaacagaacagaaaacagtagagagatatatttgcactggtaaccgtaaatgctccctccatttcttttcatctgttcatttaggaaaaaaattatttctatttatctaatcaattaaaaatttaattatcataatatgaattactggcttttcaattatatctttatctatatttaatttttgaatactttacatacacacttatcataaatgagagaaatttttattttttttaatcaaaggagattgtacaagaaagttaaaattaattttaatgtaaataaagatattattacattcatcctctggagttgaattttttttttcttttttaaaaaaagaatattcaaatgacagtaacaattaaactcatattgaccactgaaccatcaaattaataaaatatactatctcccaacttcatataattggttgtactttgaatgatatacatgtattattttagacacctaatcactgctggtcttgtgcagtcatgtaatattgcttggagatctaaattacaggatttctctaccagaagaaacgacacgcttgcttgttgaaaaaagagactgggattccttattagaaaatgatcaggtatgtatgatcaagatttaaaaatcttgttgaattgaatcctttaaaaaaataatctttgaatttgtttgcatcatatttatctcttagaatctaactaaattatattcaatgaaaacgaagctaagaatggagctaatgactggaaacatgttaagaggatggaatgaaggagcaattaaatttgcacctacctacaaatattgtccaaattcagacatttactatggatgttgctatcatggcaaaaaggcagaaaagagaagagcaccagcatggtaagagacaatataaaatccataattagatatggtcacgttcaaaacatttacattttactgttgaatacttattattaaattcttgttggttcttaatttaggtgtgatcgaatagtatggtatggtgagggtctaaagcaacttcagtacactagaattgaatcaaaactatcagatcataggccagttaaggcaatgtttatggcagaagtcatggttttaccagagctgatgaaaaacttgcaaagcttgttcctatcagaaagatacgagcaaattaaaactccccttgaagtttccaccactgatgattttgtaaatagaaaacgatcaagcttccggttgtgaataatttgtgtgattcaagctaggctttaaattgcgattgtgatcaatgttgcaattttatcacaatcttttgtattggagaaaaattgcataaaaatgtggcctttgcgatctctaattacaattagagactccaacaaccgtgacattgccatcaatattgtggttgcacgtgttttctaaaaaaattgtgtgatatatgtaaataaatgttcaattttacattcggaaaaaagaaaaaagagctagaagttcagaggaaggaaattgagaaacttctaggagatgagatgagatattatatgtttttgttgctgatgagtatacagtgaagttggttgtttttgaattattatcaagtatatatgtaatgtgacagaacatggaaatatgtcaaaacctattggaaaaaaaaaaactataatccaaattaataaatgaaacatttttgtagattgctacttgagaatcaattaaattatagaacaactacgcatccaaaatggcaaaataaattatatggcaattattgagctagttaaggtcctcaatattgttatctttgacaggaagtgggaacatcacctcttatcctgtgtgcatgaaagagcattgttagataatttttttattgatatgcgtagaagatatcattttataaatgcaactagggagaataaatgagctaagtggtgtttttctgaccaatggtatattaattgaggcgtgcacttgctgagggaaaacaaaaagagttgtgtaataagacttcatctgaaagggatcttgaatcgtgtcctcactagtccttgagatgctcgtctagagggtatgctatacagagccatcttcatgaagcacttgaaatttatagtggttgtcctgtttcactttatatttcacttgaagttaaattgcacggatggaggttacaaaatcaaatttggtaggaccccagtacagaatcacttatgctaacaatttttaattgatctcatattattttaaaatttattcccttaaaaattatgtattgataataagacttcttcatttgattctttcaacaacaaaaaaagacttcttcatttgataaataatattatatatacttttttatcgatatcatttgattttaacttatatatttttttatacatatttgaaatatattttataagatatactttaattttagttttatttttctttaatttaataatttaactactcaaaatgctgttaaaattgatattttatatttccaaattaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtggtttcttgtttctgcaatgtgcttcatcaaatatgaaaatatcaaacatttgggagagtctgatattactgtataaaattatatgaattattaattaaaataatcactttttattagttttttaataatacaaaattgacaaataagctattattttctcttaaaataaaccaattcaagtcatacccgtatatatacaatttggaacattgctatttgtttctctattttttgttccgggaattctgtacctacacacctgactttgcaccaatagaaattatttatgggatttatctttacttttagaaaaaaccaattggataaattataagtgatgattagatatgtacaagttgatttcttattttcggatgttcaagttggtcaactggaggaaaatattttcttaggcagggatttcaatgaatgttttttttatcagaaaataacttgtatttttttttttgaaaaggcaaaatatactaaaacgatcaaaactggtacaaggagtaccagattaactgaaagtcatacaaaagtatttataattacgtcacaagctctctaacttcccaagtatatggcactaataattaacattaacgagtgaagctatgccaaaagataatcccgctcaaaatctaacacctgcagcatccccacaaaattagaaatacattacaattgctgcactatataaatattaatgacagatttccaacccaacaatgccacttaacgttgatcaatacacgagatgggattagaaatccacgaattcaacgagtaaacaaaccctcttttgcggatccttagccatttccatgctagatactgtgcatgagcagataacttgtatattaataatatggtcaaggggatttcaatgaatgttagtagagatagggcaattttgttggtgtttcgaagacataaactaggacaggctattttttattatttctttgtagcttatgatgttaaaattatgaaaacttgtttaaaaaataccttatcacttataggactgaaagttcaagattgcaaattactttctttatgataaaaaaaatgctgataaaggggtttgtaagtgtaaggattgcaaggtgattctgcaaaagtttttttatccttgatgttctcttagaaaggcataaacaaaaaaatccagcaagttaccaatctaaggatcaggtggtggtaacttaagggagataaacttcttacttttaagtggaaatttttgaaggaaagtaattggaaaataatttaaaacaggaggttgctaaagataaggaaggttgctaaataaattttgggtgaatcaagaagataagaaatttttgtggtggaatgaaaatgttcaagaaataaaaagaatgctttagaatctttaatgtggtcaataatgctgaaaattgagtaaggtgttgaaatgataggaatgagataagaatagttgtgagtgaaacacaatctaaagcttataagaagttttacaaatatcttggaacaaagaatgaataatgtaagatatataagatcacaaaaaaaaaaaagaagaaaaaatgagagatttggatcaaagtgtattaaggatgaataagggattttttttattatcataaatcaccatttagagaagagatgggagaatattatttcataagcttttcaattaacgacaagatcgactccatgtatggaatgactagaaatccaaaaaagattaacaaattaagtttgtcttattaccgtagaattcatgaaaattaatttgattttatttggagatggtttatgttgtgttgaacaattaggcaggttgattaggtggattcaaccctttttatcatttttatttttgacaataaagtaaatactgaagtcaaaggtaagttttatggtatgatacacgactgactatattttatgatagtgaatattggatttgaatgggataaaaagaaaaatctaggaaaaatattaaaaaatgttaattcacttctttttaacatagaggagttgctaccagcataccacaccaccttgcacatccataccaaacacgggtagatactctacactcaaaacacaagtgtgaaactaattcatcgtgctttttacacaagctaggggcataacaaatcacccccccgacatccttaatgagacaactttgttgggttgatagtgaaaataacttgttgtatttaatgcataacgcgtcgatttgctcccaactaaacatctttccaaaagaccacatcatttcctttcccaagcacacaccccatgttgatccagaaccaatcctcttgagagtctgtatgacaagttgatgcaacattcatccaccagcttgatgttatagggtgcttcaattaatagatcttcttcattagcagctctagcttttataaccagcacccaaagggagtccttctctctaacaaatcgccacatcaaagatttattgaaacttcccatattcctcaaccccagctcaccactaccctttggaagacagacctactgtcatttaaacccaacatatattttagcttcctagactcctcgcatgaatacatgctagcatatggactatacaataattcctcctaattaagactccttatatatctctatctctcttttttctcttatcacatctatcattattattattattaattataacaagaatcaaattatattagaaaaacaacctaaactatatagaattaatttaacaaatttatcaaccctaacttggaggattttatttacacagaaaaaaataaaacaagaaagaagaagggggtaaaaatcatatgattgcttaaacacacacacactcccttcaagtcccaagagctcttggcttacaaaacactctagaaaactttctttaatagttacaactaaaaaatatgccaaaagtttgtaaaaagtcttatgctttccattgttggaggtgcatgcattttgactttacatcatttgttcatatttctccttcagactatgttgcatcttttgaccaagttgcttcatttgtgtgggtgatcgagcataattatatcgatgtctctttaaagtactagtacacaatttataaattactttggacttgacttctcatgcatattattgcttaataccatggattgtctgatcttcaaaaacccaccaaaatatggataaatttcctacaccttaatactttcaattaaccatgagagacttttttatttatttatccaaaccacatttcatttaatactctccttttaaagatcttggaagataaattgattaaataaattgtaatcactctcattgtcattaattataagatacaattaactaatttatgcttattaagaaaaatagataatttaattatcaccattaatttttttataattataatattttttaaaatttattcttaactttattaaaaaattagttcatcttgtctaatctccataagagagaaaaaaattaaaatattatagtaaaaaataagtaatacacaagagagataaaatatagttttataataaaaagattaaaacgttattgattaaaatattaattctaatgtatatatattatgccacgagttctacaataatcaaatggtactttatattttccaaattcgtataaaagcatttcagtttcaatcatatgatcactctacatagacatgaaactcctagaaaaattgaaaaatttgatgtttcatcttatgggtacgtacatacacccacatcttcctacaatgattatcaatgaagctaaccaaatattgagcaccaaaaagtaacctttcagactccaagatttagtttcatctttttccatcttgaattacattgaacaataactccccttataaccatatcagtaataccattgttaaggaaaataaggggttaaaatattgaggacatctctattttttttatgacttttgaggacatctctataataaaaactacgagtaaagtatacgaataaacttattattatattcaacttaaaatctaaagacattaggtatttttttctcttacttatatattaattttcttattcatatctaatgagtgactacctcacactaactgaaaaccaaacagagcataagatgtatacgttatattcttcaaaaaaaatgtatatgttattaggtatatcccacaactgctagtaacttttgtgctcgtttatttttaattggattaattatactttaatttatgtataactttggttcttttaattataattgtttatatatttagcctgtacagattctcaactattcaaactaatttccttccgcctaaagtttcatttaataattaacagaatataatggggatacgagatatatacttgcaaagtaaaaanaatgtatatgttattaggtatatcccacaactgctagtaacttgtgtgctcgtttatttttaattggattaattatactttaatttatgtataattttggttcttttaattataattgtttatatatttagcctatacagattctcaactattcaaactaatttccttccgcctaaagtttcatttaataattaacagaatataatggggatacgagatatatacttgcaaagtaaaaataataatttaaataaaaatgaaaatacctttaattacattttattatttccatccaaagaatatagaacaacaaatgtacgagtaatatcctgctaaaaggaaaagaaaccttgaaaagcacatccacaagtgtctttaaaggtttgtccaaaggtgagactaccagggacttggtgcaactttttaaaagataaattaaaaacaaagaagaatttggaatggtgcatgatgatgatgatggagcttgaggcacacttccttctcatagcaaccaaaggagaagccctcatgatgccccacaaaaataaaccaaaacaattcttaaatatcaaaagatatatatatgtaaccatatatagaaatatgatttcatgataagaatgaaagaaattagagtttgttcaagacatccttcatcaagctagggttggcagtatgaaattcaatcaactcattcagtgtaatgtatccatcaccgtctttatcaatctctgccattcgacgctcaacttcctcctgtgaagttaagcctagcactttgagagcatctgcaaactcagacaaggagatattgccatcgccattcacatcaaagcgcttgaaaacgcgttcacactcttccctttcactacccataacttttttcacgagaggaattgaatgtcatgtactgaattaatattgaaatgagtgagatatttatttaagaagtaaaaaaacaaaaaacaaaaacaaaggtgcctctagctagagactcggtcttgatgctatatgatcggacaacctttggagttttaccacatgcaagctcattcgctggaatttgtataaccatattgatttcttgtctagctccaacttttctttcgggtttctatgacaaactattgctcgagattcatggactttctttagcatacttcataattaaccaattttagttttgtatgatttttttttattttttttttgtgactggtactttgtacatatatgaacacatacaaatttggaatattaattcttttgtgtgttagcaacctatatatgtgtatatatatatatatatatatatatacatatatatgcaccttgggaggctaaggccagtttttagaattttgaaggatatatgtacagatctagatcactaattcataatggagtagcttgaaattgaatagattgattggatatgatatagctctattgaagaaaatgagaaaaccattagttaagagagaaaatgaagaaaattaagtgacaagaaaagccaaagaaaagaaagtgaaaagaggtctacttagaatattaattaggaaaaataattttttatatccttcgggtgtatgtggcaattaagagatggaaactaatattttaaaaaatcttgaattgagattgaaacaatattaattaaataatacataaaataatagtgttaaaggaacataagaccataactttaaaatactaaaaactaaaacacaatttcataggttcttaacatttaaagtatataaaaaattcaaatcaaatatattacaataattacaagttaaagtttcaacaatacacaaaaacatttattaataataataagtttacattcagaataaaaaagaaatgaaaaataatttaggtggattttcattttttttaaaaaaatcataataattttgtattaaacaattttcgttgacctgctatagacttttttttttcgattttcatcagtttctcaattttgacatttttttttcgaccgatttttcttcaagtcgttttgtggtttatttgaatcgaccatctaattgattcacccatttttcagttcgaccaactgatttgattcgattttaaaaacttgcataaaagccataaataataaattaagaaaagaagttagaaatacagataaagataaaataaataaaaatgtgaaaaaatgctaatagtgtaagacttgtgttaattaggtcttattttttacttttatcttaggggattaaaattgttattttattgttaattatctccatttataaaactagttaaatataattttgttccttcaaatatagattcatattagttttagttgtccaaaaattattttattgcatttggtccttgaaattttcaaagttttttattttaaatttttcggttaaaagtttgtaacaataattgcttcaacatcaacaatttcatttctaacaataacattcagtatgccctgcaaaaatagaaaaaaaaaaaagaagaaaaaacatcttatggctctagttttctcaaacaaggagcatatacagttaaactcatattatctatgatgttggtagaactgattctaggaagtaggaacaaatatcaaaaggtgcattgacagcaaaaggttgaatctcagtaatattgtctatgaaggtaacttacatttaataaaaaaaaatatcaactaaattaaatactgggtttaaaagaaaatttaaaaaactttaattttaagaaataaatacaaaaaaatatttttaaattatttttaatatatttttagaagtctaaaatcaatattgataaatatttggaagagcaaaattatattttattttattttctcattgctgataagatgttcaagtttagagaagagaaaaataagaaaatatgttgttgaaaaaataaaaataaaagtactgaggcatgaacacacataccacgtttcaatggttcaacttgctatagtacttgctgtggaggcagcagaacagggaagtgagaccggtggggtagcgttgaacgagtaatggttgagtgtgatgaaaacgatgacgaagcaacaatgtcaatgtcaatgtccatggaccctcgcgcgaggcacgcacgagccataacatcacacgccaaagaccgcgcagtgtggaacaacctcataacccactactccaaatccaacctctcatcctgcgctgtctccctgtttcacagactcccttttcctcccaacgttgtctcatggaccgcattaatctccgcgcactccaacacccccctctccctccgccacttcctcgccatgctccgccacaacactcttcccaaccaccgtaccgttgcctccctcttcaccacctgcgccgccctcactgccgtctcttttgccctctccctccactccctcgccctcaaactcgccctcgcccgccaccccttccccgcctcctccctcctctccgtctacgccaagctctgcatgcccctcaatgcacgcaaggtgttcgacgaaattccccaaccagacaacgtttgtttctccgccttggtagttgcactcgcccagaattcccgctccctcgacgctttgtcggtcttttccgacatgaggtgtcgcggttttgcgtcaactgttcacggtgtttctggtggtttgcgtgctgcggctcagctcgctgcgttggagcaatgtagaatgatgcatgcacatgcaattattgctgggttggattcaaatgtggtggtgggtagtgctgtcgttgatgggtatggtaaagcgggtgttgttgacgatgcaagaagggtttttgaggatagtttggatgatatgaatattgtggggtggaatgcaatgatggctggttatgcacagcagggggattatcaatctgcttttaaactgtttgagtctttggaaggttgtggacttgtgcctgatgagtatacttttttggcgatattgactgctttgtgtaatgctggaatgtttctggagatttatcggtggtttacgaggatgagagtggattatggtttggaaccgagtttggagcattatacgtgtttggtgggtgcaatggcacgtgctggagaattggagcgtgcggagagggttgtgttgacaatgccgtttgaaccagatgctgcagtttggcgagctttgctatcagtttgtgcgtatcgtggtgaggctgacaaggcttggtgtatggcgaagagggtgttggagctggagccaaatgatgattatgcttatgttagtgttgctaatgtgttatcaagtgcagggaggtgggatgatgttgcggtattgaggaagatgatgaaggataggagggtgaagaaaaaaggtgggaggagttggattgaagtgcagggagaagttcatgtttttgtggcgggggattggaagcacgagaggtccaaggaaatttatcagaagttggcagagcttatgggggatattgaaaaattagggtacgttcctgtttgggatgaggtgttgcataatgttggggaggaaaagagaaaggagtctctttggtatcacagtgagaagttagctgttgcgtttggagtgttgtgtggatctgcaccaccagggaagccgttaaggattgtgaagaatttgaggatttgtaaggattgccacgaggcttttaagtatatgacaagagttttagaaagggaaataattgtgagggatgtcaacagatatcacagatttgtgaatggtaactgtacttgtagagacatatggtagcatatacatgtttgaggcttgtttctaattataagtgatgctgagaaagaaaactgatttttccccattacggtaagtctttttcttactggactttctgtattttgctttcatgtttttgtttccattttgacttcttttgagttagatcaagtttaagatatttcattgcaacctttctagtgaattcagataggtgaacctttactctgaaaattttagtatccaaatttctcttacaaacaaggagatatatttggaaattgtgttattcccacagttagtttgttgttttcttatggttattgcatgagatgcagatgcagttaagatggctgagtgggcggaactccacttaatccacttgacatttgatgtttgaataacattctgaaactgtcgaggtgtctaggtgagtacactttgtgtctattgtatctgaaagattgcttgtgagacatgctatttaaatcccgagcttgttctttttcttgactgaacaatatattaaatagggccaacgattgctatacatagttaaagtcctacctatggaaaacaattatgcaaaaccacaaatgcaaaatttgttatagcttgtctcaatgtactcccattgaaaagttcaattgccaaagttgatggaaaatgagggatgtgaggagccaggaggtaggcatacaaaaaaaaaaacgccgcatctagttatctgtttaaacaggcaaggaaaatttatagtttctttatattgttttcattctttgactttgaagccacttaaattcatgaattgctaaattctatcgggtgaattgatgcttcaatctcaataatcattggtaaattaatgcattgtcattttatcagtgtaccatatttggttttttgggtggtcctaagtaagtagtattgttaaaatataatgaattttttgtagaagtagaaacgtaggattaattgggtcagggttttgcatccatcgatatatttccaccttcatttaggctgaaggaacctatttgtacactgtacagtcacaatgtaaataccgtccaagtgagttttgcatccaacactttgagtcgttacaacaacctaaataaggagccatttttaaggaagctagttaaggaacatggtttggtaggatttaacaaataaaatgtcctcgatgtttaacttcgcccaaaagactcttgagtccaaagtggaaaagtagatccagttagaggtcaagttaataggactcagatgtaagcagattactattctaaaagaaatgcttgtaacacactttttattattacaaacaattgtaggtcacatttcttatttaacgagttttactcataattttatagatttctgtaaattctaatcaataataaagagtgtattgtcaacactttttactctataatttaattatggatagagttgagtttgcgtttaggaagtatatctgtatcctaagcccacccaactccgccatttacattttgggggaaaacttacctgaccttaggacaaattaagtatttcctgtcaagtttggggtcggttggggccagtgccctttacccacagctttgtcagtttataatttgaataagcaaaatttcaatgtgttcttgttaagctttattctataagaaaccaaacacactctaagtctaaggttgagtgccatttaagccattacaattcacaaataattcaatgccatagtagcgtcaatcaacatgtttttaggtaaatcaggatgaatatatatgactgaaaatggagaaaaatcaaaagcaccccgtattttcaattttattaaatatttaaaacttcgtcttactttttttccttgtttccagttttaatcacttgaaagactgcatgaattcatgcatcaaatacagagagattggggagaacgaagtggagaaagatcgcatgtttttggaatcagtgaggaaatgcttatagaggaagaaggttgaggctgccattgtcaaaacacgccctcataacacttttaacagctgaagaagtgaagatttcaacaccactagctgcctttggggaacgtattattcattcattggaaaattcgacagcttatacaaaattcaaaaatcaattcatacttagcataaataattaattgtgttggcttcaaagggtaaagttattgaaagatacaatatatatgattgatattctgtcatagatgttactgcagattactaccataaaatttccaaaagggacaattgcaatgaactctgttgaggttagcggtaaatacacctaaaccctacttgctaaaatattatacatatctttctcatcttatatattgttcatatccgttatttaaaaaaaaaaaaaaaaaaaaaaaaaaaaaaaaaannnnnnnnnnnnnnnnnnnnnnnnnnnnnnnnnnnnnnnnnnnnnnnntggaatcagttcaaacgatcaagttactttggcagtatcggttatataaccaactagcattgaaatccatgctctgcacgaattctaaagaaaaaaaaagtcaaaaaaaaaaataattgagtaattgaataaaaaaattgtccaatcaatacatgatggtggtttgacagttttaataatattattgattatataactaattatgttatatctaaaaccaattatataatcggttgttggataaataattggttatttaaccagttttaagaaacaaataaatttaaaagcagattttattttatatattttctaatggagtagtttagtcattggttaagttgaaaaaaagacctttctaaaatggttctagcaaaatttcaactatatcattaacttagctatttgttttctttaattagaatcaaaatattttgaattgcattttattgcttacaggttagagtcatggttggaacaatgaccattatgccacgtttttttaaaatattttccagaatgtcacgtccaggaaacaatttcctacaatgccacgtgggttagttcgttgggcttgtcaacgaatttggtatgctgacgtggtgggtgttaatggacacataattcgctattcatagctgccttggaattttcggtcaagccacgtgtcagcccatgcatatttggttatgagtgatagcaaaataggtgtgggtatttcgctttaagtgctagcgaaataggtgtgattatttccccattataaagagaaaataaaaagattagaggaaaaaaaaagaaaaaaatgaaaaaaggaatttaagtaatttgagtaatttgaaaaggcaattaacaatatatatttttattatttgagtaatttaaaaataatttaaattttgtagtttaatataatttaattaattttaaaaatagataaaagtagtttaactttattatttaaaaatgcaaaggatactttttgaatatgatttaatattttttgtaaatattttaaattatttgattaagtattttagtaatttatactataattactttgaattacatttaatattttaattaattttataaatttttgaagtaatgttaaaatttaaattttgatagattgattgttggatgaaaatattttggtaacaattttaacttgtaaagcataacataacatatatttattttgattttgataattaaatatattgattttgttgatgaatttttacaaatataattatttttacttttgttaacacaatgtgataattatttggggtatattttaaaaatattactatttaaaatttaagatttaaaataaaagattgaactaaacttaataaaaaggggtgtaattagccattttcaatttttatggataaacttattaaatactggggtgtatttagcagtgtacaccacttcaaagccttcaggttactcaagactttaatgtcatggaggggtgcagatagcaaatgagggtgcagatagcgaaaaattaaaacaaaacgaaaagtcgtatataagttacaactttaaagtcatatatatatttatgactttaaagaaaaaataaaaaatataaattaataattaaaattatatatttattaaaatatttaactatccaatttattaattttcaaacaatctaaaatttaaattttatttttcaaattaaacttacatgttattaaaaaagtatatataaatttatttgtcttttcaaattactcaaataataaaaaatattaaattaataagaaatttttttaaattatctttttaaattatattaaattaaataaataattacttcaaatattatatatatatatatatatatataattaaacacgtttaaaattatgttcttttaatttaaagtcattataaatatttaaataaattggtatgtttcatattataatttaaagtcattataattattttatcatcctctaacctaatgttttacatcatcctttaacctaatattttaaataataaattttgaacaattaaaatacaaagagcagaaaaataataaaagtaaaaactaataggctcttgggaggaagtggaataatattgaaggaggaaagtgagagtgagagtaaaattgagggagaaagtgatagtgaaagtgaggtagggttaaaggaggggggaggagtttatataggggtgggccaactggacctaattcgctggatccgcctgtgaattacctagttcgctactactccttgcgtgatatgccactatgatgaccgctctgcccctccaatacatgaatgccacgttgcgctgcctattttgctcagggtcccagcgaactaactcacgtggcattgtgggaaattgattcctggcgtggcattttgggaaatattttcaaaaaatgtggcatattagccactgttccatcatggttagggactaattaattaattataaggaaaggaaaaaagtgctttaagtgaagattaacaaaaaaaaaagggagggaaaggcacaaggggggaataattgtgattcttctttatattcttatgcattagaaacaaaataagatatggtaataacgttactattttgccgattccaatcaaaatatcctcatctcaaataaattactcatccgacattgagctgaaagtatatgcatgcttatttctaatcataagcatctgctatccagaatgatatataaaattttatagtaatatagatgatattaattgggctatatcagccaaattctcaatatatatctagagcaagctaggtccttttgatagcatctctaaaaattatatctgatttcttctcaccttaatcagactatcttccctcatatccatcttttgcaataggtttctactttctattactcttctcctcaatacatggactaaacaagagtttattgtatctttttttaataaaaaaaagataatgtagcaattgtctataaataacttttccaattgtctttgatcttacttgcaaatgagataatatactgatttaaaaaaatactatatactattatattatatagtagctggcaattaatatgtctttatggtattatttggatcatgtgcatttataaatgacaattcattagtatatgtatgcattgacgcagctctgacattagccgagttattgtgatcttgaggtacgtcatcattggctcattgctttgctagttgtattttaagcttttccggttcaatatttttttgaaaaaaattctaataagtttatggttggtgaatgaacttaatatgtatgaatttcaatagttatatcatttttaactttttatcacatgtattataagacaattaatgaagtcacaaataactatactacccgttcaaataaaaggtatatgatgtaaggctgatatatttcagataaaatataattaatagaaattctaaatatatatgatgatttgatgaaaaccacgatttgtttcttttgattaaaaaaaaacttttcgtaacatttataatttctctaaagataaatgccaccttctttccaaaggaatgcccctttttcttttggaaaatgttactagatggtacgaaaaattcttgcacaaatagcttgataaaaagtgtattagcagttctgttttctttctattattgtccttaattgttattttcagttgattttaaatactttgttagtgattttgagaatttattaaaatgtaaaagaagtttcgaacattcttgttatgcacttgaggttttcatccagaattttatttagtttttaaaattttaaactcgaaagcaatttgtaaaattgtaaaaagaaacaaaagacttattcataatacttttacattatcattccatcgcaaatcacaatgtatacaagttttttgaagtgcgtagctttttctctcaaattataatatgtattaattaaaaaaaacattacagtataaaaactttcaagtgcagagtaatttaatcttttatgagaactactacaaacaggacatccgtacgttcagatattaattaatagaatgacgtgagttgggcactaaggtttgctggccatattgcaatctgatatcaaaagtaaaaaagaaaacatgctacgcgtcaaaaaaatggaagagatcttactgaccaaatctcataaaataattcgttgaagcataatatagatttcattattttacgataactaaaacaaaaattattcatgttacataatatatatgaacatgaacatgtttaatttcataacatggattgaaaacgaagtttataaatggattgaaatgagtgtgttattttggagttgcggccagtgattccaattttccttctatagtcagttttccaattgtatttgtttttatccagacgaataagtttataagtattttcacttttaaatatttatttggataaacttttctaaaaatagttataggagaaggaaaaaaaataagtcttttataaattaaaatgagttatttattaactttattagttaatcattaattaatttataaatgtattttattttttaaagaaattatataaatattttttacaaattaattaataaaaatttattttaatttataaaaaaatatatttaaatttttttattatacttaaagaaacttatctaaatatgcatcttcttattgactcaaactttagatagcaaaatatggtaactcgcataccatcataatgtagaataaaagatcttttttaatatagtgagtaaaatatcggttacataagtacatatccacatcaacttttactatagaaattaaggtccagtattagagtttctgattgataaactatatacaacaacctactgacataattaaaggatgctgacccatcagatagttaattttaatcttttaccaagtcaaaacttttaaccctcattttctccaagtgtgacttcccattaagattgcgtgagaaaaagtctttgaagtaatcttccatcaacatgcttttgaacaagggtgggttctcagaatttaacaaacttttcacgggcccaatctctgcctcaaatttggggttgaagaacatagcaatagaaattctctccttctctttgttcactgcagccctatgctctatgctggtataggccccattactaagaatctgcaagatcaccgacagcatgagttatggatgaggaaatatatagtgagatactatcatttataaataagccatgattatcaactacctttccattaattaggtgttaatgcatgctgtttcagtttcaggccttgatatagaaatgtgaatacctagtacgttttgtcagtgtttatgacttgtctcatgttgttcttaatgtaaatacaataaaaataaagatggacaaaaataacaagaaataaaataaaaggagttttctttttagtttcacatataaaaagtttctctcctaaagtagagaaaatgttcattgtatttttttgttttactttttcttaaattaaatattttttgtaatgtaagaaataataaataatttcatgttaagaaaagaataatatggtacaaattttatttttttagttaatttaatttttaaattagtataaaaggctttttatacaatttatttatgtttcacttactcttctacatctacctctaaagcaacataatttctttatttctttatttttcatgtctatttatccaaacaaaacatcttttattattttatttttcttttacttctatcagtttttctcttttttcttttctctctatttcacttctaattcaaatacacataaatctaaacttaaaaaaaataatttcattaaacaaattaaggtaaaattttttgatcgataacatatttaaataaaaaagatcacactttagactatttaaaaatattttaaatatgatagagttataagtttatattcattatttctgtctttgagctcaagaaactgtttaaagataagtttgtcaatctattttaaagattttattaaaaataaactttaaattaagcaaaaaattattagttttgaaaaaaaaaacttaaactaaataaaaaaaattaaactcgttttaaattacaaaataaatataaaaatataagctgttttcatttatttgcatcatccatgatcttgacgtgacgatgttaaaaattttgctttatccatttaaagcataaaaaggtttgtacagtaaccggattaatttattggacatagtttaagttagatgcacaaaactagacttatgatatatatgacattctagggctaagttcaatagaccacgtgctgaattaatattagaaaaattgaatgaaaaaggagagaaaagcatgacacacctccatgatgtccccaacgttaattacaaaagcatctggaagaaaggtcacaggaatccaaaccccacctttctttatctcaagaccatccacaccattgacctggtgaaggatggttatgcctgtggcatcagagtgcggggtgagccctacaacaagctctggctttggacatggtggatagtatgtcattctcactgactgcatgccatcatcaaaaaactcctccacttccttcatctccatgcttatggcttttcctaataaccccagaagtgctatacctagtttcctcaattctctgaagtatgactccaaggtatcccttcacaaatatatatacatatctcataaggtatatatatacataaatatctgattacttttggtgttagttttccaatcagaattgatatttaatgtaaatcttataattattaattatacatacataagcatacaaattattatacatatctcataattaaggtatatagatatatacatacatatctggctactttcatactgttctccaatcagaattcatatttcatcttaataatttacattgatattgaatgtaaatttttattacgtacttgaattatcaaagtaaaactctgaattctaattagaaaacaacattaaaaataaataaggaattgcatataatttttctctttatttattgagggtttaatagaaaataaggaaattaagagagagaaattaatgaaagtatatacttcaatgatgcagggagctcagggagaagatgtggctttcttctttcaagggggttgatcaccatgtagaatctgtccccccagtcaagcttttgatctttacatcttatcacagttccatagccttgaacatctcctggtcttatttggtacttctttttctcttcaatgggaagcttgaagaacttctcaatctcaagtttcagcgtctccagcagttgagagctaacaccatggttcaccacctgcataaacaaaacagtagtcttctcatataagactaaaacacaaattattcagtagttaacaattaacagcaatgactaattaagtaattatattaattaattaatgcaaatggaaaagttatcactaattctatatttgaaattaaggatataatatatatatatatatatatatatatatatatatagtttgtgaatttaaaatctttgaatttcaagatcatttcgttatttacagacatagggtacaaacctgaaagaaaccccaatctttgcatgctgtgaacaacttgtcaagttcagcatcatctatagcattttcatgtagcaaggctttgaagtcaaaaacgggaatggttggcaaagtggtttcatttgatcgaattgtaggttcttgtgggcaaatatacatttctggtattcccatttctggtttcttgggtatgtccatcacgccaagaacacaaccagagctcccaaagacacgaacctgctgtgatgaagccattggtaaattaaattaaggtacaatgacaacgaacggtgtgattggtatttatgcagcaagaaaatgccgtattcagtttggactcgttcttggaggttaaaaaagttattaaaatgtggatatatttgactatgacgacttaaataattaatttttacggccatgatggctatttatttgccgcagtggaagaacttgtttcaaatgtgcatatgtgttacgattgcaactaatatatatccaacactgtaggttatgtatttgtcataattaatgtatttcgataaaatttagttgaaggatcaactgtcttttattttatttttatccatcacattgatttagagtatttattaattttactaataattattctatcaaaaaatttaactgatcattttttgttaaatttcttttctcaatcatatttttataacaaaatttaaatccaaaattttatttaagaaaaattggttcaattaataccacttgaattaattacttatggggttgatcaaatatcttttaatgatgtgattgcaagtcgttaaattgacaacacctacttggcagcgatcatttaaattaaatttggaattgcacttctagatgttatgtttcaggaaattaagtcctatgagaattcaattacattgaacatgcatgtgtgtgtatgtgtaagaaatgatcaatcatagatatacttcgtgaaaaaggatgatatttacttttcaacaactcggcttgttatgtagatttgtcatatatagctgaaaactcttttgtttttaaatttctttggagttttcgaaaaaaattccttctagtatttccttgactagctaaataaattgcttggtacaaacacggtttgcattcagactcaataaacaaaagcagaaaattcttgaagtttacccgaagagagcatgcgcaattattatacaatttatataggataaagatggattagttttcccttagctagcttattgcagaatttatagcaattaataaccattaattttcagcaagaaaacacaaattaaagaggtaggtgaaataccataaaaaaagtgaaataccattttagagtgtattggggtgaaaattaagaagggaggaacaaaaagaaaaaaaaataaaaaagaggaaaatatagaagagaaagtgattgtataataggacatgtcctaataagcaaatgaagtataaaagagatatagaaaaaaatgaatatgtatttacaagatttgtggataataattggacatgctttatttaataaaagtatctatataataactgaaagtgaaaagcaactgattttatggggaaaaaaattacgtcttttttaaagctccaaattaattaaaatgtgaaaacaatttttttggggactgattggtttttattttcaaaaactactgttttcattccaaatgcaattaataaaacaaggtttgcttaagcatagttagtgaagagtggtatagtaaggcatgaaataaagagagaaattaaaccagaaggaaaaagaaaatgacaaaaaatctttatttatgttttttttaattaaacaaggtttttgtatattaataatgatacttttttatgataaatgttaagatatatatcaccaaaatttacagtgaggtaaaagttcggtaacattaaaatatcgaattaacataaatatttacggtcggcgccgttccaacaatcatgcatgaaatgaagggcattaggcacatcagtaagttttacgtacaaatggccttggtaagccatgataactaattacctatagtaaaattaaagaaccgatgtccaatttatggaccaataactagtaagatttgacacttttaataatgatcttaagaacagagaattaacaatgaaaaatatttgtggtttataaaaaaacgattattaaagtttgaaaatatcagttaaaaaagggaattgaagaataaaaaatctccattagttccacctcaaccagattgcaagttgttagcatcaaagatttgatagctggatgcatgaagcaaattgaagctcatgcctttcatcaatgaatgctgttttagttgcaattatttgacttgtagccttagtggatacacatgtacatctacaaaacgtaattgtccccaaattaaattgtaggctttctttctaaagacattctttaagaaacttaaaatacaaagtttttttttattggaatgcaaaaaattaagttgataataattatattaatattctcctatagtttttatattaaatgttttcttcttttaatttcttaaataatatcataagagtactgattaacaagattattttccatatatatgatctaactagctatcacctctcaacatggtgttcaccaaatttctcacgacaattgcacccccacaaagtgagtcgctagtggccactaatggtccccaagatcagattgctattctcaatcatgcatctccattaattacttattatttgtttaaaataaatattttaatgaaaaggagcatatgttataataccactagaaaaaaaaattagaacggtatctatgcataagtttcctagtgagtttacaacaaaaaaagagaaaaagttcaacaatgtatttatgtttgtttcttaacatcacattagtatagagtattaattaattttactgataactaatctctaaaaaaaattaacctatcgatcataatttgctggtgggtttagcgttaaatggtcataatttaatgagaaactaaatatgaaaataatactcggtgtcaatttatgaaaaggtcaaaactaagcatgattatctgtgttttcaattatttatgtttagtatacttatttattttaaaatttggaaaacatataaacaaagttagatgtaatacaaaaaatactctatattataacaaattgttacgtatttcgaatttgaatgtacaaaaaaaggtatggtttcaaggttggaacacggactctatatatacaattcataacaatttttatgtaagaaaaaataaataaaaaatgaaaaatggaaaaatgaatgattatgatgggtcaacctatttacccatcattaaaatggtggcttatattatattatattattattattattattatcatccaacaactttttatgcatgctattttagcttgtcttgtatatagtctacgaatcaaatgtaaaacgacgggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcagattgataaaaaaaaatgataaatctaaggaagaaaaaggaaaatagaaatctgaaaaccaaactaagaaaggcaaaatgaaaattaagatttttatcaccttaaacattgcaaggttgaaacaacattaacccaatcccatacaacaccatatatcatatcaaaagaaataatgaaataagtgaagataagttcaattaaaaaaaaaaatcatacaggaagcacacaattctaatttttttaagttgttagttattttgtcttcttaagtcttttttatttgaaataaattttttcttatcaattatttcgatattcttctctaatgtgagcacactcacatgtctaattagtatttgataatatatcaacttctgacttagtagttttctttatttaataatttattatttttataactgaattccattaaaatcttatctattttaattttacgaaatattaattttcatgaatataacttgtatataaatatatttttgagtttttgaccgcactgatctactttgtatagtttcattcatttcaaaatttaaaggaaaatgaaaaaaaaaaaccctcaatatccctcaaatataagataaatttttatttgattttgcaaatatcattaatgtattttaattattctcaaacaaaatacttctgtacagagaagatttttctatgaacgtattgtgtgtgcgtgtgaatgtattatacgaataaattagaggcaacaaaagctaaacaagcttacgaataaattaaggttgatgagaattttcgtatcgacaaattttgtgcagagaattcaaaactattttattatcaagaaaatattctgtctatttattgtctgtcattttaaaaatacagcataacaatattattatctcatttatattgaaatcatttatattttaatatattatatatttaatttttatttattattctaattaatatctttaaaatgattttttttatctctcgtaataaataaaaagacaaatatattgtaaaaaataattaaaactaatagtattatgtaaacagaagttaaacgtgcctatatatccatttggaaggtagaaaaatatgcatttgaagttggaaaggaaaagcttttcagcatgcaaatcacgtgaaaaaaatgaaggcatctcaaagtgattttccaacgtcgtacgtcaatcctgaactttttggacaaatgtggtagaggatgtacaccacacacatatagtcatcaatggcgagtgactaatatagactagttgcagtcttcgtcactataatggctgtattgcatcgttcacaatttgatgaaaacattggtatgtcgacttttttgaaatggttgagggagaactttcttttttaattataaaaatagtgtgcgaaaattgaaatataaatttaaaaatggagagagataatattgaaaatatcacaaataaaaaaatctttaaaatgtctaattaaaatagtaaatagagtgagaataaaaaaatatatatgttgacttttttttactatatttaaaattatagtataatttgtaattatacattatatgtcatattaagaaaatatcatttatatcattattattttaatttcttttttaaaaaattaacttgtatttagaactaatcacacaacaattttttttaaaaaattaacacaatgttttctttgtgtattttgaaccaatacaagatggaaacgtgttatcatgttgtattgcttccgcacatcttgtaacacaacaaaacacttttttgttatgcattataaacaatggaaacctgtttccatcaagcgtactttttgaagaaaaaaaatacatatatgcatgaaggtgaacttagcaaaaaaatggaatccattaacgaagtccatacttttatttagggatattcattagttgaattttactaaacttattattaattagatcaaattctatggattgggttggatcaaacttgtgcatttttattgtcaaactccaaccgaataaatccattcataaacaagttaattcttgtgttagatcaatcgagtacatctaaattaattttttttaatatataatgactaaatgtctttcaaagagatcaaattgttataatatttgattattttttgttacaaagagtatttgattaatagaatgaatgattctaatgcttaaataatattttatattaaatagatatcagcatgaaaatatagatctaagaaataaaaataaaaacatcaactaaaaaaacatggatgaattaaaaattctatacatatttaattatatacaataatgaatttaaacatattagattaaattttgactcaaatcttaaaaaaaaaagattagattaaattttgactcaaatcttcaaaaaaaaaaaaaaatcgaaccaaactaattagatcattttaagtgattttgaatttatggttatctatatccgtgaacactttttattggattgttgaatcaacatgggactgaagactaagtacgggggatggaggatttcgggcctatgtttttgtgaacgatgcccaccatcagaatgttgtgttttgaactttttggagaaaacaatgggcctccaagtccccttacacaatcacaaaactaaagatgaaaaaatattttcattcacatgccacattgtaattatttaaataaatgaaagagacatgaaataaaaccacaattttaatttatttatataaaaaaaattatatactctttgatcataaatcctaagccgtctcacttccagatgaagtccaaggccggactgaacaaaacgaatgtaaaggtttaattcataaatagccttcaccgattctaattaagcctgtaaagtgtaaactaaaaagaaacaaccaaattaacatcccatagcctcagttgaagatcatggaaccaagtgctcttgtagtgccctctgtcctggaattagcaaaggagagattgatgagaatcccagagccttatgttcgtccgcttcatgaacgtccaatactatccatctctacacctttaccccaagttcctctcattgacctaagcaaactcttgtcccaagatcacaaggaccatgaactcgagaagcttcactatgcctgcaaagaatagggtttctttcaggtttgtcataaatttaatatagctagatacaattttcaatattgcatatagacatgatatgtatgtgttttagtctatatacttttgatcaaacatgattgaagtctttctttattaaggactttgatcaagaatttgcttttcaaactttacatatgatttaatgtcatatttaagaattcatgatgtttttttaaagttataaaagactatattcatatgtttcttacttagcttttaatgtttgaggattaaatttattaatataaaagtacaacaattataaccatgtttaattaaaagtataggaactgaagacatatttttctcactaggatgatttatcaattaccaattactcatgtaatcatgtttttagctaatatcatgtgcaaattaaccatgatcacagctaattaatcacggagtggactcttcattggtagaaaaagtgaagagaggtgctcaaggattatttgatcttccaatggaagagaaagtttgggcagagagaaggagaagctgagggatatggtcaactcttcgtggtttcagagaaacaaaaagttagagtgggcagatttgtttttcatggtcacttattccccaaccttcccttaccattcaggttctctttctctgtttgtcttggcttatgattttttgttcgtccgttaatctgtagagtatagtaaatcaatacgctttttttaacagagtatagtaaatcaataggctttttttaacactaagtatgttggtactgaattaaaaaacaaaaaaaaaaactccaacaatttctttgtcctcaatgctacttcattttgtggaattagtcatctctttgataattatacaggtatttagaatatgaaaaagatagatatttattgtttcaatcatgttttaatttgtaccaatctggataatacattaatatttatgtattcgaacacattaaattacatatatatatatatatatatatatatatatatcaagtaactccatattcaaatagtcaagtgacaaataaaataatttaatttggtgataatttttactctttctttgattttttttatctttatgacattaatgtgaaatattcattaagtttgttgatgattaatattcacagataaatttgacttattatctttaattaaattttttcttttaattatattttttcatctataaaattcaaacttaaaattttatttaaaaagactaattctagtctattgagaccaataacatgttgctactctcccttaggtttaatacggtttccttgtattaaattactaaaaaaatatataaaaatgacttagttaattttgacctatttattttgtatttaagttatgtaaaaatttgaatatatattaccgagaagcttttaatgctttacagagatgggtagcatgtaattttcaaaaacagtggatattgttaatgtgggtagattggtgtcttcatttgcagagatgatttagaggcttatttaacagaattaagaaaactagcgatccaaataattgaccttatggcgaatgctctatcagtgtataacatggaaatgagagagtcatttggtgaacggactcaatcaataaggatgaattattatcctccttgtccccagccagagctagtgatgggactcaatcctcattctgatggtggtggacgtgcgattcttctccaagccaatgaagtggaaggtcttcaaataaaaaaaagatgaacaatggattcctgttagacccctccctaatgctttcattatcaatgttggagacatgattgaagtaattatcttttatttcacatctagatagacatgaatgaaagaaattaaaagtaataattaaggtgattagaaaatagggaaaaaaaagtgtaagaaggatgtcaaaatttaaagtgtaaaaattattttggattttgacaactagtttgctctatgatttaataccttgttactttgcttacctttcctattgttttggcagataataacaaatggaatttacagaagcattgaaaacagggtaacaattaactcgaaggaggagaggatttccctagccacgttttacaaccctggtttggattctattttaggtccagcaccaagcctagcctgttactccccaaacaccagcactgttcaagagaattagtacaccagactactacacgggatatatacctttccaaagaactccgcgggaaatcattccttgatgccacgaagatccaaaatgaaaatgatgttgagaataactcttagaagttaacaattgatgaaagcataaaagttaaagcattaaaagcttcttggtaataatttaaaagttcagaatgaggacaggctttggtagctaaatcttaaataaatacctacaactgccgcgaaaagatgccttacaaggataaaactcaaacttttgagtgtggctgtatttattggggtcaattgagcttctacatgtttgagaatcttaggttaaatttagaagaaaaaaaatatttttaaaagaaataagtatgaagttagaaatttgtaatttatgattatttttaaacagttttgttttgtaagttgttttcataagctgatttctctaatttcatttcaaacaaaaactgattctgattataattgatgattataacaaaaatgctgataaaaataaatgaaaaactttaattaggaaactttcttttacaagaattaaaacctaaattctgaaatagtttttttaagagaaattctgaaatagttgagaagtgaaaaacttatttaacccttactatatatatgcaatgcatgagaacaacgacaaacatatagggaacatgccggccggcatgctgttgggaaaaagatgcttctttagattatagattaatagttggcctgcttaagcattatgaaattaagctcgaaaattacgaaattagtctctagtttgaaattcctaggtttgccattcacgagtgtgtcatttatcttaaacgtagcatatataccactgacagaggtgaagtagtactgttggcgtgtggaatccttagtcctattctagtataatattgtcattaaccttcaccaatcatatatatatatatatatagtttcattaagtagtatcctatattaatcctaccagctgtgtacaacatagtctatgctcagttgaagctatggaaccaacgtctcttacagtgccctttgtccaagaaatagcaaaggatgccttgacgagggttccagagcgttatgttcgcccacttcatgaacgtccaatactattatcaaccactactacacctttaccccaagttcctgtcattgacctaagtaaattgttgtcacaagatttcaaggaacctgagttagaaaagctgcactatgcctgcaaagaatggggattttttcaggtttgccatcgactttttcgttgttgttgtgtgtgtacaacgtacaatagcgattaaaacctaaaatcttgtacaagctatccgaaactctcaccactagtttgaccctagtgaattggtttgtcgtcgatctgatatatcaaattggtacaaagaatattatcctgatcagagaaaagttgattaattgtacatattagatagtcataattcatagctaggagtatcaattattaatatataaaagtcctgaatggatgttgcatataaacaaacgccttttattgataaaacataatattcattttaattatgaagtgaatgattcatcaatcaacgattaatttacagctgattaatcatggagtgagcacttcattggtggaaaaagtgaagagaggtgctcaagatttcttcaatcttccaatcgaagagaagaaaaagttagggcagagagaaggagaaggtgtggagggatatggtcaggcctttgtggtctctgcggagcagaaattagagtgggcagatatgtttttcatgctcactttgccaccacatttaaggaaaccctacttattccccaacatccccttaccattcaggttccactctttatctcttttgttgattatatatatgctttctgcttttctacgtgttccattaactgtttcttccattttaactttgaaaatatgataaaccagcagtaacttacaagaaaaacagtcattaaataaggatatggaattataatgtgtttatattataactagtatagtatccatgtggatacttgagttagtcataaaattaaatcaaatgtataatataattatatatatatttaattataactgttaaatatataatataattatgtatatttagttgtaattttataaaatttagtaaataaaaaaaaataataatcattgtctattttaaaaaaataagaaagtggatgaataatataaaatatattattatcaatatttttttaccattttttttgataatgtatatagatgaaattatatctcacaaagaaaatacttgtacacacataacatttaaaaaggtagttaagacaacatattatatatctagattggaaatatattaaaaaaatgcaagatctagtatagtttattaatgacaaaatgaatgtgtatgcaaaaataagagaaagaaagaactgaagtttaataatgatttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttaaattaaaaacatcaagaaactttgcggttagaattacaaaagtgaaaacgaaaagaaaaaaaatggatgagaatcaacacaaatccatggcttcttgttgttgaacaaaaccctttttatttctcaaatgaaaaacatcaaaaaattcattaaacaaaaatgaaagaaattaaaaataaatataaattacatgtaacaataagaaaggtgccataaagatgaaacctacaccaaatgcaagatgtaccaacaaacaattactatattatcgatggtttaaagtctcttcaaaagaaaagataaaaataatattaaaattttgtattacaggttagtacaatactctgagtacataggtaatataattgtttacgcattaaagagaaaacatgctacagagatgaaagaaatgagataataggtattaaaaatttaaaagaaaaagattaaaatttaagatttaaaaaaaagattataatatacttaataaaaagggatgtaattaacaagtttcaatttaatttttagtctggaagtcacacgtgtcaggccacttccttttatagataggtgatattacatgtccattctccaatcaatgaagaaatggttcagcttgaattccgatcgaaaacttttattctgtccttgtacaggtcctaattttcccttcaccttagataaacattagatttgagaggaagaatcttggcacgttaaaaaagtttaaaagtttaatattttttaatgtgaaaataatgttaaataataataataaaattatgtaatccaaaaatattaattaaagatattttggcgctaaaaacaaggatttggattacaacactcaagttgatatattcgtcttcttgtatggttggaaacacttcactttgattccatttgcgttatattataactttgtgttgcttttaagttaattgaataatacaatttgcataatatttttttttcaatcacatttcttatcttatcttatctcatctcatctcatttttttttcttttttctttctttttttatctttctctttcctgagaaaaaaatattgtgcaaaactcccattgaaatgacattgtccctattaatttggtagcaatttttgttctctgtgatactaatttatttagaactttctttattctccttccaaacaattgtctccctgaaaatcagctaccttaaaaaaacaaaaaattaatatatggaatatgtcaagactcttgatgccttgatattcaaattaaacttgtctccatgcgtggacctaattatttaatgattataaatataataataataataataatttttattattattataataaaaataagtacattgacaatgtgacaaagtgaacactacattttttttaaaaaagaagtcaacactatataatgcataagtggtatcgcccaaaccacaaactagtggcaaactaaattagacttaaaaaaaaaaatacgtagcatctatatagtatattgcatattgacattgtattttactacccaaaacatatttttttttgtgggtgttacgaatcttcatttggtggcagagatgatttagagacatattctgccggattaaagaaacttgcgatccaaatcgttgaacttatggcaaatgcccttaatgtggacaccaaggaaattagagagttatttggtgaaggggttcaatcaatgaggatgaattactatcctccatgtccccaaccagagcttgtgatgggactcaatccccatactgatggtggaagcctcactatccttctccaactcaatgaagtgcaaggtcttcaaattaaaaaagatggatcatggattcctattaaacccctccccaatgctttcatcgttaaccttggagacatgatggaggtaattaattatactattaagtattaacaagctagatcaactttttttttaatatacagtgattaattgtctaacattttcaatttaatttttgcaaacatgtttggtcctttaccttaacaaccaattgggtagataatgacaaatggaatttatcgaagcatcgaacatcgagcaacagtgaacttagaaaaggaaaggctttccatagctacattttacaaccctggcatggaagtaaatttaggtccagcaccaagccttgttactccaacaacaccagcagtattcaaaacaattagtttacccgaatactacaggggatacctctcaagagaactccgtgggagatcatatcttgacagcatgaagatccaaaatgaagatgagaaaagctcttgacattgctgtgacccaaaatatgaatggtacaaaagcttctgtatatgaatttgacgttgctggggatttcagtttattattattgttattttaagttacgcatgtgctttctcatagtttcttttcatttttaggtgtttgttttgtataataaataagttttttttttaactactgcatgaatgaataaggtattataccatccatcaataagaaatctagtttagttattaaatacgatgtggtagaacttaaacacaaaagaagagccatatcaaaagactaattcattaagagaacctcaagacttaaatacccacatcaaataatttatttttctgtgtgagactcctaatataatgcactagttattgtaacctatctaataactgttatggattaatatgaataacaaaaaggttttataccattcatatccacgtacaatatatacgattataagacattatattgtattgtaattgaacttattgttatatatagcactgaccactagccactagatgatggcatatacattttcactcaaaattttaaccaactgtttaagtaaaaaaaattccataatggtaactacgtgcgtgtatctctagagcggcagtgatagtcatctctaacaatactctaacgctcaagtgagtgagtaatttaagaagcaacagaattgaattatgcataccttagcgatagtagattttatttctgttgggtggcatggatttttcaaaacaattgaaaaagtcattgacttgtttaagcttgaaccagtcattgactctatggaagtattgaattactgagtcactgattcatccaatgagctattggttgaatcggtagaatctctcacacataaattagtacaactatataatcaactagtctcaagctcaattctcaactatggcatttatattaaatatcttttacaaccggttcaatcatgaaaactgatatctacttattcagatctaattaagactagttcatactatttcacatgcacgaccagtctaataagatacatagatcagttacttgaccaattcaaataacatttcatatgaaatttaatttcaaatatagctcacatgtatcaagtcattttatctgggaattaggttaattgatttatctggaaatgactacttcatttttctcggcaatatcaaatgactacttcatttctgcatacagtcaagtgcaccaatttcaaattaatgcatctaattcatttatgcatagtgaatcaatctggttttttttgttgatagttgaatctcttttcatttctgcattctgatttttattttatttttttatgaactacttttatgcacttccagttgtagtttctgtgccaaccagatgctcaatcattttaggagcaataaaaaaaacacatttgatcctcaaagcaagagtgatcatgtcaccaatattgtgtgtgaattttttaatgcttgggtcagggatgataggaagagactgtccagtcaatgatgcaatcaattattagtagattgatggtgctttcctaaattaaccatgtttacagctaattaatcacggagtggactcttcattggtggaaaaagtgaagagaggtgctcaagaattatttgatcttccaatggaagagaagaaaaagtttggacagagaaaaggagaagctgagggatatggtcagctcttcgtggtttcagaggagcagaagttacagtgggcagatttgtttttcatgttcattttgccaccagagaagaggaaaccccacttattccccaaccttcccctcccattcaggttcttcattctaaatttctaatttgtctcttgtatcagcgtgcttttttttcactgcttttgcttcggtcaattacaattaatctctaaaatatgatgattccatgctttaatattaagttcatgatattacatttcctttaatagatggaaattggaaatcatataaaaatttactatttttctatcctatatattttttataaccatattgatgcgaagtagcaacggctttgttgatatcatttttcttaaacaaacagcaatcatattatatagtgccaaattgttatactgtagaaggagtcatataacaaaaatgtgaggctgatttgttaaaagttttaccatgtaattaatcattgattatttgtgtggataacttgataccttcaattgattgcaggggtgatttagacgcctattttgaagaattaagaaaccttgcaatccagatccatgaccggatggccaattctttttcaatagacccaatggaaattagggagctacttggtgaagcagaacaatcaatgaggatgaattattatccaccatatccccaatcagagctagtgatggggctcaatcctcattctgatggtggtggtctcaccatccttctcgaagccaatgaagtggaaggtcttcaaataagaaaagatggattgtggattccagttaaacccctccccaatgcttcatgttattggtgtaaaatatttctcgactttgtcaataattaatcttcaccggtaaatctttagtgtggtctaccctctcaaccaattttttttcctgtctatataaaacttgaacccgagatcttacttaaaaagattgaacttattgacttattgattcataaaatagtttaaaatagagaacatagattttttctaactttttcatttcttacaaacagtgattaatttgttcttaccatatcaactgattaatttggcaggtgatgagtaatggaatctaccaaagcatagaacaccgggcaacagttaactcagagaaagagagactttccatagccacattttacagcactgctatagatgcaattattggtccagcaccaagccttgtaactccaaaaacaccagcaatgttcaaaccaatcagcgcggagattacttcaaaggatacttgcacaagaacttcgtgggaaatctttccttgataccataaggattcatgctgaaattgaggaaagctcttgaacacttcaaaattgatggagacattaaattttaatatatggcacacaagcttctgtatttggcaatgcatctttttcagtgaagcatgtcataccaacagctattgtatgagtaaattgagactaagggtgttcaactccaaaccgatccaaaataaaaaccgaaaatcgaattaaatcaattttttttgaattggtttggatgatttttttctcaaacctattgatttggttcgatttgtaatttgtatttttgaaactaaatcaaacgcaatacttatattattttaatattatgatgtgtatattacttaagtttcacagcttttgtagttttatgtatacgaatttatacaatgtttatcattttctttttcatatgactttttaaagatatatttagtttaaaactgacgaaactttgatagattttattgttgaaggtttaacatattaataagtatcgtatgttgttattagtaattttttaatgtaatttaatttaaaaattgaaaataaagtatctaaattttaatgaaataatatcttagtaaaaattacaaaaattaaacaaaaccaaatagtaaaatattggtttgatttgaattttattttaaatgaaaattgaaccaaatcgaaccgtgagcacctctaattaatgttattccaaaaatgagaggcttttaaacaaagttaaaataataattaataaacataattattattgttctgttctgtgagaacagaattgtccaacaatggtgttggggtgtttgatgtatgatcaggttccccccctctctctctctctctcaaggagcttatgggaataaagcagctcgaggaagagaaagatcacagcggcagcgatacggtttgggggtgcagtgtgtgccgtgcgaatgaaaatagagggatagaatctctgtgtacctttcaccgtgggagatgtcgcatttataagaagctttaccttggaccttggaggtgtttcgccctggactcgtcatcgtgtttccaagatatttggagatacgtcagtaatccttccatttttattcaatcaggatctgattatcagtaattcaaatatttgggtcattaacaaaaagatacgatatctttttgttcatagtacccttttatccgtaacaattataaaaattattaagatggaatgtggattcctgttcaaccctttcctaatgctttcaccattaaccttggagacatgtctttcaaaacaaaaaattaacattggagacattttagaggtatttgaacaaaactattcacaactttttgtgtaagttgagtatctatccgttaaatcattgtaaattagtagatgtaagaagagaataaggccttaagaagcatttatatttgtgatgattttgatatctttatactgctcaaacctcaaacaccactcgatgactcaattgcctttgcaatatggttttgtaaatggtaacactggaatttatcaaagcattgaacatcgagctacagttatttcagaggagaggatttccacaactaccttttattgccctaatggccatgcgactaaacgtccaacacctagccttgtaactctagaaagaccagcacacattgaatagaagtattagtgttgctgaactctttaaagggtactttacccgataactctgggaaatcatacattgatgaaatgaggatctaaaacgggaatgatgaaatcaattagaacatgtgttgaaaacacaacaattagtcatactagaatcaagcaaagatgatcaatgaatatattattaagagattagaatgagtcaatttatgaaatattataataacataatgctctgataaaaaaatttaaataaaatcatgttgtaatggtttaagctagtggtctggtaagtaaaaagcagtatggtattactgaaatcagagaaaccatgcatatgcagagaagtcttgctacttgtactggggattgtgttctcttatctctggataaatatgatttagcatagatgcattatttacttttgttacttttgagataaatatttaataagaaggtttggtatgactttaaactatttactgtacttctttatatataattcatggaactctgtcatgttatatattgacatcctgcagtcttagcttatttacctttcggtcaacctttgagattatgattggccacaccatgaaagaaagggtcagaaaataatttagtaaggaatatgcatgtgttttattcttgagtgtttgataatgatgcctatatttccatgagtacataaagttgataagggaagaaggatgataaaaaaaaagaagttaaatttcagcctggtctcatggaaataattttgtaggaaataagggttaaaggtatttttgagcaatgtgtaaataatgttttagaaagcaattttaaaacaaaaaaaaagcgagagagaaaaatcaaatgtcctaaattgcgacttttagatttttggcaaactgttttttttcttaattagtgcattttcttaattaaagtagaaattagtgcatttatttttgggaccaaaataaagtgcattttctctctctcctagatgtgttctctccctaccttcttattactgttctctcaaaagtcaaatcacattaaattattgttatcattttcgatgaaattcataattcactctttcaaaacacataaatttgaaacgatgaagtttaaaataatgtcaaatataaattagtgttttgagcacattgattaatgaattaaattattttattaaaatatataaaattacacttttataatttttttgtttttcgatgattttttaataatattttttaattccttcgttcctttttgatagtttccataagatatatagatttgaagatctctctaattttttctctagtggtagatctcattttgaaatcataaggagagagaaaaaggtaaaaaatttattattttttgaactatgtgcatatcttgaaagttattctacaataacttatttttcatattggagatctcttcaccttctttattaagtgatctagtaaagatcagatcttgaagtcaagatttttactcaagatccagtactaaagatgctctaaatgtacaataatcattttaaataattttaattcaaggtatttttttataatagtagtataacatatgcgtattttccctttttccgtatggaccaaaaatatttttgcattaattaacggtcacagatctggccgtaattaacttgtctgaagagttatgcatattttgatcggattagattaacaaaaaaaaaaaagggtaagaaaaacaattatgatgccctatagcagggaaagagacaaaaaagagttagtgaaagtacctggtacctgcactgatgcttatatttagcttatgctagtcctgcgactgcaacctcgataaaagggaaagaaaagagaaaatagtgcgtgcaattatggaaaataaataaaaacaaaaataaaaatgttggagtggtagtagtacactaataagcttagctaaatatggatgttataacattcggaatcatagtcggcattatcatcctcttcttagtaattgtttgctacatcaccatcgaaggcacttgcaactcacgctcttgacaccaacactcttcaattccatggcattgggtagaaaaaagagtgtgcaattagcattattgcttctcctctgtttgtgtttggatctgggaatagcgcatcagcatcagcatcagggtcattctcattcccattctggtttctgtgcatccgatgcccatcatcactgcggggatgaccatccccatggccatgcgcatgaccatgaccatcacaagattgatggtaggtcgaagcttcttcccgaagagttagcggaggaagaggatatgaaactctatggcttcggtttgccccatcaccatcaccatgatcacggtatcgaggctgcagaactctccggtttaggtattttcatccattttctctcactccttaatgttgtgtcaattttaacattcttaatttcaaatgcagctcgtgggaattaggtcagtgatggtttgattaccaaattttgtagggaattagaatctatttatagaagctttgaggggccatgtgattgtggtcctatcctgatgtagggtttatgtgcaaagtgccgctagggtttatagactgatgcagattgctacgaagcctgtgtttcgtgcaatttataatgtaaaaatgggggtggtgatagggatttccacaaatgtacttggtaagtaacatatgatgtataaaagtcacctaattaagttacttaccgtggctacttccctatgttgtatagggtgggctgaggtgctaatcaggtagaaaattatggattggaggcaattcttgtattgaggattgatggaatgagtgtgagatgtcacttggtaggatgagggactgctagcttatctccaggatgtggaaaactctgtttgtttgactgagtcctgtttagaagattatgctcacggctttccttgtcccatagaggttcaattggagtaattcaacttgagtcttaaatacttattcaagttgaatgctcttctcgtccattaagcttgcacagctttctgtccattaaaagcatcctcctttaagtagatttttcatcttagtaacaacaaatcaaaagtcccattcataatgacatttggaaactattacttttttatttggagattaagattatcttcttcttcttcagacatttctaatagaatgcaattcccttataacatttatatttttggattaaaaaaatggacaataatagcataagatgtgtgctgttaatgatactctagctttctggaagctcaaatttacagattatttcagttttgatgtttatatagttcattggtttttattctaggcctttggttgaacgcattgggctgttcatttctggtgagcatggcttctcttgtttgtctgattatcctgcctgtaatttttggtgagtattttttgtcattttatacaatacaaattatgagggcgagccctggcacagcggtaaagttgtgtcttggtgacctgttggtcatgggttcgaatccggaaacagcctctttgcatatgcaagggtaaggttgcgtacaatatccctcccccttacctgcgcatagcgtggagcctccgggcactggggttacagtggtttttttttttatacaatacaaattatttatttttcaataggaaaggcttatctacagtatacaaaactgaatactccggtttattcaccaatttcagtacaagggaaaccatcaaaggctgttgttgattcattggctttatttggggtcaggtttcatccacctactttctttggtttcacttatcttgaattctctttttattgcttttctttctggtcatcttgggtattattcttccttatttccttatcatgagattttatacttcatggcttggaaatcgagaatgctagcacaatgctaactgggaaaagttacgaaatcatctgctgtcaataacttgattaaatatcttcttttatttctggttaacagtttttgcttcatttcattctcattggtcatgccttttgcaggcaggagctatgttgggggatgcatttcttcaccaattaccacatgcttttggtaaggaatgcatcataacctgtcttcagtacagttgatgcctttgttgattgattttgtataaagttcagttgaattgttgtaattgctagttttccattatttgatatcattggaggaaattatgtgtctcttttcctctttctctgatctccttttaactttcttattttctacgtgtgtatctgatagaggtcataataatagatggggcagaatatatcagagaagaggagttagtagtaattttgattagaagcaatagttgttaagtgaaaccacagcagtaacaaactaattgtagttactagacagttagctgttataaatagacagagaaaagagagggagagttagttagaaacagagagtggagagtggtgtctcgaaatcaccattgttactgtgtaattcaggcaaattgcctcattgtgaataaaagctactgcattttccatattttcctgatccagttcttatcaactggtatcagagcccagattctagggctttgtggaattgaatggcggcgaaggcaaataacaagatggaagcaagatggaaagatttttccgactgcaggaggtgcggacggaagagagaatggagatgatcttggtggcactggaaggtgaggctttgggatggttccaatggtgggaacagaggaacccgacaccttcttgggaggaattcactgtggccttgactcaaagattccagggagcaatgctaggtaatccctttcagttactgcttgctctgaaacaagaagatactgttcaggagtttgtttgtcaatttgaaaaattagtgggtactatgaatgggctggatgagttgttcttggtggaagtatttttaaaggggttgaaagatgagattagtgctgaggtgaggctacacgaacccagaaatttaatggaggccatgaataaggcaaggcaagtagaagaaaaactgagggtatgggcaagggctccaagaagcttgggtagagttttaccagtgcagaaaactaatgtctggagtgtgaagaactggaaggagggatcaaattggacaggaaagggggttgaaggaatgaataagacagtaagtggaggtgaacagatcatggcagccaagggtggccatgagaattggaaaggaaagaaaaatttccacaaattgtctcaagctgaaataaatgaaaaaatgaggaagggtgaatgtttcacttgtgaagaaaagtatcacccaactcatgtttgtaaaaacaaacagctgagactgatggtgatggaagaaaaggaagaagaggaatttcaaggaaatcaagaggaagagggaagtgaagggctgtatcaattgtcattacacagcattgaggggttcacataaaagatctctcaagttgtggggcagaattaaaggaagaaaagtagcaattcttattgattgtggtgccacccacaatttcatatcgaccaggctggtaagggaaatgaaattagaggtaacccccactagcccttattctgtagaagtaggtgatggacataaggtgagtagtaaaggaatgtgtaaaggactagctgttgagttgcccaatttacagattgtgcaaaactgttatttgtttgagttgggaggtgctgatttgattttgggtgtagagtggttagctagcctaggagaggtaaaggctaattttcagaagttaaccttgactataaaatctgaaggtaaggaagtttgtttaaaagctgacctagaattaataagggccgctatcagtttgaaatctattagaagtactatattggatgacgaccagggattcatgattgagttgaaaacagtggaaacaaaaagaggggtggaagagaggtctgaattggtgttgggagtgttggatgaattctgtcagatttttgaagaaccccagagtctgccaccacatagaagcaaggatcatgccatcaatattcagcctggagttaaaattcctaatttgaggccatacaaatacccacattaccagaaagatgagatagaaaaactggtaggagacatgttagcagcaggaattattaggaccagcataagtccatatgctagtcctgtcatattggtcaagaagaaggatggaagctggagattctacgtggattatagggctttaaacaagataactgtgcctgatagatttcctatgcctatcatagaggagttgctggatgaaattggaggagctgagtggttttccaagttagatcttagggctggataccatcagatcaggatgagagaggaggatgtgcagaaaacagcattcagaactcatgaaggacattatgcgttcttggttatgccctttgggttaaccaatgctcctgctacttttcaggcactaatgaatgaggtgatgaagccatttttgagacagtttgtattagtattctttgatgatattttgattttcagtcctacattagaagaacacattatgcacttaaaagcagtgttacacgtcttgcagcagcaacaattatttgttaacagaaaaaaatgtagttttggccaaagaagtttggattacttgggtcatattatttctagtagaggtgtagaagctgatcccagcaagctggaagctatgacaaattggccagtgcctagggatacaaaagggctgagagggtttttgggtacaggaggtttgtaaagaattatggacagatagctcacccattgaatgcattattaaagacaaatgcttttaaatggggagaggaggctgatagggcatttgatcaattaaagacagcaatgaaggagttacctatattaaaagtaccagatttttccaagcaatttatattggaaactgatgcttctggtactggactaggggcagtgctgttgcaagaagggaggccattagctttttggagtaaagctttatctgaaagaggtcagcttaagtctgtatatgaaagggagttaatggctgtggtgttggcagtaaaaaaatggaaacaatatttgctgggaaggaaatttataatcaaaacagatcaaaagagcctcaaatttttgagtgatcagaagttattaaatgaagatcagtttaaatgggcctccaaactgattgggtataattttgagattcaatataaaccgggaagagaaaatgttgtggctgatgctctttctagacagtttaatttctctgctatatcagtggtgcagcaagaggattgggatgaatgggaggaggaactgcagtctgattctcaaatgtatgacatttacagaggaattttgtccaagacaatggaaaaacctggttattcagttaagggaggcaaactgtattataaagacaggttggtgttggctagaaattcatcaagaattccattgattttaagagagttacatgattcacctgtgggtggacattcagggttttttagaaccttgaaaagggtagctggagtggttttttggaatggtatgaagaaagatgtgagacaatatgtggctgaatgtgagacatgtcaaaggaataaagctagtacactggctccagcaggattattacagcctttacctattcctaatagggtgtgggctgatatatctctagattttattggcagtttacctagagctcaaggtaaggatactattttggtgattgtggacagattcactaaatatgctcatttcttggctttgagtcatccttttactgctaaagaagtggctgatatattcattaaggaagtagttagattgcatgggttccctacatctataatttcagatagggacagactgtttatgagccaattctggaaagaactattcaggcaagctggaacacagttgaaaatgagcactgcttaccatctacaaactgatggccaaacagaagtagtaaacagatgtttggaagcttacttaaggtgtttaactggagataaaccaaaacagtggcctgctcacttggcttgggcagaattttggtttaataccaattataatatttcagcaaagatgtccccttttaaagctttatatggacaagagcctccattgctgattaaaggagctgaccttccttctaaattagaggaagtgaatcagatgtgtaaggacagagatgaattacttcaagagttgaagagaaatttgttaaaagcacaagatcaaatgaggaaatatgcagataaacataggagggaggtggagtttcaggagggagaatgggtgtttctgaagttgcagccatataggatgaagtcattggcaaagaaaccgaatgagaagctcagtcccagattttatgggccctacaagatcattcaaaaggtgggggaagtagcttataagctggagttaccagtagacagcaaaattcatcctgtatttcatgtttctttgctcaagaaggcagttaaacctacttgtcatcctcaacctttacctaaggttttgaatgatgacctggaactacaggtgcaggctgagaaagtgatgcagaagaggactacagcacaaggacaacaagaagtgcttattaaatggcacggtttacctcatcacgaagatagctgggagagtttggaagaaattagttctgtgttccctcaattagaccttggggacaaggtctctcttgaaggggggggtattgatagaggtcatagtaatagatggggcagaatatatcagagaagaggagttagtagtaattttgattagaagcaatagttgttaagtgaaaccacagcagtaacgaactaattgtagttactagacagttagctgttataaatagacagagaaaagagagggagagttagttagaaacagagaatggagagtggtgtctcgaaatcaccattgttactgtgtaattcaggcaaattgcctcattgtgaataaaagctactgcattttccatattttcctgatccagttcttatcagtatctctctggcttttctttttaccggtgtcattctcagcattagagtattaatggttgtgttagtttgatcgctaatgctttgaaaatgtaaaaaatctgaaatttgtttatcagctcttgaaggaaacatgtgtgaagtgatagtgactagtgtgacagaaagactaaaagtgtggtactggttattttacttgattttttttttcttttttcaaatcaaagattggagactttaggatattgattcttcctgtaattcctattgtctctttgttaccaactttcttaattgagaaaagtttcttcttgatccacaaatttggaaatctactgttaggtaccagaaagagccaagagaactagagaataaactttcatgtattgctatcaagtatcaagcctgtatcgaagagatacctggttctgcagtatgagaaacggagtacaagtgataaagaagaaaaatattctaggcaattcaagagtgcctagtccctcccagttcacacttccgaagcttataccccttgcatccaatccacacaccccaatcccctccctacttccagctcagcagttagttactaagtggaatcttactcccattctctttcccctgggtatgatcctctacatcacacctcttcctcttcctcttccatatacattttatttattttgggctttggggtcttacactaaggtcaactctttgatctagggagctataccttgtaggatgtgatgacatacagattcgtaggtcctgtactgctctttatactgatatttgtgttttggccagatgaagttaagaaagagtgagcgttttacttttacaatatcaggcagttgtttcctttggaaaagaattttttggtgtgtttacttattttgttattttatttgttgggagtaaaaattgtttgatgagtattaggtggttgtttcaatttagagaaatttctcatgctccattttaaatgttttggtagaaaaggatcaaggatatattgtactggattctgtttactctagtccataatttattatgcacattactttatgatttgcatagagactgcccaagcttgctgtgttcttgattgagttgattcatttcaatttccatcttgttttttttcccctattttgttaagaaggatatgttatcctttccctagttcttatgtcccttttcctttgtgataatattttgtttcctaaaaaaagtgttagtttgtgacataatatgattctcttttactgtaggtggagaacactctcattctcatggtgaccatggagatcatgaccatcatgctagttctggacatggtcattcacattctttagccgatctttctataggaatatccatccttggttagtagtgatatgcttgatgttcttactgatcatgttggttatttacctgcaaggatattttaaattattgacttcacttacttccagttactaattgcatggaataagtttatattttttcttatttgtattcagataattcagacttttggcctgggtgaaggaagtttattatgatcttttgaaaggagggttgtgttaggctctcaacaaccaatgtaaaacatgtcgaaatcccaaacatggatcactcacgatggattgtgtgctattcctagatttctatttagaattaataggttgtatttctcgagtacactgtttaatgagctagagttgttgtgttggagcttggattatgttaaatgtgcaagggtcttcacatttttctagaggaatatgggcaacaatatgagttcaagagtgccttattaggtttggtacttgaaatattggtactatgacaagtaagtatttggagtaggtgggcaccatgattcggaaaaggattaatatcatgtgtcttcaagaaactaaatgggctggagaaaaagctaagtatcagatttaaactttggtacatgaaaaaaagttagagggaagattgaaagaattacatgagtattattgtggacaaggattggaagaaaagtgtggtggatgtaaaaaggattagggagataagtttatctttaaaattaattggttgcatgggagactatcaatatagttagtgcttatgcaccacaaggtggatcaaaagcacttctgaaaaaaaagttttgggaagatttgaagggtttggttcaaggctttccacgaggaaaagaattttgtaggtggggatttaaatggacatgttggtaaaaaaaaaattacgtaccccaatgcccgcaggctccacgctatgcgcaggtaagtgggagggatattgtacgcagccttacccttgcgtatgcaaagaagctatttccggattcaaacccatgaccaacaagttaccaagacacaactttaccactgtttccggacatggtggtagtgagataaaaaacaatttccatatcttatagtggttttggatatctaattggggaaggacagtttattcttgatttgtcaatgatgtatgatttcacaattatgaacacttgttttaagaagcaagcagaacatctagtcacttattgagtccaatggcatcatgtaatctatgtagccaaccatacctagtaggataaggctatttttgttgttttttgtatgacaccatcatgacaaaccactttcatagcagtgagaaaaaaagtggggacagggaatttgaggttgaattttcttcttaaagccatgcttgtagctgtgattgatctcttccttcatcgtctcaattttctttcatctctatatttctctagtcatttgtagtcttcagaaagtaggactatgcaggtgggttctcttagaaccacaatttgttacaatgttttatggttcttgcagctggaattgtgctctttcttcttgtggagaagttagtgaggtatgttgaagaaaactcaggaggagctaattcatggacgcatggacaccaccaccataacaacaatagcaagaaaaaattgaaagatgataacagttctagtgtcaacttgcagtcagagtctaataatgcaaaagaagagagattgatagatgagataaaaaaagatgatcaagtgtcacgtgactccttgaagggagataatccatctcaatctgaaacctcactcagaaaggtaagatgagcactggtatgtcacttcagctgactgaggttggaatgcaccatttggtttggttcgaaccattgttgatgtcgtacatatgccatgacttttatcagtagaaattcccatttagccttcagatgtttgagcagttgtgctggaaatgcaattactaataggataataatatatgcaaaacctgaacagctggaataggatggttacacatgttgtataatgctctattagacatttagtttgaacggaatattggaggggatgagaaacaattatctgacaaatgaaatacttgtatcacagagaattggaagcaatgtgaccaaaggtgatccagacactaatactgtagatagcgccacatataatgtaaaatcttcaaatgttaaggaaccagttatatcaccaacaagtcttgtgtttggttatctcaatcttttctctgatggagtggtaagttatattttgacctttaattggttgtaaattgtaatgaaggaaagttttcgatgtattcatgcaaaatatattaatattgcagcataacttcaccgatggaatggctttaggaagtgcattcttgctttatggatctgtcggtggctggtctagaactgtgtttttgctggcacatgagcttcctcaagaggttcaaattcatctttattctatcacatgttcagttacatgagtattatgccaatctgcagaacattttcatcccatttttaggcataacttaatttgtaacaaactatttcctgaaggcctgaaaagtttgtttaatttgacaaagtgaagcaaatatgtatctttgttaatgtgacgtttatatttcttattgcctaattatttagttaaagttcataaagtgcttactgcttagatctttttattacttgattttaataagaaaattagcactgatatgttaaaacttgcaaattatggtgtcagaatagccaaacacatgattcacatgatgacactcaatttaatttatcattataatcttcattgttgtgtatttttaacaagcataaggtactatgaaacttcatgaacaatgttatactatgaagaacattctttctgttctttgatccaaacattttctctcaatctctttctcactacctagctaatactttcactagtagagggttcctaaaaagacttcatctggtgacatttatgcacatatgtcttcatcgatgtacattccaggtgtatattcagatttcagttagctattatattatctttactaaaaaaattctcactactcatctggttatgcacatttataaacatatatgtccgtgtcataattgaccagccgtccattgtcatgcacattccataccatggatccaagtccatgttatgaatcttttaagctgatgtttatttgaatcttatacattataagcaatgttaaacattctaggtcatctgaagccttgagactctttgagccttgattaatctggcatgaaagctgtaagatcttaagtatcctgccttaatgacacattcagggaaatataagttgaacattcagtgctatcatctcctaattgaggaagcgaaattcctgcaagtgatcatatttctgctattttgggtttcatgctttgttattgtcattttataatgttttcagcttagtattttgttcttgcttttttatctgatttttctgtctcaattttgtttattgttgacatatacattccatcggtattattggattgagatcttacttttgtcccaccaaaagttttatgctatttgtttcttccacatacagattggtgattttggcattctgataagatctggtttcagcataccaaaagctttgttcttcaactttctgtcagcacttgtggcacttgcggggactgcattggtgagtgttgtcttccattcaatatttcaaatgagtgagttgtttagtggatccacaaacggcttttacacacaattaacattgaaacaaaaataaaagtgaatattgacaataatgtgttaacaaatattattgtaaatgagtgcaagagaaataaaagggtaatcaacttttttttgaaaggctaaaagtgtaagtaaaaaattaaaatgagctaaaaatgaaaagagagattaattataccttagatttctatatggtaacaaaatgacgacttctaaacttttatgggactattataaatctttttaaattgtgtttctctgaggaatttacagttgtgttaggacttggacaattacgagtatcacatctacatacatttcaatgtcccagattcccttttcttgatttgcttcccgtcattattattattattattattattattattattatgcccaagaatgaacatggaatgaaatagaaaatcactgtttttggtgtaggctctgctgtgggggaaagatcctggacagtcatctttgattgaggtaaggaatgtttcataacgaatttatactggttgattgcaagttgattgattttagcaataatttgtctccttttttacagggatttacagcaggtggatttatatatatcgcaatagcgggagtacttgcagaaatgaataacagtgggaatacaacattaagaaatactgttgtccaaataatctccctgaccatgggcatggctgttgcccttggtatttcccttgtagaatgaaagaaatgtgttctgtttaggacttgcatgtctagattcctgattttccaattatttcacaaaaaatatgccaaccagtttacgaatgttctctttatatttttgctttatgctaaacggtgaacccagaaaaccttgtagggaaaggggaattgatagaaaatgagggatcaaacagaatgatcagggctttaccccatatgattccttactccctaacagagtgaactttgtacagtacatgttttttcttttcgtctttaatactaacctagcacaagaacgtctttttgtcaaaactgtgtattttgtaacattttactctcttttgagctgtatagcagtcaaaatggtttcctctttctgatgcacgtaagatgaagacactgattgtgtctgattgattttgtaccttttttcctcggttgtctttatgttttgggtttttgctgtctttctattttattctcttccaatggaaattgagcctgcacgcctacatttggacaagggtggtttatctcatatgaaactcacttcacacattttgatgggacgtaggtaagtaggttttgaaattgttaagagtatctttgtggtagatctcaaattgaaattttaaattattttggtggactcaatagtatcacataggattgaaaatctatcaagattttttttatttttttctttagtagtagatctcattttaagatcttagggagagaggaaaaaaaaattctttttttaacaatatacagatttcgaaggttcttttacaagaacttattctccatgttgaagatttttttacttcctttattgaaaaatctagtgaagattagatcttgaactcaaaatttttgttcaagatctaatactaaaaatattttaagtagaggctgtagagcatttgacatgcctagttgggacaaattttttttagaaatgctagcaatataactatttctacattatttattattggttaaaatttgttaaacatttaaaaaactgagggtttcattcattaaaatttgctagcatttctccaaaactttaccttaacaccataagtatttatccaacatgcctctgcacgatgaattgtataatatgcacatttgcaaacactgaagtatagaaatatctggatttagtagaaaacatgaggtacattttttgacgacccacacatgatgaatacttgggatcttgctgctccaatgctttttgtcttgctctattgaagcttactcagcttataaccaaaatgcatccttcgttacatggaatgttgtgatggaatttatttctttgttaagactcgaacttgtccatctgctgaagcacctgaaagatggtgatattctgggatggtaagggtgggaggggtggcattctcattaatggagtcatcacaaggtctcctccttcgtgtgtgagggtgtgatgccgctttcttactcctcgagctggaggctctgcgtcaatggtggtggttccttctccattcaccacggcccgggttgtctccactctcttttttgagctttctgcaaacctcttttcatgcatcctttcatcctgcaaaagccatgtagatgtcagtttcttccctgaacttcagagtgaacttcaaaatgcgttgaagtactccttttacactgcgttttctgagggcctatgaaacaaccagtgaaattaaatatcaagagggaaaactctggttcttattttccttataaaaaaaatccagacaaaccagtaactagttgtctagttgtcaacattcataggatctgattgtattaatttaattagcttccattatttattgttttatggtacaattttttgtacatattgtttaaagaataattctaaatctttttataaaatcaatttactaaatgcaaaaaatattaaatgtttcctttttatatttttaagatattaagtgtattttcttttctatttaatactggcttatatgatatcaaaagagaggataaagtaggaaagtatatccctctagctagaatcaacatctaaatgtttgacatgtagatatctagaaaacaaaatcgagtgatggtttatctatacagcatatctttttactaatttttaatattttattaaaaaatacaaaatgaaaaagtaattgtgtttaaatatcgtcttaagagaattaagaaaaaagatgttttagaaggattgagaatcatttaataaaaatcaaataccttgacgaacaccttatagctagatattgagaaatacattatgacttaatacatacaagattctttttttccttcaaagcaaacacctagacagattagaaacacattatgagaaatatctgcacagtactgatatagaattcttttctttcaaaagcttccttcctgttttgaatgattttctacgatgtactataccctaaaaagtcattctccacatctgtatgttgcaattcaaagttagaaagagaagctttggagggtgtacccctggtccagtatatatgtctttcaaataatgcagcccaaaaaaaatttatgtttagtatatcaaattcttgtgttttaatttatacggtatataaaagtacacctcctgaaactttacatgtcgattcctctgctagcaagaaacgattacaagaatacaactagaggacaaaatgcataaatacatatatatatcatggacatgatgggcatatgtaaaacaaacctaaaaaaacgaagctgcattaattatttttccttaccatgcaaacatcatatgataagaaaaacaacatatatgtgcttacgttgataactgaagactcgggcattgggcatttcacgggacgatcttcatctggtggctccatagggtgttctactgggaagaaatcagtgcttttatcaacaacaaccccttgaacatgatgcacttccatgatgatactgttttgttgttgtgttgcactagtctcatctatcaagggaaactggctctcttttccgtcctaaagtatgtaaaattgttttgcataagcaacagtgcaatatagaagaagagaaaagaaagaaaaatcatcaaaagattcttgtctattacagattctccaattacccattttatgaatgaaggagttggagagagaaacaagggtttgagagcacttacaaaatgatcctccccgcatgaaaatcccatgaacatatgagctcatgccagaagctgagaaaatgttggtttgtctgtctgttgtgtgtgtttgtgtctgtgagagcgagagaaagagaggaaaagatgggaaaagagaaagacagcataaaaaggaggaatatagcagaatgagagagaaagacagagagagagagagagagagaggtgcaatgtgggatcaccttgaacagttgaatacgaagaaagattcccattgggattttgctactagcttttaaaatcttaacctttcgctttctttgttttatttttgtttttaatttttatatgggtgcttgtctcttgacgaatcagaggcatggcttttcttttcttgctttgatgctttttaagaagggtagcagtgtacttggttgaaaatgttggtagcacaaatcatgtagatctactaatttagtgttattttatcttaactaattagtgatctcatattcaaatcttgatgcataattatattaaatagttaaagaaagaattttatcttccataatttaactcaaacaacatgattatctataataaaaaatataaatgatctagcaagaaaaaaaatatattctctcattttctgtttctctctctacacacaacacactttctgctttacttggattttgcaggaaggaaataaccaacagattttgtgcttggtgctgctgctaagttacgcacaacccatatatccgtcgtaaagagcaaaatcaaattaagcttagaaaatgaggtgtggagaaagagaaagcgagagccgaaagcaaaaatatcgcgtcattgccatgactttagtcttcacacttttgaagtgtagccgttcgtttttttcgatgtaacactcgtaaagtagtacgtagcatgtaacagtttcaacatcaaagctacattttacatgtatacacgcattaataatacttttccatagtatatgttcatatgaagatggtgtaaatttaggatgttaaaaccatttttttatgtatttcaagttgtatgatgccactgaataaattacaaggagaaaggtgcatctggtagctagggaagatctgcagcagcttctaacgtactaacttaattttccatatataaatttttccatacatttcattctctctttcatttccttcttttttttggaaagaggctagcaatgagcatcacagcataatccactctttcatttccttcttatttctctctttttttttatcatatcttttattttctttcttttgtacttccatttctattttcttttttatctcgatctattcactccatttttgaaaagaagttccagatcataatatgtccatggttaagacaattttcaacttataagaaagagttaataaaatttacttatatatcacgtagaaattagttaggatcgggatggttccaaatcatatagtaattctctattttgaggtagaagtttatcaacatataatttattagaaaataaaatatcacgaacgagactcattaaataataagtaagttttacaattttttgtaatctcaaataaattttagttaataataagaagagtgttcaatagaatgtgttatttctttaatggtttatgtattttaggaatattgtttgcatattttttccacgctagtatataaaatttggttacttcatattgagcaagtataatcttagttaatacgaacttggcctcctttttattattttaaatgtgatttaacaaaattttaattttctctttttgagatgaaatgttgattactattgctaaaatatttttctccctgtatatattaattgttaactttggccaacatacttgtgagagcgcgtcatgctcatattattcaatgattaagggggtgttcttgattaaagattcttgttattgacgtacgttttttttttattaaaaaaaacaaacttgatgttaagttttcgattgacgttaaataagcgagttaggaatgagaaacatcaaaacctagaaaagttgtctgtcgtagctttgttaagccgcaggttggggctattgagcaaaagtaagatgataacatcatccttaccgagcaaaaatcatattgaatttcttttaattaacttcaagccaaaataatctgttactcgttgaagcaaaacttttactgtagattagagcgaaacttttacttgtataaatgcatatgtaagtgtgtcaagtcactattgaatccatacattagtacataagaaaaaaagtaagtaagaaaaatagtatttatttaataatgtaaatagtaaaaggtttttttacacaatgttgaattagaaattgtcaagtatactttaaatactttataaatatttcaaaatttattgaaccaaccataatttttaattgattcacggtgttaataagttttttagactaataatgtaagtatttattaacttacaaatgtggttatttaatgtttgattttcttaagtctgatctttttgagttatatatatatatatatatatatatatatatatatatatatatatatatataannnnnnnnnnnnnnnnnnnnnnnnnnnnnnnnnnncaattacaaaaactaatttcatcatatataagtgtttcccattaaagcaagattgtcttggacagaggatatatacaatttaaacaaaaaataaataaaaattgctcagaacactgtaccataacttgaaggtgttttgatggaagcttcaagagattggacaatatatgagatacagaaatcacagaatcatgtaaatattggaattattcggataaattattcaatattatatactagtattttgtttgtgttgaacattaggctcaaaagacaccataaaaggaagaaagaccatgggggaaacaacagagtcgccccactcatatatgagcaaacaaaattgactgaaaagatggggcgttattgctgcagaatcaaaggagggaccaatatcaaacagtcagattctacaacgactcttccaaagtccatatgctccgccactaccaagccatttaaagatcctgaaaagctaaacccagaaacacaaaacataaatcacctcaaaggaggaccatatacccataataattatgttcatacttcatgcccccacgctctatgacaacatgtaaatcaacataatataataatagttaggtattattaatcagtatttttgagacattaattaagaaaaaggatttattatgaaaaatataagaaaacatgaaagaaattatatacaacacaattttatatattccaataaatatcttttctgtttttaatttcttaactaatatcttaagaacatcatatttgtctaataattatagtttaattaataatattgagtttaaattttaaatttataattactttaaaatttagaagattttttattattatttataataattttatctgacttaaataaaattatcatatgtaaaagatatctatgtaaaaataacccttagtaacccccaaaaaccttcatgcactgccttttgaaagaccaattatattgagcttcgcccctaaggagtcacccaagaaatgaaaagtctattttggagaatttggagtttgagagtagtcttaggaccacactacccttcgcatgattcctggtccaaattcaaatgaagtataaatttagatcacctaatttaacagtgggaaaataggaaaactttttcgatcctgtagtacatttttcctttctaaaaacagaaatcaacacatttagcatgcatgatgtacgattagttctctcttttaaattttttgttgtctcatttgaagctatattattagtgagggagactgaatattccttcccatgaaagaaatggcgttttttaaataaaaaaataaagattaaattgataagtgagtccccataattttaccaaatttttaattatgttcttgaacttttcttttcttaattgtatcttgaatttatttattttttttcaattggatactctgtctaattgctgctataaaaaattaatcatatacacttaattagatgtgtaaagagtggattggtgcttatgaaatatgttataagcataactaaattaattgtaaaagttttagcattctttttagtccaacaattatgaatggtttgtaaaagaatatatgaacttaattcacttgcaaaatacactattagtcatgagttatccagatatagtgtaccacatcaaaacatgtagattgaccaagaccatgaatatgtaatgctccgagacttgcaataattaatttattgcaaattttgcttacgttatttgtccaaattcgtccttagaataattcgtgcctttcatgtaatttggcaaactcagtaatttttttatcgataaatattaatttttataagaaatataagttggcagactcaacgattgattcacatgtcgtgccaaagagaagcatacaatcagattttgccaaccattaagctttgaagcaatgttatcaatatagattcatcttgtgaacgcaattcacacccttttttcttcttctcgtgggtcccttgtagccatttccccagtctactacagtaccatagaccgaatatatatatatatatatatatatatatatatatatgtatgtatatggaatgtatgcattgatttatttttcttttatttgcatttaaaatatggccgctgttttgcttttacgtgtagtacaaagtacgggtcatttcgtctagttttaataaaaagaggagtaaattttgggtatataaatagtatttttaattaaatattttaaaaataaaaataaagtgaattaacataaacccaatatcttaaccttttatttatttttataaacatcatacaactctcttgatttaaacataaaaaaagttatattttctttctttttctttcctttatacatttagaagtaaagagtcaaacttacaacttgttaaatttgagatccttatcttactcatatttgatacatttgtctcctataaataattttacaaagttcctcagtagcaggatcattagcaaagcacttaaacaacgccaaatgtttgtggttgagaaaagccagcgacattaacaatgtttatatatagccacaacatcatacacattcacgaaagcaacctaattaaggcatgtacgtagagtctcagcatcatgggacaagcatgtgaatgccaaacaaattccttctgacacagttaacattccagaataatctagaagctttagtacatatttggatgtccgatgcaattgaaagttgttgacaaaataaagtttacaaaagcatctatagtcttttttttttttttttgtatttagtttaccatgaatcattaaatttgatctctaacgaattcaactaaaaatcaaacatactcttagttgtgaaccacaaatagactctttattcgtttaatacatgtcaattagtcacttccaaatagcattttccaaacataataggatctagagttttacaaacgcatgacaactcatcccatagcaaagcttgttttcgactcatgatattaaggtaacaaccttaccaaaaatacgcaatgatgccacgtggatgtgttgtacatacaaattaaaccaacacgttaaatccctttgcgtttacgttgttgcacccctatcatccgcacgtcccaaccaccacacacacaattcacaaagttcaacaaacatatacaaaatatgaagacaaaataaaaataataacaaaagttttcaactagagaaagaagggaaggttgaaggtggtgaagaaaacaccaccatcaccctaacctttgttaattttccaccaccgtcacctttgttttgcagagatcaaaataatcaacaacaaggttttaaaaaatcatccacaaccgtgatttgagttacaacatcaaaaaatttcaactgtccacaaccacaattaaaatcacatccggttgcatttgtttgcaatttatcgcgatatcaacaaacgcgatcacaccgctactgtaatcgatatttaaaatcttactgatcaacaagttaagagaggggaaaatgagagtatttaaaagagccagtggagccatcaaggacaggaacagcatatgggttgcgaaattctcacgaaagggtccattccacaaccctgatttagaaaccgctataatcaaagctacaagccacgacgatcaccacatagattcaaagaacgtgcaaagagtgttccaatggctacgaacctcgcccttgtacctaaagcctttcgtgtgggtcctctccatgcgcatgcaaaagactcgaagctgggttgtggcgctcaaaggcttgatgctcatccatggcgttttctgcaatgacattcctgtggtgcaacccatggggaggttaccctttgacctttcaaacttctccgatggtcatttgagccccgctaaggcttggagcttcaacgctttcgttcgcgcttattttgcgtatttggataagaggtctgcgtttgtgtcctccgaggttaagccaacgacgaagcaaaagaatgttagaaataaaaagaaggaggtgaaggagacgttgatggaagagcttgaaaacctgcaaaagttgcaagggatgattgacatgcttctccagattaggccaaagaatgagaacttgaacgttggtttgattcttgaggctatggattttgttatagtcgaggttttcggtgtgtatagtaagttttgcaacaagattgcaaaagttttgttgagaatatatggggttggtgggaagatagaagccagtattggcctcaaggttcttcagaaagcatcgattcaagtggaggagatgtctttgttctttgagttttgcaaggatattggggtcctcaatgcgtctcagtgccctaagactgatagaatttctcgggaagatattcaagatcttgagaggataatcagtggtgcttcttccaagaagggtcgtggtgttgtgagaaatgatgaggataataataaggccattatggtgagagattgttcttccactgcatcggttttgcaacataaggagtcagagaatggtttgatgactgtgatcacgcaacaatgggaggtttttgatgatgatcatgtaatggttggtgctaaaggaatggataatgtgtctaatggtgaaaaggctatgattggaaccacaaccaatccttttgaggaatcatatagcatcgtaccttatgtacctgctcactatcaagctcttcctgatctaattagttggtagaatcatggaaccggcgtttatatgttgttcccttttcatttcactagattactatatatgtatattaatatatatactactagggagtccaagttctatctcaattaattgaacacgatacatgaataacaatatcttcaataattatggatcaaaaaaatataccgctggggaaaggaaaatccgaaaagtggaaaccaaaggggtaaaagtttttctgatgcatttctcttctccacattagcagaagatctttgtgaatccccccttcttcagcattaggaaagttttatgacgaagttattatgttcttattgttgttgacatgataattagatattgaaattgcagaacttgtgttgtcatctatttttattttttctcccttaattggatgttaattagctttttatgaaattgaacatttttaagtttagatacaataattagatcatggaactaaccaatttaattttatgcaaaatgtgatggacagatatctttgatgtggcagtataatggaataatggcgattgtcttttttagaaataacagaacataattgatcattatagcttagtacacatgagcgtttaagtaaccagtctattttcaattctgtgttgccatcatgccaattatatctctctacaccaggtcaattgacctatggctcatgaattgtattctttattcatgtttgagtccttcatcgctctcctcgcattgaaagtctcttcttaattctggttaaagcaattttacattttttattatgtcaacaaaccaatttcatgccttgctatgaacactttgctctggacttttgcctatgttgttttctcatacaagtccacccggtaacatgttgtatatgttttcttgtatttgaactttcccatttaagcttgagagtttcaaatccgttggaatcctattcttgttgttttcagatgatttaatttaattgctcaattttttcacacgtctgcgtcgatctctttccttgtacgctctaaaggcattttatctttatgactattcttttgtatagatgtgtttatgttccttgcatgtaagcatcaattttttcatcctctatgtcgcttaacatctaattcatcgccgacatggactcacccatgttattgcattccaaggttaggtaacatgctaaaacattttattttcatcttggctaacacaatgttcctatccactattcaatgctattttggataaaagttggggaaagtatttttgaaaatttcaaagcatatttcccaattctaagtttcaaagtaaaagtacttttgagctctccctattattagaattcaaatatacactcaatcataaattgttttgaactcctattaattatttagtgcaaaattacaacctaattaagtcgcacttgtaaatactgccatctcggttagtctacatcaaagattatttcagttagtaactactaaacacattttggacagtttgattaaatttaggaaagtgaaaaatataagggtacatattacattgacaccctctcctaacgtcaagttgctaacatctattatttgccttcatagtgtagcaagcaggtcggcatggcttcccaatggtagatttgaaatttcttttccaagttgacaatattccctttgaaagcactaccaaatatctagaattaggatacttttcgcattctcctctcttgctctatcaattcagccacaaactcggctatagccaaaattgaagactttagcggatctagttcttataaaataaaattagtagacattataacgctaattgaaacttaaagaaataaaataataaaagacaaaaaaatcattgatatgatatgatataatataacaaaaataagttagaaagaaatagaagatgtatcaaataagtatttgtaatatccatgtgcatgtccatatccatatatgattgttctattagtaatattttttcactcgtgacatttcttgtatttgatatatataacaatattataatattatattataaatatatatttaggtataaattataataaaataaataatatagtttaatatatagtattgaataatattatattatttacattacaatcaacaaaacaaaaagtatttgaaataaaaataaatattatattatttacattacaatcaacaaaacaaaaagtatttaaaataaaaataaaacattatttattatagttatttttattattacataaagtaatactattatggtctaaatataagaagaaaaaatttcttagactcaaatataagtaaaattttaattatttttatcatatttaataatatatctaaaaaatatccttcaattaatcaagatactatttccaacaatcactttttgtttttgatatcaagttctagtgaaggaaattttagaaaaaaaaatatttcttgaatgcaaataaaagaattaactaacttttttttaattaattagcataaagttagttattttttatatttaggtccaaagaagtatcataataatgtcattattttattatattatttagaaaaaatatgttttagtcattatattttttattaaatttgattttagtttctaaattttcaaactgannnnnnnnnnaatgctactaagaatcattaaaagtattgatttgatttttcaaaggaaatggttgttttgtgcgaaaaagttttcgtgaaacatgcacgaacgtgtgttgccgtaaaaatcatatttcctatattttttatttttaaatcaatatttactttaaaaaaacaatagtcttccagattcgtgctggaaatattctaaattgaagaaaacgcatagagcactcgagaaaggaattttaacacattagttaaaacattgggggttaagtttcatttgatttcatttatgaatcatgaattaaaatcaatttaattggactacttgtttcgtctaccaaagtcaacgttgcaactctaataaagttgcttaactgaattttgatggtcttttagtcgcattacatctaagaattttatccannnnnnnnnntagattttttaccgcccaaagttaaagaagagactaaattcaaatattctataaaatttaaggactaaattattaatttgagagtataagaactaaaattaagtttgaccaaaagtataaaaacaaaaaaaaaatatttttcctattatttgtaacaattaaaattgtgaataactaagtatttttctcaaaaatcgaggatcaattactaattcacaaagacaatgctactaagaatcattaaaagtattgatttgatttttcaaaggaaatggttgttttgtgcnnnnnnnnnnctcttacaatataatcaaatatatatggtacgtattacccaaaattatgttatgtttgggaattggtttttggagaggaaaggaaaagaacgacaaatatttatttctaaaaagaattatataatatttataaaaataaaccaaagattgatatattaagttctgctagtctattattttatctttttattttaaaaaattatcaaattagaaataaaaattatattctcctctcattttcttcaaaatccaactctgaaatgtgccatttaaataagaacattttcttaatagtacttttttatataatatcttgaaatgggaccaaaattatatatttaaatgatagaaactcttacaactcaaatcaacatgttgatgcgtagaagaactaaatgaaataataagtatgcatgagaattaaatacgaaagttttaaagttcgtgatgtagtttttacataaaacgccagtggtataaactttttcttcttttaatcatgattatatggattagataggaagaatcaccttttttctaacaagacaaattccaatgcaacttcttttatttctgatgaaagctctctagcattataatttccacttattatttatcctatttttcttatcatgagacttttcgtgcaaacggacgttgaataaaagcaaccctatattacattttttttttatgaagcctttttatgattgatgtggcatatgaatatagaggacaaaaaaatggttaaaggcaccactaacaaaatcatagaaaattgatcaataaaacacaaccacgtaagatttctgattttcaattcgtgggtcgaatcacaaatttcttttcgtgaaaacgggctcgaggtaataccgaacgaacaatcacgagtaaacgctctcaaaaggataaaaaggtgagtctaacaacgaaatgtcaacgcacaaaatccgaatacaattgcttgaaatgataaattgattaaaaatattttaagacattcaattataatgggaagcaagagtaagagtgagacatataaaagattgttaactcttaaaaattactgctctttattagccactagacaactgactcttaattactcaaacagcctctccctctcaaaaacaggacttagcctaccattagttttgttaggcatcataatcttctttcaacttctctatttcaactacattttagtttttcgggtcaaaaaccttttcctccttgtcagccattgaaatcccaaaaaaaaaaaaaaaattcttttatcgatttgtgccaaacaagttaatcgaaatgatggaactcattgttattatttctcacctatttttcactcatctcttctctagttatcttcaaccaaacacttttagtttctcatttattttcactcatcttttttatctcctaccctatttatctcctctacaaacagggcaataatgttaccgtagcctctactatttacagaatgagtataattttggccaacattgccaactaatgccaacatgttctgactattgctctatgaaagtaacctagttataatggaaacctatgaagaccaacttcctaattttgaatcggtaatagctgacttaatgccactactgcctcacaagagctaactaaaataaggggcaattggcattctatagagagtaaaaagatcgcgggtatctaatcatgccacttgtttctatttatgcaactcattgttatacttcaaaatttgaggtttaaaaaatatgctggactgcataatcgcaaggcatctcagatgtgattattgccttccaattgtgttatgggggagaaaaatactttgaaaaaatttcagctttcctgtccaaaagatatagctcaaccagattatggggaacaacctttttattaaattatttcccattatgtctctagactgttcagaacaggactgagaaatagataagataaaggccataaaatggtatagaatcatgaataaacagaatagatgactaattcaatggacaatagcactgaattaattgacaacaaacagtataaattcatccaaaattaacagagtaactcacaagggatacaatgcttatgcaatgaggtccctatcctgcaagtcccaggttttaatctcattgatatcatatagggtgtgattataggagaggaataggctcttacccccattatgcaacctctaaatccttggaaggatttgtcaggttttacatagtctactagaactgcaactgaaagattatccacacctaatgaagcacacttcaagaagcatccacttataggattgttaatgaactatacacaactaaaaaactgaggggctaagtcaaacaaacaaaggcaatgtgtaactgacaaaccaataagccaaaggaatgatgaaaagttaattcacaaaaaatcatagcatcgaaaaatcttaacaattttaaattaaaatgtgaaggagaattatccaaagctagtctatctagttataactcatctacataaatgttgatgccatataacatggttgtcccttatcacataaaagctgaagagggaaaaagaacaaaagaaccggaatatccaaattttaggtagaagtaccacaacagaaaaatcttggataacaaataactcaacatctgtgtgaaagaccacacaggtgtatatacaggtgaaacagaccaaatgtcatgtgtctcaacagcacctatctacctgatagtgacaaacttgttggtgccatgtctggcccaatgagtcttcagatcaatagggttagcaaagttataaccttcagctgcaagtttctctaaaacctttttaaaagcaccttggctcattttccgcccagctatccttgcaccacgccttttcatgctcattggcaaaggatatatcgacacatttgtggtgcaacaagccgattgccaacctccgcagccccaccgataacactgctgaggagccccagtgcacgaacaaaccggaataggtagaccagaaatgtccatatcaattccattaatcacaagctccatggtcttcttcggtggcttcgcacgttgaactggagcattgccattatccttcggcttcctaggtttcttagcttttggagtcgacagagcacccttagtttgccttttctttgacaggccaccttcctttttgacaactacctcttcgactctatccactttctcgtctcttgacgtatcaggtggttgtataatttgcaagttaggagctcccgatgtctctggaagaacagcataattaggattagtgggctgctgcatattaaaaaacctatctctttggtttatccaattatctctgacatagttcaatggcattggtgcttctgaaacaacacaatctcgtgggtgaaaagttccacttgcacccattaacatagccggatcacgaccaggcaaaaatggctttgtgtctcgtccagtcattccaggcatgagctgaagaccaagatgtccccctctgaagggttcataataaccccaattgggcatgttcagcacatcatcatcatccatgacaactacacacaacacaaaacaaaggatcataaagtttcaaaacatatcctttgcttcttctttcaatgtccaccattaaaacaatcttaaacaaacaagcaacatataccatgaactaataatacacaaacacttcaacggggaaattaaattccagatagacaaaacaccacgcaatttaattgaaaaatgagaaaataccaaaaacccaaaatcacaaattcaacaaaaattgaaaatgtcttaagattcccgaaaccaaattctcaaatcaggctcaaataagtccagattcactgttcccgagtgaaaaagatcggaacttgctcgatctaatcgccgcaaaacgaaaaccccacgatctgaacgccattacgatccctacatttcctcacacaccaaacacagcacacaaaagacgagctcggcgtgcagatccccaattcccattttagggttccaaaatttgggactagatctcgctcgttatggccaaggaaaacaaattcacagcacaaatgatttacattgaggctcagtggtagaagaaggaccccatcaatttcaaatttttaaggaaagcgagggagagaaggggagagagggtgggagagagagaattagaaagcgcaaagagagagagaaggagaaagcgcagagagagagagagaagaggtaggagagagaaaacttacttggtgggtgcaaacggtctttaggtttgcccttccggagagagaaagatgagagagacagaaatctgaaagagagagaaagatagaggagagaggagagagaaagatagaggagagaggagcaataggaaaggagagagagaagcggggttaaaaaatagggtatgtatgggcatatataatatactttgccacgctcgttttaaacaatatatatgaatatgtatttttggactttttctaatttcatataactagcttttgagttttgctaagcacgcatatagaaagagggatttttaaaaattaggagagagggcgatggggacaacataaattgggagaaaaaaaaatatgttgggctttgtatagaacttgccttgttctcgtaaaaaaaaaagaagaagatagaacttgccttgttcatgccagattttcttaatccattgaatgtgtaactccctcatgtcaatctcaatgccttttaaggttgatcctttttttagaagataaatccataatctatgtttatatttcaatcatagaagtagcaagaggtggatgagaaaatagtatagcatgtttggtttaaaattatattgactaaataatcagtttaaggataatattggtaaaattttgtttagttatgtcttcctcaaacgtaagatttttcattttttttttcattgcaactatttataaatagtggtataccttcaattaattttaaaatattaaaatataagttactttattataatgatttcctaatcttatgtaccgtataaatagatttaaaattaaaagaaaataatgtagtaggtttttttatgtaatgaattcctctttccttaataaaaaaacattctattttgaataatatgttctcaaaattagtctctaaaatttcaaatataatttaatttagtttatgaaactacaaaaatgttatgttatgttatactttcaaattactagatgtaaattattttaatatttattgttgtagcttcaagggataaaataataaaaacttgataactttagggtatacaataatatttttataattttaagaattaaattgactagttgttgtaattttgaggactaaataatgagatcatgatgatatcacaagctattaagatcaaatcatagtagaattggtgngttatcttgtattattagtcttcgatcatctagcatcagtttaaggagtataaacataatcttatgtgatttgttatatgaatcaatcgtatagtccaatcttaagaaattttgttgtaccatgccacaatgatttatttagagttttaaaattgaattaggatcaatcattaagaaagaataagaagtattttaatcaaataaggcttagagagacacaaaactttgatttatagggaatttgagctgaaagacttgagtccgaaaaatgaagactcaaatcccacaatccaaacctaagtctaaaatcatcaaattcaagtttacactaatagaacttgtaaagacttgaatccctcctaaaaagacttgtgattctcataagtttttgaggtttttggacaagtttttcaaatccaaatcaaactattattttctattgtggcttgagccttaaaagataaaagattatattttttttatcaattatgttatatcaatttgaattacaaactaaccttctataagtataaaaaacaaccttaaattttgtttgtgctcaaaatttgaagttcacaccttaaatttcaccaagcaggatggatcaacctaacctaatttgccacagctaacaaagataacaagaagcaacgaagattaagcagaaggtggagagtggttgaggaacgtgtgaaaagagatgagataacatttaaaatttaactaaaactagaaaactttctttttctattttccaaaaagtgagttaaaatagttttaaaattatttaaaaccaattcaatcccttattttctaaaaaaaaaatgttttcaaaattaaatttgaaaataaaaaattaggcattcacaacacttcatatagagccttacattttttgtgcatgtgtataatgacaaccaacaaagtttgaatttaagacttcatataaattgcccacactcctactactaggtcaacctagtaaatttttcttaacattttaattacgagaggaatttgataacataatctttaatatacttttaaatgtttttattattgaataaattttatataaatcctgttagatatagagtaaaataaaattatcttacgagacttaattacatagaatccaccggattgtaaatactatatttaaaattagtgtattattggtattttttgttattaaaaataattataactcttgtatgtaagattgtaaataagttacattatacatgaaatattcaaactaaactcatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaagtttatatatatatatatatatatatatatatatataagaaaaagtttatcaagttgaagtgcttctatttgcatttgaacgcatggcataatttgagtcttgcaaagtcattagtatgcaaaaaaaaattgataaatattcattttcgttcttgaatgtataaaatattgacaatataatacttaaaagatgaaaattcaaattttagtctcaaaagtataaaaagtgtaacaaattcatccatcagttaattattgtttttaccattaatgaaaaagtttaatggcataaagggacaaaaatattataaaaatgattgtcaacatggcttatgaatagattttggacaaaaatattagtaagttatcattagacgaaaatgtcaataattttctattggaccaaaatgtcagtaagttacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattaaacttgaattaagtcatcaacattccactaactttatttatttattataataatatttacaataactttattatcataaacttatatagaatattttgatcccactgttacttctctagagctgtccatacagttcgtattaaagtatataaagagattataaaagtgatattactctaaatcctaaaagtattgggcttaataagtaagaaaaacattaattaatatttagaaatctttcttcttactcattttctatgtagaaacaattttcctaatgcttaaatatattttttatcccataaatttagaccaattttcctttttgatttctcaaactgaaaaatatttttcttagtatcttaaattaaaaatgactcacttttgatctttaatttgtgaattgtgatcttagactgannnnnnnnnngaaaatgctcagtgacacaaacacaagcatacaagatattagaataacgttacaacaatgcaacatatataaacaatgaaagatccacatgtacgctaaacactggctacattaacaattagcaccttgaaattacaaacaccaaagacagagatatcactaactcccattacaaagaaacctggatagagcctcgagcttttgttaaaattttctttccgttgtaattcctttaagatctacatgtgttcaccaaactcactttttttatttttataagagttcagtcccaataaggactctaacaagcttccctgaaaaggggaagatgatagacgatgatatacacaaagagaatgacgatacaggtaatcagtgagactaataggaaaaaaaaagtattggactataagtgtaaagataaaatttcacattagataaaaataaaaaagttaaacaatatataaataaggacaagatcaataaactcaaatcttaaaattttagattaaagtgtgacatcaaatttatgtatgtggtttgttctagatccaatggtgtagatctttctagtgtttatctccattggttttccaacaaagagaaagagatgaagatggtagttggaaaaggggaggagagatcgagaaagaggtggtggctggtggaggaggtgagggggtggtggtgagaaaaaagaattttggcacgaggacttcttgggccgttgaatctcaatattgaggccgaacaatctcttttcttgggccactgacgacaattacttcctgcattctccaaattgcttccatattacttctggaatgatcgttccaaaagtaatatgggaagtgcagaaaaaaacaccagccactaacctgacttgacgttgaagaggtccatttcccaatcaaaatcatttcttcatattacccgagtttcttgtaataagtgaatttctttcgatttaaaatttatttttaatttattcaagatggaaatgtaatccagtgagaggctcataattaccatcgtgggggagagggagagcgcaagcttatcacatgactgtaaaagcttttccacaattaaaagttaggaccaccaagttacaatgtaacaacatcactattatattgtggcaatgctaagatcagaactttaatcagaactgaactttaattttagtcgattttattacttccaccaagtgtttttaattgggtgtgtgtatgagggattacttaagtatagtattctttcttaaaaaaaaaaaagtgtagttttcttgttaaatgaatgctctctttttttttttcttctttttatctaccaattaacaagtacacgttctcctcctctttgcctatcttaaattatcatttactttttcatgcatgtatttatttggtatgtgacccaatgtgcaagtacctgttaaggtccaaaaataaggtcgaccagcctttgattcggcaagctaggctttctattttgtagaatctctttttcataatctagtttgccattccacctgaatatcctaaagttggccaatgagttacttggcttgtttcatgagttccggttttcatacgtacaaagtagataaccaatcctttatttaactaaaatatcattaattaattaaatggagcatagacaaacttaaatatgaccttttgtacataagaatgcgtagacttttataattttatctatcaaatctatcaatgtcataaactatcaccacccccacccacattttacaagaagtttaaaatcaattaggctcacattttgattcatgataatacaaaggaatcaatttcaaacaattaacacttcaaaaagaaattgatatgctcttaggaggataaatactgataggtattggcctaaggtttgaagctagataaatnnnnnnnnnnctcacattttgattcatgataatacaaaggaatcaatttcaaacaattaacacttcaaaaagatatgctcttaggaggataaatactgataggtattggcctaaggtttgaagctagataaattagttaggaaatgtacctcccctagagttattgaattttgaaatacattaatataagttgtttgtaatgagactgctcattaacgtagacatattttttctaagaagataaaaaaaatggttttcaggctagttgtcaacatgaatgacggaaattgcagagcctgagatggatcctacgatgacgatgtcgccatttgcctatcaaaactaacagaggacaaggtgagataaaacactaaacaaaccatacttgctaaaaaaatttaggaacaattttaggtgttttaattgtgacacacttaaatcgtgttgttaggattcaaagctataacaaagaagaaataagggaatatattaaaggcaaaaatggagagatcctgagaggatatgatggtgataaattgacatttttaaaaccaatggaaatcttgattttgaaggttgaagctactgcagtgtgccatagtgacaatgcgttgtagttgggtcctacaatcctaatgccgagtaaaagggtaatcttgctgagattttctagttttacaaggcaaaagaaatagcattggtgagattcttttgctcataagttgggtcccaggtcttggttttccttccttttctattttgtacagtttttttgcagtctataatcatttcattgcacgggtaattaaactaatacaagcattgtactattcaaattaaattactatattctaagatgtgttatctttttgcagagtaaaacatagtatttaactgttaaagtgcgtcagagagggaacattgtgcataagcctaagttgacctatatggatggataaataacacattgggatagtagtaatgatggctcaaggagttattgaaacgtacgtgtgtgactgtattattgaaatgaataatgtttggaacacaccttcattctaataatagacaccaccaaggaagagaatgaattaagaaaaatgtaaatatgatactgataaaatgtgatgtccacattttaaaaaatatccaaatacaatgaaaaaaactatttaaaatgtatacttaggaagtgatattatgataatgaggatatgtattaaattatatataatttaatgacatcaatagtaaagaaaatcaagatatgaagatatgaggttagttcaatgattagagaaggataaaggaaaaagaaaggagacataaataatatgtttgaatctttcaactaacatttataataaaattaacaattctactaatgagcaaaaattaaacaattttttttatcggtagaagttaattgttaattgttagttttttgttagtaaaaaatttgaatcccttctccctttcccaccaaccaagccaaccttataagttaaccaaagcaaaatggaagagcaaccaaaatagtttacacagtagcaaaacaaaatttgtgtcaacagaaaacacaagtaaaattgaaggattaattagtaatacaggagagcttaaaaatgaggtggaaaggacttaaaagggaaaaaaatagcaagggaaaatcccttaatcatttagggttaaattggacgctaaatatcatagtgaatcgttattgtatttccaatgaatacaacaatgatgtcaataagtcattgaaaaggtgaacaaatatgtgtgaaaatgtactttatattttagagtgaatggtatgtatatttgactnnnnnnnnnnccttaatcatttagggttaaattggacgctaaatatcatagtgaatcgttattgtatttccaacgaatacaacaatgatgtcaacaagtcattgaaaaggtgaacaaatatgtgtgaaaatgtacttcatattttagagtgaatggtatgtatatttgactcgaacatagagaagtataattgcgggacaaatgaattgaattcaatatatattcttgcactttttaggaaggaagctagcatccttaattacacaatcccataaataagttggaatgaatatatgaccaatcatttatcatgaacttgttctatataaaatatatatttattaaatatatcttgtaacttaaaatatacaaataattagataatattaaattcggctctaacaggccaagaaaaaaatataatttaataaataaattttaaatttttgcatacataaaatatacaaataaaacttcaatattatgtatacataatgcttttttatagataaaaataaatataactataccgaatacaaaaataatactatgtttgattttttatataagaaatgatgatatgtttctcccttgttctaattatataaacatagtttcatttttaaatgtatttttaaataaaaaaattacagtaaaaaatgtgttaattatatattttcttttataacactaacttattatgaagtttattaaagatacaatcaagcatttcactaatggatgcatgcattaattgattaccaaattaagttacactcattaatgaaaaaatacattccttaaattaggaatattgatattaaatacacttaaactatttaattctatgataatgttaattaaaattaaataacttaattattttattagttttgataaattaatcatatataagaaaagaaagaaattagatagataaaataattttggataattatatctcaacatcataaataatctattaaaacttataattttttcttaactcatttttttattgcatcatgttacttatcatatttatatttttattcttctcctttttctcttcttaatgacaactaacacagtaaattcatgtattgtttttcaataattttttttataaattttaaggggttcataatattttttataataatataaacacattttaaaaacttgggaggattgggttcaacaagcaatcgatatttcaggattaagtatgtagtattctttgtaataatagttcttattcatcgtattaacaatcaaaaaataattgtttgtctatgtttggatgagaagcaagaaataattaattgttattttttcactaaattaacattttgttcattaatggaggagacaaaattgatctggtccaacatgttggaccgaattgggctctaaaattagtggtaaatagagttaaactaatttggcttggcttggtaaatcaagtgggataagcttgtaaaaaattgacatgaaaattattgggtaaggtagaatgttattaatttattattttcctcttaaaaattaaataaattagacaaaaaatatgacccaatttggcctagttcgacgagtcaactggccacacacacacataatgaagattataagtattctttacaaaatgcaattctacttaagtttgataagactaaaataaataatagaactcttccacaaagtacttaacaccaccatatatgaaatatttaagctcgacaccactaattaaattgaaactatctcatgttaattgattcacaaattacatgtattttaagtaaatgttaaataagtttttgatttctataaaatttttgtttcctgtaatttagtctctatatacatttttgctctattttagtctattgtttatttttagtcatcagtatgaaattaaaattggtaagaaaataaaaaaaattgatccacaataactaatattaatggctaataaatgaagaaaaacaaaataatattattatttttctaaaatgataattttctcacaaagactaaaatttaaaaaaaaagtaaaagtgataaaaaaaatcaagtgaagtggctatggttacaaataaagaagacattttagctgactgggactggacaatattaccatacacatgtgttgggtaaagtttcttaagtttatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgtcaataattttctattggaccaaaatgtcagtaagttacaattgaaccaaaatgtcattaatttttctgagactagaatgttagtacgttttcattggatcaaaatgtaattaagtaatcatttgactaaaatgtaagtaatttttcattggatcaaatgtcagtaattttttgttgaaccaaaatgtcaacaagtttctattgcactaatttgtgaccccaaatttcattttatttaagtgtaaaatataatttaaaggtaaatcatcattcctctttttatcattgcaagcataacaataacattacaataatcacttaaaaaaataggaaagtaaacatatgttaaaagaaacataataataatcatactattgattaataaccataatttgtttgtaaaaatagaaaatatccaaaataaacattcatacactattgtgtgcatattattatagttattaatcaatattatgattattattatgtttcttttaacttatgcttattatcctattattttaattgattattgtaatgttattgttatgcttgcaatgataaaaaaaaaggagagaacatttacccttaaattatattttacccttaaatgaaacgaaagttggtgtttgacaaattagtccaatagaaatggattgacattttggtctaataaaaaattactgacattttaatccaatggaaaattactaacattttggtcaaatggttacttactgacattttggtccaatggaaaattactgacattttggttcaatgaaaaattactacattttagtctaatggtaacttactgacattttggtccaataaaaaattattgacattttcgttcaatagtaacttactgacattttcgtccaaaatctattcagcaaccatattggcaattatttttgtgatatttttatccatttgtgtcacgtaagctctttcattaacagtaaatgacggaagttatcagatgaatggatttgttacactttgtacactttcaaggattaaaatttgaattttcatctttcaaaatgaatttgttaacattctacacattcagggacgaaaatgactatttatccaaaaaaaaaaagacaagatgcaagttgtaacaccccgtgtgcacccggtgtattagcattatgattattatcagattagcgcttaaacactgtaattaaaacttttcgcggaagcataaatcaaaaccatatttcttgattacatctcatcacaagcataagataaacccctgctagtccagatcatacaaccaataaccataggcagatatactcaaattatctcaacatataaacaggagaaaacatcaattacataacataactggttatgtacacaaacaacatctgacactagcggtgtctatacaaaagaataagcatccacatgctttctgatctcaccgatccttcctcacacgagggcatacaaggtctatacaaatacaacataaaacatgtgtacacacacacgtcttccctctacaggggtacaaaacagcatcaaaagctgagccaccaagctctcctcaagctgcctcacagccaagcatatgttgtctctactggggcctcccgccctgagactgctcctctctgccagaaccgtcacctgaaaccacataagccccacacagggtgagataaacatctcagtaagctcagggtccttggaggcatctcctccaccttggctcactctccatgacacaagtcatcaggcatcacaaacaagctggcctcccggccctcatatcaatacaagcaagctatcttgctctatgtacgacggatttcatcaacgccaacctcagtgtgagaccggaactcacacccgtgccatcccatcgggagctacccctgacgcatggacgcacatatatggtacctccgagaatagaaggaatgtcccatctcctatctcttggtcttgagggatcaccgacctctgggatctcatcaaccatgagcaaaccaaactaggaggaaacccatctcctagggaggtccatatctatttaactggctagaagatctaaataacaggcttcatacatatctaaagcacagatacaagcatatatatcatcatgagtatgcaatatccaataatgcatgtatcatgaatatgaccatcactccacccggagtgtggtgtggcacaaaggagtgggaaacatccccaagggaccaagaacttacctggcaaagctgagctctgcagttctttccctgctctgtggcacccgccaccgacacccttggtgtcacgccttatacaaggcatatcggctcatatcgaacgtcaagccagaacaagcatacaagcttaagcatataacacggttctcaaccgtctcaaagaaaggaacctcaatctcttccaactacaaggtcagctaacctaaggttcaccaagtctcaacactcaaagccatatcatagaccctcggcggtctatctcatgcccaaaaggcacttgagtcgtcacaaggctcggtgcaagccaacatcaagagctcaaagctctacataagctcacacatggcttgaacggttctttcacacacaagacaccgttctaacagcctcctaagcatatcaaaaccaccaaccaaggttctagcatgtcaccacatagctaagcaactcagcacacaactagacatgcatatcatagagccaagaaatcaaagttcaccaaactcacaattgagagctaatcctacatcctcacaacattctaaacacatgattccaaaggacccaaggctaatactagctttatcacaagtgggtcactattcacccaaaaccccaactcacaaatcaagcggtgaatctcgagtttcttacctcaaagatgacaaggaaggcccaaggacaactctccctagcttgggtaaccacgaatcgctgtcgttcctcgccgaactcgagttctacgaacctcccttgagaaagggattctcaaaatgagtgggtttgaagggagaatgaggaaggattcaagctctacaagtgtttttcatcatgaatggtgtttaaaggacttgatttggtgaactatggtgaagaaatgaaacttggagcttcaacaatggaggtggggtgctggcggaagaagaaggaaatgttttccttctgaaaatcgcgattccctctttatatagtggtcctgtcaaagttgtcgcgctgatagcgccactatggcgctgatcacgctagatcccaggaaccatggcgccgtctgtgccatccccgcgcccagagcaccatcctccagtacctgtggcgccactcgcgccgccttggcgccccgggcgtcaaccaccagaacctatgtcgcctggcgccaggagcgccgcagttctgcagaatcctgcgctgttcacgcccaaaactcgcgctgtacgcgctgggactcagagttattatacaagttattttatcgtgacgtcattggggccggatcttgttgaaaacaactgagtatagaaatagtttcaagattaggggtgtcataagaaattgatttggacgatttgagttggtttattaagtgagttaattttatttgactcacttatttttttatccaaaaaatatataattcagctcaactgctcatgccatcatagtttggttgataggttatgcgagttgactcacttttagaaaataaaaatataaaagaaaaatagaaaaacttaaatacaaaaatataaaaaaacataaatacaaaaaaaatctataacatactaatttattgtattaataacaaactcaatgaataggaaaataaaataaaattctcaaggaaaattatgataaaaaattaaaataaatagtttcacacagtttggcttgatgataattgttatgcatacacaaattttacatttaaatcatataacaattatcttatttttcctcttttaacgcttcttttgtgagtaaaacgtaagagtttagctttttatgagtttttattcagttgatgctaaaattagttgatttatagtgtgttggttatattttttattttttgtagaaaatgatacaacagagacatgaaagatggattgaagatctggaatagcgcgcaaatgcgggcttagcgcgaggccaatttcaaaaaacatgacagttgacattttgaagaataaaaaggggaaaacatttggaaaaaggagagagacagaaacaagagctagggcacgaagaagtgggaaaacccactcccttaaggactccttcctccattttcttccaagtgtttgtgttctatctttttattgtgttatgcttaattataggaccggtcctgaaaattctttggcccggggcgaagtggaaaaaatgggcccctaccatactttttttttgaaatacaaataatattaaaactaagggatggaaaaaacggacccttaacacacaaattttttgaaatacaaataatattaaaattaagagatggaaaaaatgggccttaacacacaaattttttgaaatacaaataatattaaaactagggatgaaaaaaatgagtctctaacacacaaaaaatggatccctaacttacaaattttttaaaatacaaataatattaaaattaacggatgaaaaaaatgagccgctgacacataaattttttgaaatacaaataatattaaaactaagggatgaaaaaaatgagcctctaatacacaaattttttgaaatacaaataatattaaaattaagagatggaaaaaatgggcccctaacacacaaaatggacccctaacatagattttatttttattttattgtttataataaaaaaatttacttacactaccggcccaaaaacttttgggccctgggcggaagccctgttggccctgccccagggccgggtctgcttaattatctttatttatgttgaattttatgtttctgcattagtattagacaaatatcaactttaattcattgtgtgttaaaattaaaaatatataaacttcgagtacaatcaaagtccttatggattcaacactcgaacttatcattttattattatttggacaaattggtatgtttgccaaagtgttaacactcgacttatcttatgttagtgcatataaattgtgagtttattaggaatgacaatagagtaatatcaattttcaaatttgtgtttaaaagtaatagttgtatttgatttatacatgcgtaattttaatctcgatcctcatattcgtgtttaaaattctgttcaatagtctatgtatgttattgattttttatttcattcaaaaccttgaattttaaacgagaacaaatatttgtattataaatataaaacagttttgtgtgcatttgatacacaataaagtaaagcataatgagaataacatagaataaatatttaagatagaagtcaacttcttttctaatgtattgttttggtaaattatgaataacacaaacaaaataaatatattaaaaattaaatcgatgtttaaattttttattttaacaatataaaattattccttaaaaaataatataaaattattttaaagttttagttcatgatttctttctctttaaattataatccattgataatacatgcttagttttcgtaagaaattatatgatttcgattagacatttttttaaaattgcctatgttgatgtaattgatttgattaattaatttgtatatcttctactagttggatnnnnnnnnnnaatattaaaattaagagatggaaaaaatgggcccctaacacacaaaatggacccctaacatagattttatttttattttattgtttataataaaaaaatttacttacactaccggcccaaaaacttttgggccctgggcggaagccctgttggccctgccccagggccgggtctgcttaattatctttatttatgttgaattttatgtttctgcattagtattagacaaatatcaactttaattcattgtgtgttaaaattaaaaatatataaacttcgagtacaatcaaagtccttatggattcaacactcgaacttatcattttattattatttggacaaattggtatgtttgccaaagtgttaacactcgacttatcttatgttagtgcatataaattgtgagtttattaggaatgacaatagagtaatatcaattttcaaatttgtgtttaaaagtaatagttgtatttgatttatacatgcgtaattttaatctcgatcctcatattcgtgtttaaaattctgttcaatagtctatgtatgttattgattttttatttcattcaaaaccttgaattttaaacgagaacaaatatttgtattataaatataaaacagttttgtgtgcatttgatacacaataaagtaaagcataatgagaataacatagaataaatatttaagatagaagtcaacttcttttctaatgtattgttttggtaaattatgaataacacaaacaaaataaatatattaaaaattaaatcgatgtttaaattttttattttaacaatataaaattattccttaaaaaataatataaaattattttaaagttttagttcatgatttctttctctttaaattataatccattgataatacatgcttagttttcgtaagaaattatatgatttcgattagacatttttttaaaattgcctatgttgatgtaattgatttgattaattaatttgtatatcttctactagttggatgtggtgtgagtgatttgccattctccttacacttggatgcaacacaacatctctagaatatatattcatattttctctccaaaattggcggaagtgttgagtctgccgcccgattgattcgccaatggcaactgaattttcattgtaccacactatctatcctaccattagagttggtctcagcacgcagatgtcacgtgagagatggggtggggacgtgggctgtgatatgaggtcacgcatatataacacaacgttaacggggtctttggcccacacacacacacacacacacacacacacacacacacacacacatatatatatatatatatatatattcatgcaagcaaattacagtgccatgaacgaaataatgactactatgctgttgttttcttcttcttatgtggttggatggatcagagatgaggatgttttttttgttcctgtccaaaattccgaattccgcgtgtgggggctcaagctttcaaccaaatgtttgattnnnnnnnnnnnnnnnnnnnnnnnnnnnnnnnnnnnnnnnnnnnnnnnnnnnnnnnnnnnccatgaacgaaataatgactactatgctgttgttttcttcttcttatgtggttggatggatcaaagatgaggatgttttttttgttcctgtccaatattccgcgtgtgggggctcaagctttcaaccaaacgtttgattagattgggtcagttccaagcaaaaaagacacacacacgacacacccctctctctctctctctcacacacacacacacacacacacactatagagggagctttataaacaagacttgccttcaacctttacctgctcgaggtgaggggtcaatgaaacaacacaacaaagcaagaaagctcgtggcaaagaaaaagctagcaaaaaaaaaaaagccttaaagaaagctgattacataaaagcaatacctttctctctttctctattatttctattatctctatttcttccttcagttgtgccactatcattcctcatcttctttccatacgagtaaagctgaaaaccccactattgcaacctcacaacttgtactagttttgagaatttgatcgtgtgctaacatatagtcctcaaagcataaaaattttccacccatgttagacaacaacaacaacagtgcttctaattctggtgcaccatcttcttctgatgccgcctttgcattatctgaaaatggggtggctaacaacaaaaggaaaagaagacccgcaggcacacccggtaaaagttttttccttttgtataggggttcaagttttttcaacttccaagcttttttttttaaaaaaaaattcgttgggtttggttttctctccaaagttaatttcttttttgttgttcttgcagatccagatgccgaggttgtgtctctctcaccaaccaccttgctggaatctgacagatatgtttgtgagatctgcaaccaagggttccagagggaccagaatcttcaaatgcacaggaggaggcacaaggtgccatggaagctgttaaagagggaaacagcacaagggcagaataagaagagggtgtttgtgtgccctgagccaagctgcttgcaccatgacccttgccatgctcttggggaccttgtgggaatcaagaagcacttcagaaggaagcacagcaatcacaagcagtgggtgtgtgacaagtgctccaaagggtatgctgttcaatctgattacaaggctcacatcaaaacctgtggcaccaggggccattcctgtgactgtggccgtgtcttttccaggtttattaattagtttctttttgttttattttcccacttctcagttctcacacaaacatacacctttgtgtgttgtttgtctattattccaagtttccatctctcccctttcttgatttctgtgtttgtttttttttgggctcctcagattcagccccctgctcagcaattgtttttgctctcaataatagaagccaagttactactataattgttattattttactttttaaattatatatatataattatactatatgattatggtcaaaccctaaaattctaggtacaaggatggtgcagagaaacaaaaattctgaatctcagatacctttcatgtgaaagatttcccatcttctagaggttattaatattttatttattctagtttgcaacttcaaaaacatgtaagttgaaaattttcaaattcctaagcattatgttatgcatatgaatattacatatatacaccccaatccatctcattcaggccttgtacttggtgttcctgagcagcttttcagtttaagggcagtctatctccaattatccacacgtccattgattacttaagataaatccatatataggagggaaagtttattcttttcattctttttttgaacttatgaagaccccattaattagaatattagatcactctgagatattttattttgttgcactattcaatttaaacatgaccatagaatccatgtattataactagatctttgattagtcattttttttgttgcttcatgcttgtttttaaacactacattaacaggttttcatacatgtatatctttgtttgacagttttttttctctctctagccaattatatattcagagacaacaagatgaagccattacacatatatatcataatctaatctattttaattacctaaacttttgtcctttacagggtggagagtttcatagaacaccaagatgcatgcactgtccggcagcatcggccagagttacaagcacttcaaccagcatgctcttctagaacagcttcaagcgcaagtccctctagtgaggcaaactttagcatagccccaccattgcaaggacttccagtaccgccaaaaccagctgaacaaccagcaacgacagtcttattaacgtcagagatacacaataacaagtccaccacctcgcataacttagaacttcagctcttaccctcctcaataaattctcaagaaaaacgaagtccaaaggaaaactatggcttgaaactttcaataggctcatgtagaaatgacaaagggaacaatgaaccaacagacagagcatgttcagaagcacataggagcccaccagaaagaaataataataatgtgagtgactattccacattggaagtggcaaggttgaaggagtttgcaggagaggaacttaagttggccatggcagaaaaggcttgtgcagaagaggctagaagagaggccaaacgccaaactgatatagctgaacttgagtttgagaatgccaaaaggataaggaaacaagcacaagctgaccttgcaaaggctgaagagctgagaaagcaagccatcaagaagataagttccactgttaaggaaataacatgccacacttgcaagcaacagtttcagtcttcaattgttggagttccatcatcagaagaaacctccattgtgatgagttacatgtcctcagccaccacagaaggagaagcagaatgagtgacatatactgtgaccagaacacactgtgctaggaaaagaaagaaaagacaagctttattctgcctaagggaaagatatgatatgatgatatcacaggaggagtttacatgaagttatattgttcttaattttttcttattcatttttctctttaatgttttcttctctcttgactaggtgaaatttgttttattttaaagaaagttcatattctttatattttttttatcgagatgcagtgtttaggagtttgagagtctgactattgaagctttctttaaaggtgagttgtaacttgtttttcatgatcattatttgacatattcatcatccgttcatttgttgtatgacaattaaaattgaagaccatgcaaagatagctttacccttatgtctaacctaatatatacatgaaaggcaacttttgcaattttattgtaattagagggtaccctatatttctcttcaataataactaattaattcaaaatactggctggatttcacttatttgtggcttaaattgtactaactagaaaacaatagttgttttaacagcaattaatgtagattctaattccggattagagtaaggaaaattgaaacaagagagagaaaggacatatctcttccagggtttgattaatgattatatttggaagtacccggtaaatgtggatttttgggattacacattagaggcaatgcatgcatgtggtgaggaaaaaaagaagaattgtttattaattattacttattttcagaaaaaatggtggcgttaaatgttattaatgttataggagtgaagtatgatgttattgatatatgtcaggttgccttgtacacatggaccctttaggtaatattaaatgaatgatacatgtgacattcatccgggtgaatgatagcaatgggttgggaccattttttttaaaattgatttattttctgtataggaaccaaaatcaaagggggggctaaataaatctttcttttgatgagggaaaacaaaaaggagaaaagggtgaaaagacggaagggtcgttttcattgcataaacgatccttttaaatgcacaggttatgtataataaaaataaaaaacgccatgtttttcagtgccacagttgaaatggtaatggacaggcattcgtcactctcaacataaacaaacgcacacaaggctctaacgatgcacatgcttttaacaggagacgggggagggttgcagtgtcagcgcatagggctggtacagttgctttatcattaattaaggtgcaaaatagcatggaatccatgtcactgtttcaaatttttaaacatctttatcttttttgttttaccattatagatgtagtaaaatacttactgactttttaattggttaatttttgtccaaaaaaatatgaattttttctttcaattttttttaatattccttttatatagacaacaagtatcatgcattaatagattgtaagcattaattttcttttatgattctttttaagtatttaatgtaattatatgtttaagatttatattgaaaactttccattaagttgtagtaaccttacattaattcatatatgcatttggtgtaattcttttatatacatacaataacaatatattatttatctataaaaataaaaaataatatcataggatttgtaataatttgcatcttgtttagctaattgaataaattctttggtatataattaaaccgtttaaaaatgaacatttccttttttttattataagattgacttgaccgtagtaaaaaaaggagaaagagaaaaattataattcgattcctaactagtatttgctccaaaaataaattattgtataatttctcaattcaaaattggacgtttctctttctgaattccgaagggaactttgtgtctttgaaatttcaaagaaagaaaaattaggttgagcttttccttagagtcaattatattattgacctttatttttttgactttattattaagttttgaatttttaattccaaactcatactactttttgtaccatgatagacacgaaggttgcttaactttatgaccaatgcatatttaactataaaatggtattgtattatagttgtaaaaaatatctataaatgttttttagataatagagggaaaaaataactataaatgaacatggatttaaatcagaaataaaccagtatggtagtttcaatataaagtaaaatttacctaatttgtaacnctttgctccgttttagtttttatgttgttaatttatttattctaatatgttgttataatatcacttgttgaatatatgaaactataaagtgtacaaattaaattaaaaatgattgattcttttaagttttaattattttttacacataaatgtttcgtaataattagtctagtcttattatcacttaatagtgcaaaaaattgtagtctaacagtgtatcaaaatcaaattatctctatatataaactttttattcatatttattattatattactgtattttgaaataataataaaataacagtataattataaaataatataagctactccgttataatattaactgttattgttaactatataacccttagctaagtttttaggaaaatgttaattaatattatatttaataaactctaagtaattaacatcatatgaacagaaaaacacatataccaatgtattgtatagttacaagacttggtatatataataataaatagtcagaagaatttaaaagtaattgaattaaaagatgtcaaaatagaatcaatttatttaaaaaccatttgcttacaacattttctttatagagctttaagaatcaatgatttaaggttatctatggtacattcatgtgggtatatcttaattaaagctttaaaatgtatcagaaaaaggagaaggaaaaagtgggtgtggagtttggtaattgttctttgacaattcaaagcaaagcaaaagcgaagaggctagggtgctccaatccaacagggttaccttgttaatgatatctagtgtctgctgggaccacgtgcacctcttacccaaccttttaatgcatccctaccctttttggctctcaaatggtccaagagtctggctctatatatattctctagatagctacggtacaagaattctttatctttccaccagtttttaagagcaatgcgtatttgaagggctatcattctaatatatggcaccttcaataactcagggaactgtcaaaaaagcaacataagtttttcgtaccctgatttatattttttgtttttggctctacttaaggtgatcaagtaccatattaagtgtcttcggaatttcgttctagcatctcgaggtgcttcatttcaacccatcaagagagaaagccttttccgtttggatacattagaacgtaattgatgtttatttcaatacgaaaatatacttatttcttaattttgagctttagaaaaagtgcttcttcttttgacaagctttaaactacgatccaaatacaaggtaagtaaattcaattttaaaaatgttagtcgtgtaatctcctcctatcggatgggtctattttttgaaataaaatatccctctaattgtcatttcttgcccaagccctacgatcgaactcaagacatcgttaaaaaattcaaatattaaatcacttacgtcaacaattttgatgttgattattagtaaaaaattcaaatccataatctgtctttcttttctttctcccttcacccttcacaaagtaacaccattgctgcaacatgaccaacatcgagcctatggaaattgcaaagagcatcttctttgctcgtaaatcttctcaggctaaacatttttttccttttgcttctcactctcttctattttgtaacagacatttttgaattatattctccagatttgtgaatttgacttgctagtaaacctattatattttagcaataaatgttatagtttttttttctttatgtttttctttaaattaaagaattaataacgataacctttttttttttttgcttcacgacaatctggagatatactaaaactcaaacttcattaatttatgagtagagagagtgagagaacgagacagaaaagggaatcaacataacaaaccacgtgcttcatatgcaaataacattagagtgtattcgaaaaaagaaataaatgagtaatgagaaattgaaataaattatttcatagtgttttcgatttctatgaataaaaaaaataaatgaaaatttaacttagttaaaaaaaataattaaaagttcaaaattgttaactgaaaattgagtgtgattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattataggtattaaatatttttttttgaaatagttgataaatataaaatgttagaaatagacatgattgtataattatttttttttataaattttaattacaatttatggataaaatatatatgtttgtataagtatagtttatccttttgatcaattttaaactcttatatttatatttatttaaagatctattattttaattattcttttagttttatttattatatatttttatattgtacgttttactaatattaatcttatacttatacttatactatatgtgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtagacatcatatatattttttatgtttattaattagtataacaataagtatatttaaatatcattaagtattagtgttgtcatgtcatactaaatgattatcaatatcttgaagagcaaaactaaaataataaattagatatcgtaatggttaaaataaaaggtgtaatacagaaaaaaaatctgaaaataatagcgaaaataaaataaataaacctataatatattatttaagaataagttcaggataaaaaaatgaatacagaagctaaaatgctatttaaactaacaaattttaaaaaactttacaagctattataaaaacttatttgtcaaacatttttaatatttatagtcaaacaaataaactaaaataataattaaagtagcattcaaaaataagttagaagctgcaaacataaacttttaacatacttgttttaatcaaataaactcatcataaactagttaaactaatttataaatgactgaaatgacattattaaacatagcctaaaatttgaatttatgtgttcatatattaaattacacattgaactttaattactatttttttttggaaggttataccgaattcaaattcaattctttatgaaattatcttacgacaattatcatacagtttaagaatgtcgatacatcaagtttactgacgttactactacctcttaatagctttaatatgtatactttaattaactaaaaaacaaaatatatatacccatacacttgtgtggattactggacgattacaactttgcatgaataaatgaaagggaaaaaaaaaatgtctaggtgcttcgtgttatcatcatacaaacataaatggcccgcttgaaagagagtgattacagcaatgtctagtcatctactagctagctagctgcaacgatcacgaatccatacagtagtaatatgtcggatagctatatgttgatttctaatatgaggaacatatgtttatatatgtaagaaagcaacttcacaatttaagcaaacaaattaaagaaaacaagaaatccagtaattgttatgatcttgtaactaatccagatttagaagaataattatatatattaaatacattattaggtctaagtatcctctatgttatgatcctgtaatggatccggggtcgtgctcctaaaatagtgctatcgaggaaattagacttctgtgtccgaggtgacactttaggaaaaatgtgcttaagaggtaggaacccagaagggagaaacctcgcgtttattaagtaaccgatgtaggacccgaaagggggagacctcgcgtttattaagggaccgaggtaggaacccggaaaaggggacacctcacatttattaagtgactgaggtcagaacccggaagggggagaccttgcgtttattaagggaccgaggtaggaacccggaagggtgagacatcgcgtttattaagtggtcgaggtaggaacccggaagggtgagacctcgcatttattaaggctttagtaaggcgtcgaggcatgaactcggacgagggttgattttgagttagtaaggtaccgaggcatgaacccggacgagggttgatcttgagttagtaaggtgccgaggtacgaatccggacgaggggtgatcttgagttagtaaggtgccgaggtacgaatccggatgaggggtgaaccttagtttaataaggtgctgggatatgaacccggatgagggcagaccttaaactgaacttgcacaaggttgccccagctatgcatgccgagcttgacaagggagacttagtggcataatttgcacccgacagtgccagagtggcatcagaagcgtgtaacacacgcgccagagtcatttatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcttccctacatctctgcatattttaaataaattaaaagaaaaggaaaaaaagatttaaaagttaaaaaataagactaataaaaaataactaacatcataaaagtagtgagtaactattaaaagagagtaataaaagtttaaaaattaaagaatgatataattatctaaattttgtgaacaccaacaaagaatatttaatttattaatagtatagattcacaaaacatgtttaaaacacgttacttattgtatggctggtagaaatgctgagtgtaataattgacattacattttctgtttttttttttttttannnnnnnnnngaaaataaaataaataaacctataatatattatttaagaataagttcaggataaaaaaatgaatacagaagctaaaatgctatttaaactaacaaattttaaaaaactttacaagctattataaaaacttatttgtcaaacatttttaatatttatagtcaaacaaataaactaaaataataattaaagtagcattcaaaaataagttagaagctgcaaacataaacttttaacatacttgttttaatcaaataaactcatcataaactagttaaactaatttataaatgactgaaatgactattaaacatagcctaaaatttgaatttttgtgttcatatattaaattacacattgaactttaattactatttttttttggaaggttataccgaattcaaactcaattctttatgaaattatcttacgacaattatcatacagtttaagaatgtcgatacatcaagtttactgacgttactactacctcttaatagctttactatgtatactttaattaactaaaaaacaaaatatatatacccatacacttgtgtggattactggacgattacaactttgcataaataaatgaaagggaaaaaaaatgtctaggtgcttcgtgttatcatcatacaaacataaatggcccgcttgaaagagagtgattacagcaatgtctagtcatctactagctagctagctgcaacgatcacgaatccatacactagtaatatgtcggataactatatgttgatttctaatatgaggaacatatgtttatatatgtaagaaaacaacttaacaatttaagcaaacaaattaaagaaaacaagaaatccagtaattgttatcatcttgtaactaatccagatttagaagaataattacatatattaaatacgttattaagtctaagtattctctatgttatgatcctgaaatggatccggggttgtgctcctaaaatagtgctaacgagaaaatcgaactactgtgtctcgggtgatactttaggaaaaaatgtgcttaaaaagtaggaacccagaaggggagatctcgtgtttattaaaggagcgaggtagaaacccagaaaggggaaacctcgcgtttattaagtgaccgatgtagaaatccggaagggagagacctcgtgtttattaaggaaccgaggtagaaactcataaggggaagacctcgcatttattaaggctttagtaaggcgccgaggcatgaacttggacaagggttgatcttgagttagtaaggtgcctaagcatgaacccggacgaggattgatcttgagttagtaaggtgtcgaggtacaaacccggatgaggggtgaaccttagtttaataaggtgttgggatatgaacccggatgagggcagaccttgaactgaacttgcacaaggttgcacggaccatgcataccaagctcgaccagggagacttagtggtataatttgcacccgatagtgctagagtggcatcagaagtttgtaacacatgcgccagagtcatttatatatatgatcattcctcaacgtttctttacagaaacaccatcgtcttcttcctttctttgtttccgccatttgttagagagagaaacttcataacctcttatcctcgaccaaaaccctttgcatgcaactggaaagttgaaaggaaccacccaatagttcggttccaacctctattctttctatagaccaccagatgaagagattgctttcttcaagagcccaccaaattctgtttcgaagggaaagaaggttttagggcgttcaagctttgagaagccgccccctagctttcctaaacgtttatagagagtgtgtgacggaggacattggtggttgtgacctagagggcgagagagagctagtgtaacattcggagcaggtaagctctctgttcttgggagtctttcccttgactgtgttccgccatactccgagagagtgttggttattgtatgtcatgatgcatgtggtattaaaatatgtgttctgcttttactaataacatgtatatgatgcatactatgattatatgttgtttgaatgatgagattctctgaccagtataatagactatgtatgaactttccttggagccagacgtagagcaaccccttgttgttaatggatacagaaacctgagagactgtgcccttaagtggatgatctttctcggcaatatatatacgtatgctataatggtgctgcattcctgatgttggtagcgcccaacggaatgacacctgtgttgcaacatatatgtgatgtattgtatgatatgcctatttgatgctatgtatcatggaaagtgaaccagggggaggagaggcctccaagaaccctgaatttactgagattgtatgtgatatgcgtctagaatataatgttttttcaagttaaaataatcatagaatcaatcataatttggcaataaaggtcttttaattatgaaaattctgatcattatatcatcaatcataatattactaatttatgaaaaatttatagcaggaaatcaagagaagaggtaaaagaaagaaagatcaagaagtcaatcttctctggattctcaagaggatagcacgagatatcgtctcagttgcaccagaaaataaagttaagacaatcttctatgtgatcttgcacaatcagcgctagaatccacgcgaattgcgtcagcgacatgggatttcaggatcttaaattatattgcacgaaattagaagatatgaggggtttttagagtctgactataaatatggactgagagagtagtagaaagggacagaggcctgtgcctctggacatctacatcgagaaatacagtagaacgcataggaggaagcttaaggaatgattgaaactaggtcaagaagattaaatcaagattgaaggagttttcttcttcttcttcttcttccttgagattcttgacccagttttatcttattttatgttattaaggttagacatgaatatttatggctaacttcctttattgtggttagagctaaaaccaatgtgaactcctctttaattggattgatattaatataaattgtgctaattgttttattttattttgttcttgaatgaattattccttattagacttgatcattctagtaaggttctaaggattagggtctacaataggaatgttggagctctaatttctgaaagcagtaaaataacaatttttacattacctaggaatagagatgtatgattacagagcaatagatctattagcttactacttaacttaagagaattgttaaggaattaagatttgtaattgggttaaagagttaaattattaaggaattaagatttaactaatttgtgtaaaaatacatcctctcagcaattagaataattaaaattagtaaccaattcaaataaaaaaggtaggaataaaaggtgaatatgctcttacattttattatttgtaacgatcgatatatttatcgaatgtataatatatttttaacttaaaattgaaaaaattggcgtattcaatcccaacaatgacgtcaaaaatatgatttatgaatgagatcaaattatacttctttcaatctgtgttcagaataagcatttttctcatatatatccattttcatgaatcgaatggtagaacagtagatgtacgagcactttcagcgaaaaatatgatttatgtctatttggatgcattatagcatgagttgttgcaatataagtggggtcaatctcaatacaaatctgactcttgcagtcatcattcaagtggacttttactatatgaaaattccatgttgtattttttaattagacatacttgataatatatatatatatatatatatatatatatatatatatnnnnnnnnatttttaaggtggaaaaaatctttgaactccgaaaatatttataaaatttatatttacctcatctttagaaaaaccaatgagagcttaaacttatgatctaccagtcagataatattaatcttataaacaaaattttatagctttagtacgtactaacatataggaattttgccaatattattcggatgctgtcggtcatcaatatacattcatgtactaaatatcataaaaaaaaatcatctggtgtcttattaaaccttttttttatggaaatattactaacattaataattaaataaaatataaaaataattataaacatttatcactttttatttataattactttcaatttctcctaactaattaagttttcattttgtaattatatttaaaatttataattataaagaaactttttgttatcattttctttatttaaagataaaaaattctgattcacaaacacgtgatagccatcaaaacactagcaacaatcgtagtatttgttctccatgtcccaacctctctctatataaagaaatctatatataattgtgtcgaaattcttcagaactttttctctagctactcaatgattgtatacacatgctattatagttaagaattaatatgtattcagctttcaattgcttttaattcaagtttatcccttggatcataacaattttttacttggtgcatataaaatttgtttttagagagtatcatttccttatgatagaggcccaactatgcataataaatagtcggagagtaagagcaggagggaaacttgtaaattaaacactccaagttataacaattaaaaaaaaacaattattattttcattttaaattacttcataactatgaataaattgttcatctgagtgaaactgagtttaattttcttaagtaagatttcagattcagacattatgaaagaaaaaaatgtgattagataaaaatactctactaaagacgttcaatcaaattttcaatgaagattaaagattaatgcttagcttcaatccaattttcaaagggctcactataaattattatttataaaaaaaaactaggctaatattcatcaaaaggatgttcgatttagtgtaatgaaatgaattgagaatttttttatgttgtaaccatgctagcaatcctttttctcagtgacaatcgaagtagttgtccaagtaatattttagtccttttgaaagattgtaactcacgttggtacaattgcatatagagttgggtatacgagttgtgtgatttatggaggataattttaacttgtgattctcccgaagatatgtggcccattaattgtaagtttttttcaactcaatatgtataacctatgaatttagcatgctaaaattggtctgtggggttcttttttctttttaatatgaatcacgtttgttatgctttttgctaactattatgtgtatatttgacatttgttcttaagagttaagatatttagttcacaagactttttgtaccaagtatgtatttgttatttggtatttggttggaacttttgttgttacccattttgcacttcatcagtatatttgttatattattaaagttagtcaattattaacaagtaaaagtaataactcaaaagaaaaatataaaaaaaagtgcataagtgaaccagattcacccgtatacttagctctgaaaatttcctgaatttgcttgaattattagtatttttcattgtttctctgttaaagaagggcataagtagtgatccattagtggccatatagttccagtgtctacgcttttctatgaatcccagctagtcctttaagtcactatacccaagggttttgtcctataaattttgatgcatttgcactctcaatttcgttggatgccatttggtatatatagatttttttgacttctacgtttaggacaagattcttttataaatggggtaatgacacgggcctaagaagttaaaaggagaggagaagaaaaaaggcgtatgatcatttcaatttagccattgacacatgttttttttttttttngctagtcctttaagtccctatacccaagggttttgtcctataaattttgatgcatttgcactctcaatttcgttgaatgccatttggtatatatagatttttttgacttctacgtttaggacaagattcttttgtaaatggggtaatgacacgggcctaagaagttaaaaggagaggagaagaaaacaggcgtatgatcatttcaatttagccattgacacatttttttttttttttgaggaaattacatttgacacattgttgctgtgaatattttgcaaatatatgtttagctatcgaagtggcataattgagttcttttgtgattttgagcatttgtttgattattgataatgaggaatgaagtgcatcaaagattttcctaacatctttcctctttcttcctttctcttctgacttctcttatcttccttcctgtttcttcgtcattttctactaatgatacattttattgttaacttaaaactaactctaataaaagtatgaaggaaaaaattacaaaaaactaaacgaagaacaaataataaaagtatattataccatactaggggaaagaggtcttccctacatctctgcatattttaaataaattaaaagaaaaggaaaaaaagatttaaaggttaaannnnnnnnnntgtttttttttttttttacatcttcctgttgtctatcagaacaactaatttgttatgaagattttaatgggttgataatggcattcttcttaccggaacatgcacggttgtatttgcactttttttttggtggctggttgtatttgcacttcttaatcatgtaatgaagttgcatattttgaacttaatttcaagaacattgataaattataataattttgtgctaattgatttacacgcacggtagatataacaagttattttgaggacaaaataagttaattcaaccttgtaaaggggttttttttaggatgatgcctgtgtgtgtcatcaatgtgtgcatttgtttatttgccgactggattgtgggaataatactggaccatatgtcttggcccatttccattttcagcaataggtatccactatccaggatcttcccggaaactaaatgtgttcaattaaatttgttagcttcagatcttgaataaacatgaacaaacatccccagaaatatatattaaaaaaataacccaaaaataagatcttgtaaaatctgagtatatcgttttggtaaaaaggaaaaaaaaatgttaaataagatattcaaactacaaaaaagtaaaaccaatggtcagtttatttaaatttatttttaaaaaatacttttttaataaaatgagtaatttttcagttttctaatatacttgccaaaactgtttttacttacaataagtaatttttttaagaaataaatcttgggtggatttgtttaaacttcaaaaaataactttaaaataaacactttttatataaattttttaataaataaaatattacttattttaagtaaaaatagtttagataatcacatcaaaaaatcatagaactgcttattttatttaaaaaaccaaaaatgaacttaaacaaactaacccaatctgtttttaaaataacgctttcaattttgttacctttttttttaaaaaaaaaaacatttttcaaatatttgataaaaatatcaataatcaagaagattaactaagagggttttgttaaccatttttctttaatcagatggtcactcttcagagtacatgcacaattggtccactttgcagttgcatttaacctccactactatgactgaggcacaacacagaaagatggtgatgaaagtttggatattaagatttattgttcatctcacccagtcaatgatttgttaataacaatttcacgaagtcataattcttttgcatataatctttgtgtttgatgaattgcctcaattgattggattagatcacagattaattactttaactcgtttcttggttctgatttcatatgcaattactgcagtgttaatattggttggagttacatagtatcgctgacaataatactaaataaaaacacaataaatgaagaaagaaattgagaaactaagcacaataaactcagtaataacagctgtagagactagagaaaatcttacaagcctcatttcatattttcattcattctcctgtcataactatggacaataacacggttcaagcactgttgctgcttccatcagttgatccaggcataagctctctcagcatggccactacctgcaacatgtttggccttcttgaaggcaagtcatcaacacactgcaaagtaatctctaaatatcttatcatctccttcacttctttggcttctgcttcatcagttccttgagtggccaaaagcaagtcattgtcaattacttccatttgcttcccttcgcagacctttatcttcgcccaccccaccaagttggtgtcaccaaagtcctctttatcagtcgggcgtttcccgctaagcagttccaacatcacaactccaaatgaatagacatctcccttggcagtgcacctgaaactttggtagtactctgggggaacatatccaggtgttcctgctagtgtgctcacactaagatgtgtgtcaagggcacttattagtcttgccatgccaaaatctgagaccctggactccatttcattgtcaagtagcacattgcttgatttcatgtctctgtgtatgatgtgagggatgcaattgtggtgcaggaaacaaagtcctttagcagcacctcttgcaatcttcttcctttcttcccatgtcaaaatgcgtcgatcacgcgtcttgattctcccatgaagcatctcttctaggcttccatactccatgtactcatacacaaggagcctctcttcccccactttgcagtaccccaacaaagggacaagatttttgtgcttgatcttccctaaggtttccatctctgccatgaattctcgatcgccctggcagctcagtcgaatgagcttctttatggcgacactggagccgtctttgagtgtggccttgaacacttcaccaaaaccaccacacccaatgaggctcgctgctgagaatccattagttgcttcaatcaattgtgagaacttgagcttcctcagctgcctctgaaatgttgcgacattaatgcttaggggctctttctctttgtcaattttccatgttgtagcagcatggcatgcttgtaagctattgagcatcttgacttcctcggcctccttcctccttgcgcgcattgcaattgcccacacaattaagatacacacagaagcaacagagatgagaattcccatgacaatgctatttgcccatgttgcagttgctgatttacggtctcctttgctaacatcatcacttggatatgttgtgggttggctgttgtcattcttgcaatcaggcaatggtacaccacaaagtcctggattgttcgcatactgggaagctggaagtgtactcagttgtcccctagatggaatctgccctgttaactcattgttagatagatcaatttgtactaagaatgagaggtttgaaaatgagtctgggatatgaccctgcagtctattgtgtgatgcatcaaacacacccaaatttttgagctggccaagtgatgaagggatttctccggatagctgattgtgagataattcaagaacctgtaaagccaccatatctccaaattcatctgggatttttccgcgaagctcattataggaaagatcaagatactccagtgtctggtacttggtgaacaggcttaggacaggaccagaatagagtcttgtgaagtcacaagtcctcaatgttgggacctgcaagagtctttcaggtcggataccagagaattctagcaaacctccaacccctttacatgagtttccaacatttcttacaaacaccaaagtgtttcctgaaaggatcccaaacaaggattttgctcctagctgcctgccaagtcttggagggatctctccagtgagcttgttgctgttcaagtccaaccacaccaaactgctgcaatttgctagctctgatgatatatccccagtcaagctgttgtttccaagctgcaggactgctaaccttgtcaagaggccaaacttgcggggtatttcaccactgagttcattgcttgtcagtgatatccattcaagattgctgcaattgaacaactctattggaattccacctgtgaggtgattattgttcagtatgagatccttgagattcttgcactggcccaactttggtggaatgcttccttccaagccattgaaccatgctattagctgctcaagattttcgagttctccaagctcatcagggattgtaccattgagatagttcagactaaaatcaagtgtcttcagctgtgagcactttgacagttcagcnnnnnnnnnngatcatatcttaaaccggattatctttaaaggaatggaaaaaaaaaaaaaaacaattcacagtcaaaagcatcgaaaacaaagacaaattataaagcccttgtttggatcagtacaaattttggtaaccgacaattgaggattctaaggaggagaaagggatatttacgaacttaacatctaacgttctcgtttcaatatgtttccgcttgttgaattttacctgaatttcactagtttgaaaataaagatctattaatcagattttttttttttttgaaagtcagatactatttatttnnnnnnnnnnttctagcaaacctccaacccctttacatgagtttccaacatttcttacaaacaccaaagtgtttcctgaaaggatcccaaacaaggattttgctcctagctgcctgccaagtcttggagggatctctccagtgagcttgttgctgttcaagtccaaccacaccaaactgctgcaatttgctagctctgatgatatatccccagtcaagctgttgtttccaagctgcaggactgctaaccttgtcaagaggccaaacttgcggggtatttcaccactgagttcattgcttgtcagtgatatccattcaagattgctgcaattgaacaactctattggaattccacctgtgaggtgattattgttcagtatgagatccttgagattcttgcactggcccaactttggtggaatgcttccttccaagccattgaaccatgctattagctgctcaagattttcgagttctccaagctcatcagggattgtaccattgagatagttcagactaaaatcaagtgtcttcagctgtgagcactttgacagttcagctgggatttctcctgtaatgagattgtctggcattctcagctgctcaagtgaggctgctcctggacataaatctctggggatagatccataaattttatttgagctgaaatccacaatcttcaactttttgcaggaagatagtgaagatggaaattgacctgtgatagcattatttcccagcctcagttcctgtaatgatccaaggttctgaaagattgcatctgctaactgccctgacatattgttgttagatatgtcaagaagttgcagccaactgcaagaagagaaactagatgggattgagcctgagatgttgttgaaagaaagtttgagctccaaaagggtagcgcatgcatttccaaattcagaagggatccagccagtgagttggttgtgcgaaagatccaaagtctgaagtttgtttagctgaccaaaagctttggggatatccccagaaaccatattgttggctaaattcaaatatttaaggctggtgcagtttgacaaagagagtggaattgagtctgataaacggtttccagatagatcaagttgcaacaaggaaatgcactccattttcaggccaaaaattggccctgacaggttgttggaagagaggtcaaggacctgcagtttatcagaattttgaaagaaattttcaggaatagggcctgtcaagttgttgtaagaaagattcacaacaagaagatttggacacttggagaacaggttctcagggacaggacctgtgactccaccaaaggatagatcaagctgtgtcaaactatatgggagattaagtaaagaggtagaatttacagaaaatgaattcaaagacaatttcagaacagataacatatctaaagaagacaaagggtcaagagatatagtcccagcaaggtcattattcccactaatatcaagctgagtaactcttccaagggtgcaagagactccataccagctgcatggattcctattcagcttccaccctgacaaaactccacttggatccttctgaaccatccttttgaacatgagaagagcctgtgcatcagtcttgatggaggaaactgctgcaccctcagtcacaggaaacaaaacagtgatcacaagaagtgtcacggtgagaagaggcaaaaactgaacatggttgttctccattgagaaaacaagccttgtgcaaagccagaacagaacacaggtctgggaagagagagaccagcaaagatgttgcagagagatatagattaatgtgtgtagagaggagagaggaaagacatactgagagtggtgagtatgatgagaatttgttgtggctaaacctttgggaaaaggtgctgctttttgtgttttataaaatttaaaggagggaacgtgagagggaataaggttgtgctgtgtgtggtgggtatgtactcgtaagtttgtagtataattgctctagtgcaaaaattttactttttttggatgatctttgtcaaagaaaatctacctaatcatcttagtaaaatcatttcttttaattcatattttttttatccatataacttaaatttgagacattatctaaaaggttcaaatttaatttcttttttatttataatgtagtatataaagtttttagttttattgatgatattttttgtcaaaataaatctatttaattattttaataaaatctcattttttattcaattttcttgtattcacaaaatataagtttgaaacattatttaaaagatataaactcaatttttatttatttattatgctgcagcgcaaaatttctaatttattgatggctaagttttattaaaaatctatataaccatcttaataaaatctcatctgttaatcatatttttttttctatcaaacaaatttcaatttaaaacactatttaaaacatgcaaactcagtttttcactcctaaaaacatatgatagtattaatatcttggtaaaataatctgtgtagagtagagaactgagagaatttagttaaagaattgatttgacttttggtcaacgatttgggacccacagacaaaggtctgcatctaaagatcggcgctataaaaaaaagaaaacctgagagcttggcctgtgcctgatccaagagtcactgtctgtcagagtgcgtgagaatgtttcccccatttacatagtactagtgtcgtgaaacataatattggcaccatgtgcaacatatctggttgttttctgatttcagccattgtttgtttctcccagtgcttactgatttggtaaataaagtattatattttaaagtttatttagacttctgtctcttttaattatattatgtgtaattttggctttcaagtttttttaacaaattaaatattttattttaaaattaagtttatttatttattttttgttaattttatgtaaaattattaaattataatttttactagaagttatagaaaattaaattaattaaattattttaaaccatttttcatttaaaacccatcaaccaaaacattaaattcaacagaaaagcctcaaattctacattctttaaactctaatcttgcataccaaaattttcaaatttcaattaaatttctaacttacaccttattttatattaattccaaattcatttataaacccccacatatttacacagaaaataagattttgagagttttaaatagaaaaaaaaatatggaatgaacaatttgcttgattttaaaaataaataaatttaattggtcaaagaaaaatttcgagaccaacattatacataatttaaattaaaaggatagaaaatacacttaaactatctttaatctttgataaacatagcaagattgataaataagcaaacaaaaaataaacataaactaacaggttctcactagtataatttttattgttattgatgttgatactgtctgtgttaatctctaccagtttccagttgcatttaaattttaaattatactctgtggactgtatttgtaattgaagtctatggatgagcttatcatcaacgtgattgtttaatttagaatatagtcttgaaaagaatgaaaaatgtattagtgagggccccacgtgttgaaatgtgaaggggaaaaaatgatgatagtgtgttatggttgaatgtttcctgtgaaaaaataaattctaggtagagtaaacaaatggagggccccccaccaatgaagcaacatcaattagctccgtgttaatggcatgggaggtgatgatgctcccttttgcgcctttctcattcattcttgctttgcaagcagttgcatatatatatatatatatatatatatatatatatatatatcactacattatttacaaatttgaacagtgactcggttcaattcaccctaatctttataaagttttaactttttatatagctgggttttgggaccatctcttactttgctacacactctaattagcacattctgcttagtgaatccctgttgatggttcttcacaccaaatcaagattgtgtctgcaagtggtgatttttttttccataggagagaaaattgaattcccattttatttaatgtttcttttatgagtcacttggagaagaatgcaaactagtatgtgagagaaaagacatttaattatgaaataattttacgatattattaaaagatttgacatgagttcgaatcccaaaatagattctttgcatacttaagaataagactgcctagaatactttttttccaagtattagaagatacttaatttttttttttaagatttgaaccaagttgatatttattgcttagatgaaatggattcctaaaaaataatacatttgcgatgtacaagaaggaaataaattccccctctatatataatataatctgtagtttgtagtagaataatgtttagcgatttaactaagtcctgaattgagtttatgaaaataagtcaggtagccgtaggaaacatgagtcaattggaagatcgaataatgaaaaaaatcgtgcacgcgcatttccgcaaattttgtatcctattcaactaaatatctttgccatatgaagtaaattcacagtcaaaatcaaagagaattgggtctaacagaaaatgttactctcacaaagtggcaaataaggttcgaatttttgttgaaaaagatatatatctatattaaacatctgatcatatcttaaaccggattatctttaaaggaatggaaaaaaaaaaaaaaacaattcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagtatgtaaattgatttttttaaagataatacatattatttatcgaaaacaatcttattcaaatcgaatagaattattatgagtaacagaattatctctaaatatttaacataactatatatttaaaacataaacttgagatcactaattaacttgaaataactttgcatcaattgatatttgtgcttaattataagtataattggtttagtttcagctaaaagaatataaggattacttagatataagcttatacattttggtccacttaagtgtgtgtaaagtttattttctaacctgtaaaccaattagtaattcacgtacttatccttgttcttcttttaaggaaaatgtttttatctttttcttttagtcattatgttattattacaaaatatttattgagtttgttaataattaatctctataaaaaatctgacggactatctttaataagatttagttcccaaccatatttttttatcaacatgcttgaatatgagatcttatttaaaaagattaagtttaattccattagcttgaatcaaccacttggttatttttgttcttttttttttttaattatgatagtcaatatctaactttttgtcaaaaaaagaagagagaaagaaaataaaataaaaaaacctttgtcaaaaagagggacctaagtttccgctttcctcaaattagctgaaatgggaaggccaaacacttgcaataaattgagaaaattagcaattccatcaaaagataatcgatacatcaaaggtccgataccaacttgaagcatctaattatagtcttcaaggacaacttgaagcatgtcacattcacagattgcacatgagatacttctatgttttcaattaatttaatatctcttgaatttaagaataatgcttccttaataagaccactgattttgaagctattagttaagagaaaagagggctaataggatctctgtctaattctccgagactttaaattggaggtagctaggattaccaaaactaaaattgataaaataataataataaaaaaaaactaaaatcaaccttccatgagttccattcaacttctctacttttttattgaaccaaggcgattcatcattcatataataaaaaaagctctaaaatataattcctagatttgaatacttgaaagtaacattgatataaattaaagcctaggtgttcctgctcaggtagcgtgtttcgaattctcatggttttggtctcattggagagctatccgcagtagtggtgtatctgaaaatactctgataagcatgaatgagtctttatgctagagattgaaacaacataattgcctcaattttgttcaggtttcttttatatagagacccaggaaagaaaacgttaactgtccaaggatatatatatatatatatatatatatatatatatatatatatatatnnnnnnnnnnnagaatgtgaatttaatcttaatttaactctacaaaatcagtgtaggaattctaattttttcaatacattttttcgcatccaacacttttaaatttgatgtgtagataatagaagagtgatccgtttaatagatttaatataaattttaatattattttaaaacatgagtctaactcaattttataaaattgatttttaaagtaagagatgttttcacctatatactttatcttgatattatctttagttgatgtgaaatttaatcttttttttccaatagatatattggctcaggttgtctgcagttccagttcatcctctgatttgttagtttgaacctccataaactaaatttagactaattgtactttaaaagcttcatgctctttggctaaggttgttggatttgttcaggttgtgagttgtgtgcggtgccacatgcttctcccagtaagtctttgttggaactattagttaatttagaattggaatatatccaattgcacaagggtcagaatctgagtagtcaagaggaacaatataatctactataactgtacaaaaaccaatttaaatagaacctgtatgataagtatgaatcagaaacagatgcaaagagatgaaaggatccgagcctaacaatgttgtctccttaagacaatttgttccctccaattgatgccaaaggttgatgaacaattgtctcccaggatagaacggatcaacgtctgaagattgatggcacttcaaatcaacaacccaaacgaacaaagacaatgcttgaggaaccacagagttatgtgatatgaaatgcactagtgtctaagcgagactatcagaaaagattaactatcaaaactttatcagttttccactttcttgcttcattccttcctattttctgactgtctctgtgtctatttatagacaacaaacaactctggtgaagagttgtcagtaaaccatcgcgactcttggcgatgaaccatcgtgactcttggcgataaaccatcgtaatcgttggttatcggagcggttgagagtagttatttttctaacctttcccaagagcggttataagtagttactattttgaattgttaaccgcctcttattcataactcatagagtttaaacaaaaactccaacaatcccccacatgaataagagatcaattcaacatgactaaatgcatatgaatatgtatgcaagtgtggttcctcggcgagaaacaattgcatcgagataggtaggggttacctttgaaccttctctagtgtaaacctatcgggtatactaggccaatcggtggtcgtgatgccttgaaccgtcaacctgtatggtgtataccgagaaaataggagtcacacaattgcttctctagcattgctcgtcctcattgttgtgtccattttggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggttctgcaagtgttgtagagaatcggccttttttaagttctcattgaagcggccctcacttcacactcacataggtgatttcttgtgatatacctccacatatatcatctgaacacatcagattaagaaaccattaaaagccattatgcttaccctcatatgcactgtattgtcataggaatgagtatgagtttaaaaactccacagtgtttaacagtcgatcatgacttagttgtctttttgaacctagttcgtgggatctccactcatcaaggtagagttaccgcgatgatcaacaattgataggccttagacccattcctttcgacaaattttcaactaactctgtaggaattcctttagttaatgaatccgctatgttctctttagacctcacatagtctattgagatgattccattcgagagtagttgtctaacggtatcatgtctacgacgtatatgtctagactttccgttatacatgatgttcttagccctaccaatggcggcttggctatcacaatgtatgcctacagctggtactggttttggccaattgggaacatcttcaacaaaattacgaagccattctgcttcctcaccggctttatctaaagcgataaattctgcttccatagttgatcttgcaatgcaagtctgcttggacgatttccaagatacagcacccccaccaagggtgaacacatatccgcttgtagatttagtatcattagaaccggtgatccaatttgcatcacaatatccttcaataactgcaggatactgttcataatgcaaaccaaagttttgagtgtgctttaggtatcctaaaactcttatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataatcgtattaacatgtatatctgagacatcggatttataaaccaagaatcgactagcactactattaagtgcataaccaatgaatacacaatccacggttttaggtccgatcttcaaccttttgggtttaggaaccgtgaccttagccaagcacccccacactttcaagtatttcaaggaaggttgctttcctttccatacttcgtatggtatgctctttgtcttcttgtgaggaactctattaataatatagtttgccgtcaaaatggcttccccccacaagttctgtggtaaaccggacgtgattaacatagcgttcatcatttcttttaatgtccgatttttcctttctgcaatcccatttgattgcggtgcataaggagcagtcatctgatgtataactccagattctatacagaattcctcgaaggggccatcatattctcccccacgatcgctccttatcgccttaattttcttgttaagttgattttcaacttcatttttatattgtctaaaagccacaagtgcttcatccttactattaagtaaatagacataacaatatctactgcaatcatcaagaaaagtaatacaatatttcttattacccctagatggtacagttttcatatcacatatatcagtatgtattaaatctaacaattcagttgatctatcaacagaagaaaaaggtaattttgaaaagtacagaaacactgattaatcacacagatcaaacagaaacactgattaatcacacagatcaaacagaaacactgattaatcacacagatcaaatagaaacactgattaatcacacagattaatcgttcaaagtacagagagtagacaacagtatataatacaataagatagaatatactgaactcagattcaaagcaaattgtcttaagattgttggaactattagttaatttagaattggaatatatccaattgcacaagggtcagaatctgaatagtcaagaggaacaatataatctactataactgtacaaaaaccaatttaaatagaacctgtatgataagtatgaatcagaaacagagatgcaaagagatgaaaggatccgagtccaacaatgttgtctccttaagacaatttgttccctccaattgatgccaaaggttgatgaacaattgtctcccaggatagaacggatcaacgtctgaagattgatggcacttcaaatcaacagcccaaacgaacaaagacaatgcttgaggaaccacagagttatgtgatatgaaatgcactagtgtctaagcgagactatcagaaaagattaactatcaaaactctatcagttttccacttttttgcttcattccttcctattttctgactgtctttgtgtctatttatagacaacaaacaaccctggtgaagagttgtcagtaaaccatcgcgactcttggcgatgaaccatcgtgactcttgacgataaaccatcgtaaccgttggttatcggagcggttgggagtagttatttttctaacctttcccaagagcggttataagtagttactattttgaattgttaaccgcctcttattcataactcatagagtttaaacaaaaactccaacagtcttgtatagtccaccaatagacatcaaattcacgttgatttttaaataattaatctttgagtcatttatataagtcttgtaaataaaataaaccgtgggttacttagtataaccgagcaaaagattctaaatgctgtaattgtttactttgtatgtaattaattaagatttaatattgcacattaatatgattcttcgtcaagaatttcagcatgtacatgagagcattgttctctatgtgtattttatctacactcttcttaatatacaaaccctaactcgagatctctagctaccctcctagatacacccaaatcatgattctagtacaggagaattgaagtatttttttagaaatggattcatggtttatattgacttgcatatagttaaaagtttatgcattgtttgaatgatcaataatggaattaatattgatatatcactttggctggctttaggaaacgagatattgaatgacttcacaagtattaaacagttttctacaacaaaaatgaatattgtgaagtaacaatgtaacattcacataacacaaatatctggtcattacgactagggaagagagagagagaagcttactttcgtattttgtgatagtatatcgatattgaaggattgcattttgaccaagagaagttgatgttacgggaaaactgcgtgataattatacttactattattagttttcaatatggtgacccattcgtaattatttcgaaggaccatactaagggatgacttttgtatgtagaaagtgaattattttcggggcacttccataaacttgaatgtaaaagcctgaaataccttgacgcttcgcaggtccttcaacagttccacgaacaaaatttctcattgctccacgagggtaataatgacatggacattcaatatgttttactttctttttttttttttttcattttttggtataacattaaataaaaaaaacttatatattgagttcatgagtttaataattcttttaagattgaagagagcaattaataaaaataaacactacctattattattaacaacatctttaagtattttgcaggctttcgtaattacaagaaactaccagtgtattttttttttttatatataattgataacctccatgtcatttttgaagtatagctaggaagagaatgagaaaaggtaatagatgtgataaataatatgatgagaaataaagaaagatgaaaagaaaaatgaggtggaattgagatgaggcacttctttagtaattttaaaagtatactaacccattttcagttccaaaaccgttttggctcaaaagagggacctaagtttccgctttcctcaaattaactcatatgggaaggccaaacacttaacttgcaattgagaaaattagcaattccatcaaaagataatcaacacattaatattgattaatcaacacatcaaaggtccgatacctacttgaagcatctaatatagtaattttaaaagtatactaacccattttggttacaaaaccgttttggctttgactaaaacactaaaactataatttttttataatataatttaagaatattattatttccctattttatgaaataccacaaaaatagataaaaaaaaataagtcaagtcttatcttaattatattggtgagaggaaatgttaatgatagtttgaaaaaaaaaactaacaagatatgggaatgtgggatgaaattttttctatgctcgaaggctctaaccaatgtgttcgaaggcttcaaacactatcatcgtttcagttaaaaatcctcattttcttagtgataagcgataaatttattgtatttttatatgtaatttgaaatatttacttgatattttagtatattttaagctttgttttgaatcaaattcgttatatttttaatttttaatatattttagataggattacgattttagaaggttttaatatgattttgagttttacataaaaacaggaaaattttataaggtataggcaatttaagttagaagagtatgtctcgcttaagtgaacaaatcacttaagtaaaaagtgtgttaggcagtgtctctataaactgaattaattcaaaactgagataattatggagatatagctcaaaaataaatgaagaaagtcacttggaagataattggaataattaaaacatattatatcagtttaagagataatttccttatatagattatattttgtaaattaagataatttgtctctattaaatatacatttgattctataaatagagagacataggcaacaacaaaaaacctctacacaccacctttcactaaaaaatcctcttatcttctctcttcttgtatttcatgagtaactagtttcttttttaattaggaaaggaaaaagattgaaccttatttgatttaattttctcacattaatatattgtttgagtttattattcaccttctatatgcacatctcatagatgattctagaaattgacatgcactctgacaagcctcgttgaaatccgaactaaatcagaaacttaattggggttatctctattaatagaataattttggttaagtctcactaattctcaaatgataattttgattgcttgtgttagtttgccaagggattgagaatcaagacaagtgattagggataaaatacatcactaatttggggatgaacgatataacgacatagaagtgtgagtaattgtagcaaataggatgattttgagtacaatcttaacatctcaacgttattgttccttctacaattattatcgcttcaacaaataacttattaacttttcttttagtttatgttgttgaatattcagcatattaatctctgtagaaaaatatatcattttattttctgttttgattagttttagttttaggcagtttaaaatatagaaaacaaaaaaatatctttattcgaaaggctttaatttgaatattcatcctgtactattcctttggaggatgatgacctgagcttcatttgagtattataattaggatttgggttacacttgaccgatgtaaatcctaacgtaatcaaaacgttaacacatagataataacaaaggtacaaagaaccttctcttttctagttagatgggctcacatgaagaaaatttggttgcttcttttttgttttcatttaatcatctaatatgaacaccaactatttgctctaaattaacttctttcttttaatttgttccatatgtttcttttattataaatttttcacatgaattatattcactcatcaattttaaagcttctattcaaagcaattacgaaaattttatcaaaaacgaatgaatatttctcaaagtgagagatttataatataataaatgtagaacaaaagagagaaggaaatcgagttaacttgaaggaagcaactggtgttcctattttttaaaatgaaaataaaagaagtaactaacaaatttgtcatgacttgcaccgtaattgttgtcattttaattttcaggctttgttgtagtttgtaacattattcattgtcgatttctcgataatttacacattaccacactttactcaattcttctttggaaaccaatactagaatttttggtgtgctttatcttcactaatatgctttagaaaacttttcagaaagtcatttatctcactcacctcatctcctttcttgcctaatagatcaattaagctgttttgttgtttattgatcaatcacgttttactatttttgtaagaaaaagtcgattcccatctgatctaacttctatttggttcttcatattggtatgacacagatgcaggtggtatgagctgcgctactaggtttgtcagggtaaaggttgggcttttgggtactactctattgcagtagcatttcctacgctttaatccagttgacaagtagacagtcataacaaaagcattgagagtaagcaaaagggcactagtgcaggtaattagtgcactacacatagttgatatttgttgtttcccggtacaatgttagctcttatagaatttgttagcatatcttcaggaagatacatagaatatggatcactccatcattgataaatttgttgattgtggcctttgttcccttgttacaaacagttgaacttgtgattatacaccccctcttcaaatgattgtttttgtggcaaattagtttgattcagaaagtgccagaaaaagcaaagcgagtgcagtagcaatttgtgggtttgttgcctctatttgacccaccaaggcatgacattgctgagaccataagacgtgcttttatgactgttgtcttcttctagacgctgctcttccatcgaatttcttcacggtaagataaacatattttctttaaaatagcagaattatttttcaggcttaacctctctatacatgaaaatactggcaggacatatttggcgtgagatctatcaagaacaaccatcgtgagctcatagaagttgtttatcttcaagtattgtaattcaggctcccattgctacacagtcaaggagctggacttacattgaactgggtttgttttcctaatattcttactcttgcatagaaacaacacattaatgattgtaggtattgtgttttatggattatttcttagatagccatgatcatagctgtgtatgtgaattggggctttgcaaggattgaatggagtcaggcaggtgtcatttggctctatagcatcatttaatttcttcataccattggatatattcaagttcatcatccaatatggattaacagacaaggcatggaaatataatcgagatcagggcaacatcttaatctctgccaaatttgttgctcaatctgactgcttttcagtgttgtgatgcaggttgctttcacttcaaagaaggatcatggaaaagagggagagagagagagagagagaagcataagggctgcagctcaacatagtttacatggtctgaatcctcttgaaatagacaaaatcttgaatgaagaaaacaactatagaaaactgtttgaacatgctaggaaatgtgctgaagttgcaaggtaatgtacattgtccaggatacctttatctttgattttcccccccttaattaaagccgaatccaatccagaatgtaatctatttggtttgcaggttatgggagcttcacagtttacacactaaagggccatatcaagtctgttgtgaaactccagggacttgacattgagacatttcagcagcaatacaccgttagagtgacttaagttctgcgcaaaagagaggtttagaagacaagataaaagcagcacttaatctttggaaattgtcattattatttttcacctcatgaatcatgatgacaatgaactgtgatcttttgattccttttagaatttgtcttcaatattttgttatatccttcttcaatatttttccccggcgagagagataagacttttttgtttttttgtgaattataagactttagttactgcaaataaataaataccaaatctcagttttcttgactacgcttcatcaaaatgcgacttcctgaattaagtacccattagtttgctggacttgacgtgagattactcaaacaatgaagcagaatttagtttatccctctacccccatcttattagatattgagttgcagaaataatatgttttaaaccggtcatttcatttcttcatgctttatacatatttcacacaaacttgaaacatgtcccaaaaattactattcaacgtaattacatttcatttttaattttattttatgaaaaaatacatttatatatacatgctaagaccatgtatgggggctgatggcttgaattggtgaccttgaattggatgttgtgtacatatgatgagaaacaaaaggtgattcagatgtatttggatgacttttttaatttaagaatgcaaatataaagtccatattatgggtaaacattttgaaaattgtgataacatatacccataaactcatctttatatatgtgtgcctttattattttcattcttattaagaggtttggagtttttctataattatatgtaattagaactgtaattacagggaattgtcattcaatttacaaacattattataaaaaaattaaatgatgatctaattttaaacaaaaaactttaaacattgttaaaattgtctaaatattaaaaaatagtattgacattgttattattgtcatatcactaatttcattattcaaaacgaaaatgtttgaaaattttattaaatgaaagatatttaaacatagaaataatattaatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattttaatttattttgagaaaaaactaaaagtaagatcatttactcaataaaatctaattgacttaaatataaaatatgattgtccaaatttaaaataaagataatttaatattaaatatttaaatgtataatattgctatgattatttttattttatattatatttttcaacatgttaaaataaagacaaataaaacccgacatccccgggttaggaaaaactagtatagtacattagggatttgcaatgttttttttttaaatatatatatactttttacataatgtttgagatcaccaatataaaaaatgactttctatattagttacaacacaagctaatgcaaaaaatgatttttttttatatcaattgtgactaaaatctatgcagaatacctctatattaattaattatctttaaactagtgtgaaaaaaaaatttatattaattttgaaatcgatatagaaattattgattttctatatcaattgatcatatatctaactattcacaaaattatttagaatataaaaaaaattgatgttaaaagcctttaaatttttgtactagagttgagtaaaaaagatattggaggtgacaagcttataaaatcataggtcaaatatgtattgagcaagtctcaaagacttgtcagttattaacgggataaataattcaagttgcctatgagtatgcttcaactttaggcaattgtgtcaacataaggtaagcgtcattgctaaaacggaagagtcgagactgtcacatattcatacagaggttacttctagttgccttccactctctaccaaattaatcttaattggaagtttcttgttgagcatagtcactttttttaggaaactaatttacacatctatacctatatgttgctgtgtaaattggagcaattcttccttctaagctttcaaacagttcatgaataaacaaattcaatactttattttcataattcacttttactttctcttttatgtgattgcatagaaaatttggcatggaagttggagaagcttgattgattgagttggttccaatgtgccaccaagcttaattaacatgcttgattaactttgtggaactgtagatatacacggtcacaacaagtattgcaatgcgattatatatttacctgatttatttcaaatctattcaaagtacttagtatattttctcattgagaggggtcccaaagggggtggggcttttgatgcaaaatatgttaaggagtaagagcaagaccaagttgtcgtccatggcacgccggggaccgactgacatatcacttcccactaatgggtttttttctttctcatcattgattgtgacccaaaagtcatattctcttttttttttttttttttggtntttttttttctttctcatcattgattgtgacccaaaagccatattctcttttgttttgtctctccaatcccaatattttctctctaatgtcattttgtgaatctttgcaatgaaaatgtgaccatgaatggccttttcaaatgataaaaagataattcccttggcgtgtaagacttaagtcccttgttggatagtgtttgcgctctttatggcttttttccatacatatcacattataagtttgtcatactcaatcatggtataatatatctttgatcttggacatgataaaaatcatctcatgtatacttgcttttattttgttttatctacttcaattattgattatattctcacgttgacttcccttttcatctgtttgaaatttttctcacctagaaaatagattgatataaacaaaagttaaaaactactttggcaaatatgtctttgtatggagaaattataggatggtccagaagaatcatcacgtatttatgattttggtcaatttcttgactattggtttaaattttttgttgcattgaaaatcctacgaacattgatcataagcatggattttggatttatattttttaatttatttgttttgtgagtgtgtgtgattgtcagcaattgttaactaccagggtatggtatcaatgtctgtatgtcatcatttttaggaatataacagaactaaaaagcctcgtgtttttgaattggcaaccttctcttattacaaaaaggtaacaaagatcaccagaaaaaaaaaagggtaacaatttttttgtttcctttagtattactgtgaaataaacatccttttgtctccaattgatgcctaaacatgtgaagagatagcgataacccaaattattatagttgggtccaattattatttagtgtctcacaaatataattctaactttttaccaaaaataaaataaaataaaatataactcgtaagaagtggataaaagaactctatttatataaataagattgatcatttctaaatattcaatcagactgctaatttcaaagcatcttgtataataactgaagatttcttaaatgctaatgaaattggattcatcgatcacagtcaaaaggtattatttgaataaaaattggtgatcacattaaaactatctaactttatgtgtatagattaatttcttttagttcagaacaatcctcctgttttcccgctacaaggctcacatgtaactattgtaagtgacataattgagtttaatttttaagtttcgtaagtgtaaatttttttatggtatcagctaattaaaaatcataatagatatcaattttaaggcgactattattataaaagtcggtaccttatcatattaaatatctttatacttcaatgcaactatctcgttataatagtttgtttgactattgaccaaaagacaaagggagtaggttcaagatatatgaaatgtaatttacaacagtttaagaacatattgtaaattggttcacaggggaatccagagtacagagaaaataagatctgcctatgtgaacaaaaagctaaatcatatctagaatagggattagggacacttgaaattcaaaacgggattctatcttataacaaaagttaaggggctctataccacattattgcaatatgatttcagaatttctacgagcaaattgggggaattttctttcgacaaaaataaaaggggagctgctttagctaaattaagagaaaaacaaaataaaaatagtctctattttcttggcttgcaacaattaccacaatataaaagttggttcattgggaaggcaatatgatggccttttcatatatttgataccccacttggttactaagtgacgaagaagaatcatttatttactttacttaacgtaaagctcatactttttgtcaaatcgttttctccttcaccatgctttaaacaaatattactttggtcatgcagcataaaagaggcaattggtggatatgccactcagaaacataaatatactattcataaaaaaaaaaaaaaattgtgacaagttgacagaaactatttgagtggtgacaggaatcattaattagaatttgattacacattgacttcctgctacaaattcctagagttggagccaattcaaaggaaattcatcaacatctttgttgagtttttctctctgttattgttgtcctggagatttcagactcacataatcctatttatttatataactaatttgagatagattataacgaaacgaataaaaaattgtatgtggcttgtatttcagaaaatggtttgaacccaaaattaagcatttgttaacttaaatttcaataagggcattcaaagatcaacgttcttatccacggaaaaaaaattgtcaagttgagatttattactaatagatttaaatgaagttatttctatgaccgagtaagttatgcagcattcacactaaaaaagatagattttaatttcttttttttttcttgtcaataattttggtatggtgttagaatgtacatgctgaacaaatataaaaaaacatattaggacatataaaaaaattcgtacaagctgaaattcttaaatcgttaccccttttcttttatttcaagaactagagacacgggtcaaaggaatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttttttaaaagaacgtgttatgtaagttctacttttatttacggaaatattttgtcacatatttcttccaaacacaaaaatcttctgacataaaatgagttgttttgtttaaattcccagttattactcaagtttatatttggctgtagggaatcttatgacactagtgcttgtgatcttacaacttaataaaaaataaataaattaaaaatcactttgtttttatatcattattacatatgaattatcaaacttcaaaacaaatacttgcataaccaaaacaacaataccctttaatataatgatataacttctttttttaatttttcaaatgtgtcctttatagaaagcaattttaacaactaacgcgttcatcaacaagagttagaactaggaattgtcacttggtaaagactttactttagcattacacaccagaattctttttaatggataaaacgaatatttatactatgaaatgagtttagaagtgtttactcaattcatgccaaaatttattgttttatatttgtataagtgttgaaaacagtaaggttaggttacttcaataaaaaaaagcattttcttattcaaaacatcttttagctggtatagctagacatgcatgtatttgctgactagaatatatttctacaatataaaccattatagaatatacctaactaggtcagtataatcatattaaatggtcattttcagagaagacattcattagtacaagctacttcaaataaatttcagtgactacagaaatcaaagattaaatcccatggttccaaaaacttcctcaagtgcaagcctgtgcagttatagagacagcatgacaccaattcatgaatggagtctaggcttctctaggttccaggtacacactatataacctaccttatgacagcaaaagaagaaaaaaaaaataacaaacccttttctcttttcctaacagaaataatatgaactttaccaacacgttcaacccccatctactcacacttgatggacctgtatatgtgacgaacaaagagcagggaggcacggaaacctacactaccaagcatgaggaaaaagccatagcagatgcaggccatgtaaccgaagaagaacgaagtttgcataaaaccagacatatctgatcgtgcatagtagtaatacaagcaatagccgtagatgaacaagccagttgatccaccacaaaggaaagacctacggaaaacacaagccaacagcaatgtcatccagttgaaagctaagtgctcagggtatattaaaggcttaaattccctctatcttcaaaagattcataacatcattgttaagaaaataataatagtattggctaaaaaaaacacattccagcagaaaaaggaaaaatgttaaggcaataaatggcatgatattgtactaaacccttaatattggactaagaaagcactttgtttacaaagttgtgccaatgtcattcacttaagttttcttctttgccgaatttgaacaaaaatgtttttatataggtttaggcataggccatgcctggcattgcccatgtgctcagatggcccaaacctttatagtaggcccaaattagtttaggtttgatcctaggcccaaaaatttggctttggtccaaaacctagccaggcaatgaatgcaacagatactcgagaatgccatccaaaagaaaaatagtaacaaacaatattttgtagttgcatctccatatgatgagattgatattaaggcaattatagaaaaaacattattctttataaatgatacactagtcctagaaaagctaaatattctaaggtacatcccttccattacaccatcaacaaaaatcttaccaatgccgccgactagtccttaaataggtgggaaaactaattttactatgattgcctggacacttatctgcttgtttgagtagagacagaatatgactagtaggaagtctatttggacacaataaagtctaatacataagtactttccatctattcaatcaaacaagaaacactattttattctacaaaaactctggtataagtcaactgagttaatatacatgattcatagtcattttacagaaaattgacagatcaagtatcaacatcaacatcaacaacacctttaacatcaagtatctatggtaaaaactcaaaaatcccaaattaaattgtagccagttgatgaattgaactagttattcagatagggtaatggaaaggcagaaaagagagaacaaggacaaggagaggggaaaaaaagaaaggaaactggcaacttaactcaaagacataactgagttcaagatccaagtagatgaccttatataaagagtccacaatttacaaaattacatgcagaataactaacattaaaaaaataaaataaaatccaaagtttaaaccttaatggtaaaatctaaagttatgttcatatgctgatgaatgtcatcacatgtcttccactccttgttgcgaacttgggatacccatatcaccattgttaattaactcaatatttttttgaagagaaccaatgaggaagaagggatgaggatatgagatggaaggaaatgacccgctcccctcccaaacaccattgagagaaccaatcacataaacttcctaattcaccctcaaggccttctaatctcagcaaaactcttatagatatacattactaagattacatgcattaaaattgtaacatgacaaagtattgtggcatcttaaatattccttttttctggaaccaacactgtcatgaacatacatttgactaagtgggacaaaggccactaaaactatgtaacttaaatctaaatattagaatatatgaagaaaaaaaatccaataatatattgattgtatattagagtaatttagtgtatcttagattatcaattacgattagtttccacaattccttattatctctttggattggtatccttatttcattatatttaaatatttaattattagtttccttattttagtagggattatgatctaatgttagtataaataagtataattgctttatattttgtaacaaatcatatcaagtctatatcaatttcagagtatccagtctcaattatctccttttcctacaacactactaaaaggctttaaccctataatttcaacttggtattagattggtannnnnnnnnnaaaaagagagagagagagagagagagagagagagagagagagagagagagagagagagaatgccctacatttgttcaaccagaaaacatattttctattttgttaatccaaaatgccattaaaagcctgtttcacaagttatgtcaatagattatgatttaagattccaactaagctcttacctcaaaatgaatattaaggtattagcaatataagcgatcatttccctggagaaaaataaataaaggatcaaaacacaattacatttgactacaaaatataaatacagaaaatgaggagatttcatatggcaaatctaaggtgtgaccttactgcagcaacaatgcatatttttttgtttagaggtttcatatgattgactgttttagcttaattagagtcatattttttgttttcttatgtctttatagagatagtnnnnnnnnnnagggattatgatctaatgttagtataaataagtataattgctttatattttgtaacaaatcatatcaagtctatatcaatttcagagtatccagtctcaattatctccttttcctacaacactactaaaaggctttaaccctataatttcaacttggtattagattggtactgtcctcctccatgacctatctcaccactattagattggagaaaagaggaaaggaaaatgaacaacaacttttagataatagtaattataatttaatattatacttctaattttaaatattttattcaaaaaatataagtgtgaatatagtaaagaatttttttgatactttgtggacaaagtagtgaagatagagaagttatttctcgctttctaattaatagcaaaaatataaatatgccaacaactactttttaaaacttccccctcttttcctagccattgagtcattgaccatatcctttaaaccaaggacaatatgaaaactaactgaattactaatataagagtagataatgtatttctagtgaaaatcacattacacaaactcaaacaactatagaaggtagcaataacataagttacatacctccaccaccattcatgatcctcagcagcaagttggaagtacgtcaaagccacagtgatgaaagcagtgacaatcaacagaataatgaagacaatgaagagtatgctgtagatggtataaattctgtggccccatacactagcaaaaatgtagtacagctctatgtagatggcactaaaaggaagaaatcctgccattgccatctggggaatggtactcctgtaccaaggcagaggtggaatctctcggggatattttgtagtgcggacaggtgcttggaactcagttttgctattcttacctgcaataccacccaacacaagcaatggtgaagttaccaatgtccatattaggactatcaccacaattgtgccaaatggcagggcagcagttgcactataagcaatggcaacagtgttaaggaaacagaacatgaggaatagggggccacaaaagaggcatcctgtcaacaataagttcctaacctgcccacaagaaaacaaatgtagaaatcatttaatttcatttcataaaaattatataaattaatacagtcaaaccatgaacaccaatcaatggaaggagtccatatgtacccaattagtcccttcaagttgaatatagaaggaagtagcagtgtagccagcgatgccagatgtgagagcatatatgaccaccagtgcagtaaataaagcacctcggttataaggataaaacacaccaaccagtgcaagcataaaaatgaagatcgtactgcacgagcataaagaaataaagaatggcattcattacaatatagagagaaaaaaaaatcaacacagggagaaagagcaattagaagattcttacagtgtgaataactgagtaccagaaccaagggctgctgaaaagaaagacttgtgctttggaaaccggaaaacatcaccatgaatgtacttccatcctgtctcctcttgatcatcagcagcttcctcatcttgggcatacctggagaaaattacagacaaaaacaataaacaaggggtgataataagattaataaaataatgttataggcaacaagatgactaactgatgatagatgagcaagaaagtcatacttcataaagtcattcttcaatacacgcatgagaatggttgccagaaaaccagtcaaaagaagaactgttacacaggagtttatgattgagaaccagtgaatctccaagtgatgtggcaaagaagaagactgagagtatttatccattctcttctcaaaaggtgtatctgtttccttccattttgcagtgtacatgaactcaacatcaacatctttatcctcagtcaggtccaccacagaatgaggatccattcgggcactgatttcaatcactcgatctttgttgtacagaatatcgaactgaatgtgcttgtaaagaaaatacctatactcactagggtcagttttcccttccttgtcaaccgtcccaataaatccccagatcggcaaatcatcataatacatctggaaataatagtccttcttaactgcttctcggaactgagcaacttgctcctttgtgagcttcctcttgcatacaaccttagagtctttctccttcttgaaactaagttcgtaaggagcactaacaaggcgatcgccattcaacacctcaccgagggcttcagtcttttctttctcatgacctgccattcagatgtactcattttacaatgacatatcaagaacccataaaagtataaaaaaggacgaaggaatatccactaaacagagctacaaattgacatttccacgactagagatttcattaaaacaaaaacacaatagcaacccagtattctgtcccttcctacaactgaaacaccaaaactaaactcaaaacctcacatgctaaaactacatcacgagttatcacactcttgtattaataactagagaaagagagagagagagagataaacaactttgactaaatcaaataacaaagcttcaattatggaagtaataaataaattcagatagttagttacctgttacacagaatggcaggtcaaagtatcgatacgtttcactgaaaccaaccaattaaacaaataaatgagaaaatcagaaagacgacaacctcgtacaacactgacgttgcaatccgagataataaaaacacgaaactgaaaacaagatcagattttgacgacgacccagaatctaaaaagggtaaaattaagtgttagagaatcatgggtgtggttgggaaatgggatctcaaggagacgaacctggggttgtgaaagggaccaactttgttggcgtaaagaggaacggattctccatccttgtaacggtgatcggaagcgtcggatctaacgtgggttccctgaaaagagatcagaatcgcgagaaccaaagccaaagtgcttctacccattgccgctgcactctcgttcgttcttcgcattcagatcagatggataaagaacaagaaacacacaaagacaataagcaagcaatttattcagtacaaatttctgaaggaaatgacacagtttattttttaaaaaataaaaaacgaagttttgtcttttttctttttcttttcccattttataaatctatttttctctattttttatatttgagtgtatgcatggtgacccattatatgttactatagtctctactgttttacttggcattagcctccatcattcattaaaaaaagaatactgctatttatttaagggaattttcaagataacaaattacttgttaatataactaattaaatttaaacaagatattaagtttttaaatagttgtatctataaataatttgtgcatacaaaattatttatatatttacataattcattcataattaaacactaaaaaaatatgaatcttgatgtagtttcccttaaaattggctttggtctcactgtcaccatgattctaacactcaagtcacaattttttttttgaagaagactcaagtcaccataagagacagttgaagggtgggaaaattggagacacaaaaatttgcttccatgtcttactgtttttatgttgggtttgtcccacactagtggtggtgattttgttggtaaaagtaaaactgcatgatacgccccaatccaatattatgtgcaggaaattgctattcacaccacaaatttcactaaaaactcctttttgtagtgaatcatttattaagaaaaatgaatatatataattcacagccatatgctttaaaaaattattcccaaaggacctttttgacataaatacatttctgttgtataaaatatacaacagaaacttatttttgttgtgtaaggggtgcaaaaatacacaacaaaaatactccattgtatatcatatatctatatatatatatatatataaggaattgtgatttcactttcattttactttttatagcaaaggattttcgcttaagtaggagtaaaacaaagtatatgtaatacaattttagcaagaaataagaagattttgactctggaagtaaatttgagagagaaagtcataccacatgtaagtttaagtatgtaggatcaatcacataagacagatggttaaattaataagaatgtcatatataatacaaacagaatagttaaatggagagaaacatggagaattatttgtgctcctagaatgactaccaaactcaaatgcattgtatttctataacatttgtcggtacaacttaaaacttcaagtaataacacccatttaaaaatacgtttattgttaataaaatacagtctcgtggtctattctatatctatttgttctaatttacaatgttggtgatatagaggcaccatttattgcacaacaaacattaatcactaaagattcttcaccctcaagattagcgaaaagatagcgtgcttggtgagtcaatcctcacaataatatcttcttcttcagcaccagaatcatcacttgaattatctccatgatgatgctgtcttcgttctgtgctttgtgaaggtggatttgtaacatgtcttgtgacctcatggaccttcttggcagttgcagctccttctgatttgactgaaacaagaggacggccttgatgtgacccaatggttggataggacaagctatgaagtggtctaccataattggttaacaaacttctactccggggagggatgtccaccttgaaactgagaattaattaatggaaaataaaataaagattaacatttctggtgcaagccaaataacataataggaatttaagtttgttagtgagaataatttctcccaatgtctttttggtctccctccttcccttttcaaaattgaagttgatcatttgtaggctctaagtttgatttatttgcagagattgattgctagaaattttaaaaaataagccaaagctcttttctaataggaaaaacatccaaggatgttgatcaagctctaatcctactcttctttgcaactgtacatgccacaaaactggaagtcaaaaagaaaacaagatgcacactgaaaagttaatagaaagcacattaccataaccttgtattgaacaagcttcaaatggaattcttaaataacaatgtagatatctgattgtataaaaagctttaattaaattgaaaaacatccaacaatcaagcatagtctcccaaaaattttttgtccttacagatgcagtagtgtcttataataatgtgcctttcctttacttttaacctaaattaatgaactgtaaaaatttagaatgtttgaagcagttaatcaaacagtaacaaggtagagacctgatgaggttcctcctgttgtaaatattaaaagaattgacacaaataatgaaatactattcaagttaaacaactcttaaggactgaaacaaatgcaaaagttcccataccattcagaaggcctactcgtatgtctttcaaattcataggatctaggttactatcattttcaggtgcaccatgagggtgaacactttcaccttcaatgctatttaagcaggagatatatctcttcactgtggaccagtcagcagacccaagctcctcatcatctccaggttcaccaaaagcctccaatgccttgttcaacatttcgtactttgtgaagtcaaggatccgtctctgttattacatgagcaaaacacaatggccagaccaaatataagtcagaaagaagagaaacgggtgatatagagatattttcatttggaatcaatttacaaacatttatacaatgtagaagctttcctttgtttctcacaatctatacttattcgtgtataaatttatacaaacccaaatgtttatatagcagttatgaagcctaggtactccaaaaatggcagagtaatggcacacccattaggagatcatattttcttgcaatgaaacttggctgcattgctgtttttttcaagcctccttggctctctaatttctattagttgctctttttatttttactttctgagttattgaacaacaattctaaatacatcttcagtgctatatacaacagtgaattatatggatataagatatttttcagggtattttcttagatttaagagagagagagagaccaacaattaggataaaagctgaagacagtagggaattacttaaaatatgagatatcaaagcattatgtctctcaaaacgacaacataagttgaacatagaatatcagaaaaaccctgaccttagcagctgacaatttattcatgccaaggtagtgtaaaatgaattgtgtggttgaaccatttattataaatgttaaaaacacagttccaccagttaagaaaacaaactacacatataattgagtcagtttataaagacaactaagatatcaaggatttcagggttgcaatgactttacataattttagcaaaattgctgacatgctcttgataaggataatcatagcttttgggattttagccttagtcaatcccacaaaactagcttgcaagttaaaagactgcccaagctttataatctctctttaagtcatatctctagtcaatgtgggactaaatcatcacccttgattgcagcccctgaacagaccgcaattcaggtgggctagggtgacctttaagggaacattccaacacataaaaacaactgctaatttctttcacattttccactagcaagtattcattttttttcttctacaaatcctattgtattggaagatgaatatatctcattattcccaattcataaaccattattcctattccattatcagttatattttatgactaccatcatttgccttttagctttggttagttagtttcattgcttggttaaaggagtttaccatattgccctttctctttttaagttcccttaaaaataaaagctcttccttttatcagaaaaaatctaaacagcagctatctcacttgtaaacaatgataaggtacaatgcccatgaataattatatctataaagagggctataaatatgcatcattagtccatgaatacttgccttaactgataacgagagtgccaaggcaactgcgcctcacaatcctgaccagatgagaataatagcttctttccaattcaaaccatatccaaaatatcttagaaagggaaataatgctccaactacaatgcaccgagacacttgaacacatgcatacagaagcaagaggtggatccatgatgttcctaaaacagacgcaatacgttgcagtcactctttttatactttacaaacatgagtacttaaacaacataaaaaggcaagcgatactggcaagagcttctagaaaacgtaagcttatcaaagcatcgaaattaagttatcgctgcttctttgagaagagcatgatcatcagagttatttctttccaactttcataggcctctctcattgtataaggtttgttactagagagaaaccaagaactaaaacgcaaattattatcaatttcaatccttagattaaaatccttatacgctgagaagatttctgcagttgcattatgcaagacaacacggatatatgattaaaagttaacaatttgaagaaattctatcatttttattttgaatctgcatggacttgccaatcccccccctccccctcccaataatcgtagatacaaactatgaaatacagctttctccagcataattaaaattcgtcagcacaataatacaagattgcaatgaagtcccataatcccattcattaacattattttcatttacttgctttcaatatacttcatggtacagattttccccattaaacaaaaactaagaatataatccatggcatagtgcaaaaaataagagaatatatgaagtgattcttcaagtcatactaccatgatagaaaatattgttgtcaccaagtactccttcagctataactccactgcaaaaagatatacgaaaatattaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaattgttcaccaaacctttaaacaaactttttggttgataaaaaaaataaaaaatagttgaaatgacacactcatgtagtaagtaacataggtttattaaaacacggtttgaaaaggaaactctagatatataaatggtattcaactcgatttcattttgttattcaaaaaacacctacatttgagctactacctttagaccataaaataacttttgttaattgtgtgaggcatctccatgattagaaatataaaacagaaaaaaaaaaaacacaannnnnnnnnnnnnnnnnnnnnnnnnnnnnnnnnnnnnnnnnnnnntatcaagtgtaacactggaaattaaaaaaataaaataaaatctcccatagaatgaatttagtttatatgcacaaggacaagtgaaaaaggcataccaaaactgatgtaagctttgttgactttcacccttaaaagctgttcttgcaaatgcagaatagaacctgtagaaagatttcaataactagatttccaaaatgggtaatagacatttttttactaaaggtcaatttacattcccaaagatatcactgtcaagacaacagagacacctgaaccctcctgagccggcatcctacttgtataagtattcataatacaagtataatctctaaatttactaaaagatgaattcaagtttgaagggtaattacagtgaaataagcaatgtagctaacagcaaatgtttgaccaatcttaatcactgtatcattaaaaataaacgcaagccacaaaacagatgcaatcccaaaagcaagacccattcctacactggaccgagcaaacagtcacatgagcaaagataattttcgccactagtgcaacaaagaagtaggtgaaacctacgctccaagtgaaacttgtgttagaaatttgattatagcaacccaattgaaggtctctccaagttccatccgatagaaaagagtataaaccacaatagcagtcctggacaagaatgaggcttaagttttgtcaaaaataaaatacatttaaaaaaccatcacatgcagaaatagtcattgtacacgttcaaggctttgagccacttcttacaacctagattcatttggcaaaacagaaattcacttgaagagtagatgttagttaaagaagagcaaagggtactaaaaatacccatcattcatcaaggattccccttcaattatcgtgcttagctttttgctggcaccaagatctttcaacaaagccacaacagcaacaggatcagttgcactcagaagtcctccaagcagttttccaactccagttgtaaggaaaagtaagctgtattgtgacaaatgagctataatcgtataacacaaacaatgaaatctaaacacatcggttcacgtaccttcaaaacaactcctagacaaacagtagaaagtgcaacaccaggaccagctagtaaggtcatttgtgcaagacaccgctgcattagtccaaaatgcatattgtgatggaacatcaggcatcttataaataacagtcagtgacttatatttttataaacaaacatcaagtctgctccctgtttagcagtgtttaatgctagctatgtctgatcttgttgatttaatttctacatctttcattagggaatactggtaattgtatgaaataaaaatatttagtctcatgttgtgcattaaagatttcaaaataattgatatttgacttagaattgttagtttctggcacagttttcaagttggtctcctttagtttacatgacttcttggttagattttgtagggcatttggattattttgttcaagtttcacactattgatgatgcttaattgtgaacatgttggctactggggctttgtggaatttaaaaagcaaataaacaaacacaacaacatacatctagaaaagtcaccaaagcaagcataaattactaataagtaggcaagagtttataaactagataggaactatcataacagaaaagcaccatcactttataactcaaatttagtcgcagttatacataaacttctactcaaacagcaacaaaaacagtactttcgaaaagaagaagaaaaacggcgacaatgatagcacgcgactaatcagaaatatataataactagtatggttatccgtgcatcgatgcacgggttgttattttttcatataatttatatttaataataattaaattaaaaatatgagtttataatcaatttaaaatttaatataataaaaattaatttaatcagtatgtttattaatttaagaattataaaagttggatgtaatttttttaatatttttatcatcaatattattacttaaatttgtatgctaattgtttcatagcaagtctttttaatgtctttttcataattggaaaggacatgtaaggagaagaagagaaattaaaagaaaaaatagaaattttaaaaaagaattgaaatgatttgataacatggatcataaaaattgaggtttaaaataattattgactaaaaaatgttagtaaatcatgattaattatggctaatttaattaaaaataaattttaccaaaattattgacacttaattaaaattttaaaatgtttaattaaattatagctaaaaaaggagggaatatgactaatttaataaaaaataagtggtgtattaataatgggtgaaattttagcggaaagatggcagaagtaacaatttatatatatatatatatattatagattattatgatccttttaaaaaaattattataaatacaaactacaaagagaagcaaagataaaagtgtaaaatccgaaacctttaatatttttttttgctgagtatttaaagccttcaactgcacacattaaaatcaactacaaattcaagaattcactaaagaaaaataattaacatgctactttttagataactaaataaatataaatatttttctacaaaacaaacatgacattttttcaactcaaaacaaatgtcatgaatacaaatgttataaattaaataactattgctttgctattttgaattactttgtttttctcttatttttaaatattttttaacttattaaatccctcataatttcatgcattaaacttgctacgttccattggaggacgcacccaaagaatacacaatctcactttcctttgcatgatactgtccctggaagataaagagtaatggcacacatcattaatttcgaatgtgtgtgtcatcataatgacaacaactttattaggttggagaatcatatggtgaaatataaagttatacctcatgtcatattccatcagtcgtgacaacaaataaggttatccgatgcttattttgtgagttgtgatgctaccatttttccattcgtcaatatacaaattgggtctcttaaaattggaaaggacacatgattattaccacaaaataataaacttgaagattacgaagaaatgacaaataatgtaataatgaaagagcaaaacttcctctatctttaaagagcctcttgatattttttttcaatttataattaatgtaaaatgagaatgaagagttgcacatttagagagtactggaaagaatttaagattcattcaatataaataaataaaaaaatagggagtgtgataattaattgtttcaatgtcactttaaggtttcaacaagaagtattatttacatttattgaggagtgaaatgttttcattagcatgttatttgtttaatttttatacaagaagtattatttacatttattgaggagtgaaatgttatcattagcttgttatttgtttaatttttagattcaactaattatcaaacttgatagttaatttataattgtaccttcaatatggatgagaaaataaagatgatggaagtaagaacttttatatatatatatatatatatataaattcatcgattaaattttcaatgatcgttttattgacaaatttttatcagttgaaaatttcaattttttttgtaatgtttataatcgaatattttaatgaccagtgatcaagttaaatcttgagtggtatctcacctaaattttgtatataaaaataagcatctagtaagctatattaaataggaaattagggacacccatgaattaacaaacaataatgaatctcagcatgaccatgacttattcaaagccaggtactatccagattccttttaggttcccagaccacgtcctttaatatttctagatcataaaagcaaccgtgtccggactcgttgattgtggtatggcatagaccctcctccacatgaacatgaagcatagcagacccattcaaatgtgcccaaacagagcactagagtttagtttaggctatgccttacatttttgtcttcattggcttaagtagttaagttaaccatcttttcctttacatagaaaaaattaaaagttttggtcactttggaatgggtcggcgcttttcaataagttgtatagaatttcaatttctaccactacaagattaaaatcctcgatacgcgcactctcctactcggtttacgcggtgtgtacacattcttatttaaactaacgtcggcactcctcagccttcattttctctctctatctctctctctttcagtgcccaccaccattttcaatcaccatttttaacaacatggcttcacaaacttcagcaccgagattgattcctgaaaggggtcaagttctaaagagggtcctcaaaatggtgttttcttgtttcatgtgtgctggttcttcttcttacaattcacatcatcccaaaaccacttcttcttctgtgtttccagcaccttcgcgtatctgaatctgttcttaattatattggcatttgacaactcgtcaaattggatactgggtttggccgcaccacaacattgttcttcacctccgagataaatatgggtgtcgaaaagcaactggattagttaattaatctcatatagttttcgaaaagcaagcttgtgttgtaacaattttgtttcctgtattcaaaagtgagccctttattatcactttgatcctgggcttgcaaatttttttttgtagtttcgaatgtggaaatcttccttagagtttggttggaaattttaaatattcttaatattaatgttataattgggccatacggaaattttttgtatctatctcaatcgttatagacttttactaattatattaatatttcttgtttgaagaacagccaaaaagtaaaaattattaatctaaattaaattcaacggctgcacccgcacgtgcacgtgtgtggtgattatttggtaggctagcaaccaacgtcattatgccaaagaatagaatcttgtcttgaagctgtgtcactgcttacagacatcgtgctagttactatagaatggaccaatgattgttagttttagttccagtgttcaaacataatttgaaattgctataatgtaacagtagtacactagtactccagtcttatttggatctcaaatactatccaatatgaccgtctcaaacatttttattggagtttgcctacaatatttctttaatgaatttttacgagagattaaaggtctgaaataaatataacaatgatgagaaattgatataaatatgaaatataaagtaaataaatcaataaaaataatataaaaatatagatataattatatttaactcaatatacagtatacttatattttattttttaaaataattatcgtatttgtaaattatattaaattgtattatatagtatcatactcaatatttgtattcatgcagtgcaacataaattatatttagtaaaattagttgaaaaattaatttaaaactgaaaagttaatcagaacataaaaagttacctaataattaaaaaattatattattgaatcataaatgtttgacaaaattatatgttaaaatagctaaaaaatataaaattgtataaaaaataaaaatagtaaaatttttaccttaaatagaaaatattaaaattgaaatctaataaatatttaagtgcaaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatcttcaaactattacataataaaaataaataggtgttgtcaattgtgtgaggcatctccaggatttgaaatataaaagaaaataaaatacagcatatcttaatttcttgtcttcacctttcaaaaacaaatttatgtcttcaaactattacataataagagtttataataaagattcatctctaattatgatttatgactcatgttgcggttctaattttataaggaaattgactgcagcataaatcataattcactgcactcaaacaaactcattgatttagattgactgcagttggttattgtcttagccattggatcaaactaataattaaaatcttgcctcatcagtatttttatgattaaaagaaaacacgagacttgctttacaaatttaaaatggaagatacgaaaagcagctgacactgaggtgaggtgaggcgaggtaactattacttaattgtattttctatataaattacatttatatttatatgagacaatttttgttccaattagataaaattattttagtcttatttattttaaacagaattagctttcaactcatattatatatttttatgagtttaatatttatatattgatgcagtcataaattatcataaaatcataaataattgtttgaattattttaaaataattattgtaaaaaattaataaatttatcatatatgataagttgtaattggatgatagtgtataaccttttttttgtttcttatttaaataagttttaagggtaaattttatttataaaaaataataaaaattatctaatttgtaacataaactcttatataataagaaattatgatgaaattcatgttgaattgttttttttcttcttcttcacaattctgcaagttggttggaaggctgtctggttcttgtagacacaagccacgtggtatgctgcttctttcttgggctgaataagggcctcgtgacatcaacctcttaccgcgtgtaacaaagcccgcaacgcgtgagaatgcatcggtccaaaaaattttgcattttcttcttttgaatatcacaataaatatattgaccttgtatataacattttataaaattattttagtctacactgtcttattattcctccttctccaacgaccttcaaatgtaaacccacctaaactaattcttcgttcacatacaataacttgacagtgtcagatttccctaacttgttatttcttatggctatgttcatgttcccttctaacatctaagtattcaaattttttcaatccattatattcgtttatagactatccatcttaattatagcaaatttatttatcatatatatataaattaaaatatagtatgaaaaacttaattttgcattgtcagtacaatataattaaattctttatatatatttgaacataaattatatgcttttttgttcaataaataaaatgaaaacatgctgttcagatatctaaataaactaatatgttttttattaaataaattaaaacataacgtggtttcagatagagtgaaggataaataaaaacatgtggttcagatatcaacattgtattcatgtgtttttgtgagaaaaaacatttcggtcttgttagggctttttcagtcttagcacattgtgttcaaaatgaaacagaggaacagtgaaagatcgacccaatctgaacccttatcaaataaccaggtctataaacaaaacgaacattgaaaccccaatttctttaagtggccttctgacgtcaagctaggtatgacgtttctgtcgtcactcattcgtcattaaaacatttttgcttggttttagaatatctttctggttaaattggagacattactaattattaaaataagtaaatataaaagtgatcgaatctaatttctaccgtaatctatatagtaataaaacaacattttcctaacctatttcttgcttctccttgcttcgcaggttcggttccttacctgcttcttgcttctccttgcttcgcaggttcggttctgcttctctttgcttcggtctcactttttccagcttcggtccactaccacacctctcagccaattccaaatctctgttgggaccctccctcagctttgttctctgcagctctcaacaactctctgaagctatcatcatttcctctcaataactctctcacgaaaacacccaatcccacacttgcttccttctccatcttctgctaacaactctctgaagctatcatcatttcctctcaacaactctctcacgaaaacacccaaccccacacttgcttccttctccatcttctgctatgttttgatttttccttgatcttgctctttctccatcttctcctctctttttgttttttacattgaagctaatggaggctgaaaagccatagctttctcatcg

SEQ ID NO: 2 - DNA, 2515428 bp, Glycine tomentella (residues 1-1,257,714 of 2,515,428)
  variation 2518..2998: note = n is a, c, g, or t
  variation 36286..36599: note = n is a, c, g, or t
  variation 36872..36881: note = n is a, c, g, or t
  variation 65098..65189: note = n is a, c, g, or t
  variation 91979..92044: note = n is a, c, g, or t
  variation 103399..103465: note = n is a, c, g, or t
  variation 108489..108498: note = n is a, c, g, or t
  variation 109073..109082: note = n is a, c, g, or t
  variation 110439..110448: note = n is a, c, g, or t
  variation 114969..115015: note = n is a, c, g, or t
  variation 117523..117532: note = n is a, c, g, or t
  variation 119983..120104: note = n is a, c, g, or t
  variation 147407..147539: note = n is a, c, g, or t
  variation 148147: note = n is a, c, g, or t
  variation 148448..148543: note = n is a, c, g, or t
  variation 151690..151746: note = n is a, c, g, or t
  variation 152026..152272: note = n is a, c, g, or t
  variation 155219..155271: note = n is a, c, g, or t
  variation 160392..160454: note = n is a, c, g, or t
  variation 171648..171859: note = n is a, c, g, or t
  variation 177208..177279: note = n is a, c, g, or t
  variation 178199..178208: note = n is a, c, g, or t
  variation 191490..191619: note = n is a, c, g, or t
  variation 194974: note = n is a, c, g, or t
  variation 196069: note = n is a, c, g, or t
  variation 196368..196600: note = n is a, c, g, or t
  variation 208015: note = n is a, c, g, or t
  variation 212728..212812: note = n is a, c, g, or t
  variation 213179..213270: note = n is a, c, g, or t
  variation 233294..233303: note = n is a, c, g, or t
  variation 252827: note = n is a, c, g, or t
  variation 259658..259791: note = n is a, c, g, or t
  variation 262066..262133: note = n is a, c, g, or t
  variation 262439..262704: note = n is a, c, g, or t
  variation 269209..269218: note = n is a, c, g, or t
  variation 270030..270039: note = n is a, c, g, or t
  variation 270849..270858: note = n is a, c, g, or t
  variation 271823..271844: note = n is a, c, g, or t
  variation 277888..277935: note = n is a, c, g, or t
  variation 278275..278284: note = n is a, c, g, or t
  variation 278614..278630: note = n is a, c, g, or t
  variation 283365: note = n is a, c, g, or t
  variation 292154: note = n is a, c, g, or t
  variation 294898..295033: note = n is a, c, g, or t
  variation 303145..303509: note = n is a, c, g, or t
  variation 327149: note = n is a, c, g, or t
  variation 345182..345191: note = n is a, c, g, or t
  variation 345689..345698: note = n is a, c, g, or t
  variation 347234..347243: note = n is a, c, g, or t
  variation 354646..354974: note = n is a, c, g, or t
  variation 355279..355288: note = n is a, c, g, or t
  variation 366049: note = n is a, c, g, or t
  variation 387264..396263: note = n is a, c, g, or t
  variation 401298..401307: note = n is a, c, g, or t
  variation 404653..404702: note = n is a, c, g, or t
  variation 411793..411845: note = n is a, c, g, or t
  variation 414129: note = n is a, c, g, or t
  variation 424879..425053: note = n is a, c, g, or t
  variation 436381: note = n is a, c, g, or t
  variation 438890..439012: note = n is a, c, g, or t
  variation 445443..445813: note = n is a, c, g, or t
  variation 446434..446520: note = n is a, c, g, or t
  variation 448528: note = n is a, c, g, or t
  variation 449746..449755: note = n is a, c, g, or t
  variation 451579..451618: note = n is a, c, g, or t
  variation 451827..453537: note = n is a, c, g, or t
  variation 453971..454045: note = n is a, c, g, or t
  variation 454682..454729: note = n is a, c, g, or t
  variation 454995..455028: note = n is a, c, g, or t
  variation 458579..458801: note = n is a, c, g, or t
  variation 471895..471896: note = n is a, c, g, or t
  variation 473644..473695: note = n is a, c, g, or t
  variation 475540..475549: note = n is a, c, g, or t
  variation 476056..476297: note = n is a, c, g, or t
  variation 476716..481095: note = n is a, c, g, or t
  variation 483544..483583: note = n is a, c, g, or t
  variation 494682..497556: note = n is a, c, g, or t
  variation 500976..501680: note = n is a, c, g, or t
  variation 509293..509775: note = n is a, c, g, or t
  variation 510125..510134: note = n is a, c, g, or t
  variation 511429..511438: note = n is a, c, g, or t
  variation 512071..512080: note = n is a, c, g, or t
  variation 520829: note = n is a, c, g, or t
  variation 535872: note = n is a, c, g, or t
  variation 548634..548716: note = n is a, c, g, or t
  variation 550234..550445: note = n is a, c, g, or t
  variation 556363..556825: note = n is a, c, g, or t
  variation 561399: note = n is a, c, g, or t
  variation 563228..563396: note = n is a, c, g, or t
  variation 569719..569972: note = n is a, c, g, or t
  variation 571088..571199: note = n is a, c, g, or t
  variation 571558..571610: note = n is a, c, g, or t
  variation 574171: note = n is a, c, g, or t
  variation 582944..582946: note = n is a, c, g, or t
  variation 584002..584056: note = n is a, c, g, or t
  variation 595096..595105: note = n is a, c, g, or t
  variation 598699..598791: note = n is a, c, g, or t
  variation 599080..599089: note = n is a, c, g, or t
  variation 601036: note = n is a, c, g, or t
  variation 603263..603301: note = n is a, c, g, or t
  variation 605068..605725: note = n is a, c, g, or t
  variation 612683..612791: note = n is a, c, g, or t
  variation 613113..613122: note = n is a, c, g, or t
  variation 624207..624794: note = n is a, c, g, or t
  variation 627447..636305: note = n is a, c, g, or t
  variation 637524..637692: note = n is a, c, g, or t
  variation 643932..644116: note = n is a, c, g, or t
  variation 646255..646264: note = n is a, c, g, or t
  variation 655076..655353: note = n is a, c, g, or t
  variation 655764..655773: note = n is a, c, g, or t
  variation 664924..665368: note = n is a, c, g, or t
  variation 665811..665897: note = n is a, c, g, or t
  variation 684898..684955: note = n is a, c, g, or t
  variation 686088..686097: note = n is a, c, g, or t
  variation 686785..686794: note = n is a, c, g, or t
  variation 687013..687452: note = n is a, c, g, or t
  variation 696202..696211: note = n is a, c, g, or t
  variation 697137..697146: note = n is a, c, g, or t
  variation 697505..697530: note = n is a, c, g, or t
  variation 698828..699334: note = n is a, c, g, or t
  variation 700134: note = n is a, c, g, or t
  variation 701663..701779: note = n is a, c, g, or t
  variation 705994..706003: note = n is a, c, g, or t
  variation 706275..706284: note = n is a, c, g, or t
  variation 706554..706740: note = n is a, c, g, or t
  variation 739616..739625: note = n is a, c, g, or t
  variation 739984..739993: note = n is a, c, g, or t
  variation 740772..740781: note = n is a, c, g, or t
  variation 747267..747725: note = n is a, c, g, or t
  variation 748024..748033: note = n is a, c, g, or t
  variation 751823..751832: note = n is a, c, g, or t
  variation 752158..752167: note = n is a, c, g, or t
  variation 754755..755332: note = n is a, c, g, or t
  variation 761790..761799: note = n is a, c, g, or t
  variation 770075..773141: note = n is a, c, g, or t
  variation 781173..781238: note = n is a, c, g, or t
  variation 788556: note = n is a, c, g, or t
  variation 798961..799024: note = n is a, c, g, or t
  variation 799264: note = n is a, c, g, or t
  variation 803059..803645: note = n is a, c, g, or t
  variation 806342..806500: note = n is a, c, g, or t
  variation 807057: note = n is a, c, g, or t
  variation 809594..810292: note = n is a, c, g, or t
  variation 810583..810645: note = n is a, c, g, or t
  variation 819075..819099: note = n is a, c, g, or t
  variation 819525..819534: note = n is a, c, g, or t
  variation 823746: note = n is a, c, g, or t
  variation 831993: note = n is a, c, g, or t
  variation 839444..840159: note = n is a, c, g, or t
  variation 860764: note = n is a, c, g, or t
  variation 874264..874670: note = n is a, c, g, or t
  variation 874982..874991: note = n is a, c, g, or t
  variation 875486..875495: note = n is a, c, g, or t
  variation 880231: note = n is a, c, g, or t
  variation 892030..892205: note = n is a, c, g, or t
  variation 900420..900439: note = n is a, c, g, or t
  variation 905126..905135: note = n is a, c, g, or t
  variation 917837..917857: note = n is a, c, g, or t
  variation 918415..918483: note = n is a, c, g, or t
  variation 919195..919698: note = n is a, c, g, or t
  variation 929819..931166: note = n is a, c, g, or t
  variation 936309: note = n is a, c, g, or t
  variation 937617..937679: note = n is a, c, g, or t
  variation 938166..938202: note = n is a, c, g, or t
  variation 948999: note = n is a, c, g, or t
  variation 955232..955301: note = n is a, c, g, or t
  variation 957017..957452: note = n is a, c, g, or t
  variation 957755..957764: note = n is a, c, g, or t
  variation 963372..964799: note = n is a, c, g, or t
  variation 975972: note = n is a, c, g, or t
  variation 980684..980776: note = n is a, c, g, or t
  variation 984316..984467: note = n is a, c, g, or t
  variation 984667..985013: note = n is a, c, g, or t
  variation 985138..985404: note = n is a, c, g, or t
  variation 985808: note = n is a, c, g, or t
  variation 1017314..1017402: note = n is a, c, g, or t
  variation 1021845: note = n is a, c, g, or t
  variation 1037120..1037214: note = n is a, c, g, or t
  variation 1041307..1042192: note = n is a, c, g, or t
  variation 1043052..1043061: note = n is a, c, g, or t
  variation 1061729..1062991: note = n is a, c, g, or t
  variation 1064770..1065153: note = n is a, c, g, or t
  variation 1065481..1065490: note = n is a, c, g, or t
  variation 1068350..1068358: note = n is a, c, g, or t
  variation 1070628..1070664: note = n is a, c, g, or t
  variation 1073221..1073383: note = n is a, c, g, or t
  variation 1073735..1073744: note = n is a, c, g, or t
  variation 1082661..1082682: note = n is a, c, g, or t
  variation 1083652..1083936: note = n is a, c, g, or t
  variation 1084301..1084344: note = n is a, c, g, or t
  variation 1084663..1084672: note = n is a, c, g, or t
  variation 1087587..1087596: note = n is a, c, g, or t
  variation 1088480..1088489: note = n is a, c, g, or t
  variation 1100633..1100693: note = n is a, c, g, or t
  variation 1103210..1103222: note = n is a, c, g, or t
  variation 1103976..1104499: note = n is a, c, g, or t
  variation 1108036..1108083: note = n is a, c, g, or t
  variation 1108391: note = n is a, c, g, or t
  variation 1121455: note = n is a, c, g, or t
  variation 1131796..1131956: note = n is a, c, g, or t
  variation 1139540..1139850: note = n is a, c, g, or t
  variation 1141715: note = n is a, c, g, or t
  variation 1153053..1153141: note = n is a, c, g, or t
  variation 1158773..1158797: note = n is a, c, g, or t
  variation 1159432..1159557: note = n is a, c, g, or t
  variation 1162619..1162739: note = n is a, c, g, or t
  variation 1163190..1163199: note = n is a, c, g, or t
  variation 1166327: note = n is a, c, g, or t
  variation 1171052..1171076: note = n is a, c, g, or t
  variation 1171386..1171412: note = n is a, c, g, or t
  variation 1188088..1188121: note = n is a, c, g, or t
  variation 1188873..1188917: note = n is a, c, g, or t
  variation 1190220..1194815: note = n is a, c, g, or t
  variation 1195112..1195121: note = n is a, c, g, or t
  variation 1210221..1210724: note = n is a, c, g, or t
  variation 1221116..1221723: note = n is a, c, g, or t
  variation 1246582..1246600: note = n is a, c, g, or t
  variation 1247090..1247160: note = n is a, c, g, or t
  variation 1252322..1252399: note = n is a, c, g, or t
  variation 1255587..1255722: note = n is a, c, g, or t
  variation 1256438..1256447: note = n is a, c, g, or t
  variation 1264054..1264141: note = n is a, c, g, or t
  variation 1264542..1264551: note = n is a, c, g, or t
  variation 1265445: note = n is a, c, g, or t
  variation 1270155..1270164: note = n is a, c, g, or t
  variation 1270726..1270735: note = n is a, c, g, or t
  variation 1276069..1276088: note = n is a, c, g, or t
  variation 1285115: note = n is a, c, g, or t
  variation 1292752..1292761: note = n is a, c, g, or t
  variation 1293343..1293352: note = n is a, c, g, or t
  variation 1296972..1296981: note = n is a, c, g, or t
  variation 1297588..1297597: note = n is a, c, g, or t
  variation 1301879..1301888: note = n is a, c, g, or t
  variation 1302658..1302667: note = n is a, c, g, or t
  variation 1315014..1315160: note = n is a, c, g, or t
  variation 1318709..1318990: note = n is a, c, g, or t
  variation 1319334..1319757: note = n is a, c, g, or t
  variation 1321767..1321837: note = n is a, c, g, or t
  variation 1324303..1324656: note = n is a, c, g, or t
  variation 1327754..1327769: note = n is a, c, g, or t
  variation 1348460..1348627: note = n is a, c, g, or t
  variation 1353754..1354201: note = n is a, c, g, or t
  variation 1354501..1354543: note = n is a, c, g, or t
  variation 1361377..1370010: note = n is a, c, g, or t
  variation 1373811..1374519: note = n is a, c, g, or t
  variation 1404036..1404553: note = n is a, c, g, or t
  variation 1408650..1408745: note = n is a, c, g, or t
  variation 1413613..1413642: note = n is a, c, g, or t
  variation 1418003: note = n is a, c, g, or t
  variation 1422061..1422070: note = n is a, c, g, or t
  variation 1435965..1435974: note = n is a, c, g, or t
  variation 1436939: note = n is a, c, g, or t
  variation 1442212..1442221: note = n is a, c, g, or t
  variation 1466149..1466756: note = n is a, c, g, or t
  variation 1488168..1488729: note = n is a, c, g, or t
  variation 1489174..1489183: note = n is a, c, g, or t
  variation 1494640..1494771: note = n is a, c, g, or t
  variation 1495169..1495178: note = n is a, c, g, or t
  variation 1496562..1497374: note = n is a, c, g, or t
  variation 1501256: note = n is a, c, g, or t
  variation 1519233..1519331: note = n is a, c, g, or t
  variation 1530876..1531672: note = n is a, c, g, or t
  variation 1539501..1539510: note = n is a, c, g, or t
  variation 1550168..1550188: note = n is a, c, g, or t
  variation 1559883..1559892: note = n is a, c, g, or t
  variation 1560261..1560270: note = n is a, c, g, or t
  variation 1560602..1560695: note = n is a, c, g, or t
  variation 1568183..1568192: note = n is a, c, g, or t
  variation 1575847: note = n is a, c, g, or t
  variation 1580103: note = n is a, c, g, or t
  variation 1581680..1581790: note = n is a, c, g, or t
  variation 1582461..1582543: note = n is a, c, g, or t
  variation 1598249..1598481: note = n is a, c, g, or t
  variation 1615304..1615306: note = n is a, c, g, or t
  variation 1620936..1620976: note = n is a, c, g, or t
  variation 1622376..1622440: note = n is a, c, g, or t
  variation 1623858..1626107: note = n is a, c, g, or t
  variation 1639782..1639810: note = n is a, c, g, or t
  variation 1657914..1657978: note = n is a, c, g, or t
  variation 1658123..1658961: note = n is a, c, g, or t
  variation 1662215..1662290: note = n is a, c, g, or t
  variation 1662660..1662669: note = n is a, c, g, or t
  variation 1666740..1666813: note = n is a, c, g, or t
  variation 1671811..1672574: note = n is a, c, g, or t
  variation 1673048..1673065: note = n is a, c, g, or t
  variation 1674791..1674800: note = n is a, c, g, or t
  variation 1675163..1675172: note = n is a, c, g, or t
  variation 1678279..1678404: note = n is a, c, g, or t
  variation 1678859..1678899: note = n is a, c, g, or t
  variation 1684450..1685029: note = n is a, c, g, or t
  variation 1690393..1691192: note = n is a, c, g, or t
  variation 1698905: note = n is a, c, g, or t
  variation 1713749..1713758: note = n is a, c, g, or t
  variation 1714429..1714438: note = n is a, c, g, or t
  variation 1721212..1721719: note = n is a, c, g, or t
  variation 1722067..1722269: note = n is a, c, g, or t
  variation 1733874..1733908: note = n is a, c, g, or t
  variation 1743304..1743899: note = n is a, c, g, or t
  variation 1744231..1744265: note = n is a, c, g, or t
  variation 1748110..1748890: note = n is a, c, g, or t
  variation 1759134..1759143: note = n is a, c, g, or t
  variation 1762830..1762889: note = n is a, c, g, or t
  variation 1771366..1771373: note = n is a, c, g, or t
  variation 1775112..1775509: note = n is a, c, g, or t
  variation 1782687..1783942: note = n is a, c, g, or t
  variation 1792376..1792451: note = n is a, c, g, or t
  variation 1802175..1802222: note = n is a, c, g, or t
  variation 1803101..1803115: note = n is a, c, g, or t
  variation 1804607..1804627: note = n is a, c, g, or t
  variation 1807679: note = n is a, c, g, or t
  variation 1815540..1816276: note = n is a, c, g, or t
  variation 1816730..1816739: note = n is a, c, g, or t
  variation 1831257..1831321: note = n is a, c, g, or t
  variation 1840114..1840183: note = n is a, c, g, or t
  variation 1841183..1841192: note = n is a, c, g, or t
  variation 1853078..1853247: note = n is a, c, g, or t
  variation 1866798..1866807: note = n is a, c, g, or t
  variation 1867100..1867109: note = n is a, c, g, or t
  variation 1867744..1867800: note = n is a, c, g, or t
  variation 1868124..1868163: note = n is a, c, g, or t
  variation 1872772..1872781: note = n is a, c, g, or t
  variation 1876847..1877364: note = n is a, c, g, or t
  variation 1880122: note = n is a, c, g, or t
  variation 1885134..1888261: note = n is a, c, g, or t
  variation 1908210: note = n is a, c, g, or t
  variation 1917391..1917806: note = n is a, c, g, or t
  variation 1938336..1943444: note = n is a, c, g, or t
  variation 1943733..1943742: note = n is a, c, g, or t
  variation 1965086..1965095: note = n is a, c, g, or t
  variation 1965460..1965469: note = n is a, c, g, or t
  variation 1972085..1972791: note = n is a, c, g, or t
  variation 1973111..1973122: note = n is a, c, g, or t
  variation 1974857..1974935: note = n is a, c, g, or t
  variation 1975220..1976196: note = n is a, c, g, or t
  variation 1977813..1977865: note = n is a, c, g, or t
  variation 1978144..1978215: note = n is a, c, g, or t
  variation 1988350..1988667: note = n is a, c, g, or t
  variation 1992044..1992053: note = n is a, c, g, or t
  variation 1992564..1992575: note = n is a, c, g, or t
  variation 1993922..1993931: note = n is a, c, g, or t
  variation 1998316..2001666: note = n is a, c, g, or t
  variation 2007006..2007034: note = n is a, c, g, or t
  variation 2022891..2022963: note = n is a, c, g, or t
  variation 2023545: note = n is a, c, g, or t
  variation 2030200..2030333: note = n is a, c, g, or t
  variation 2033148..2033157: note = n is a, c, g, or t
  variation 2033672..2034130: note = n is a, c, g, or t
  variation 2040204..2040649: note = n is a, c, g, or t
  variation 2040932..2040941: note = n is a, c, g, or t
  variation 2043444: note = n is a, c, g, or t
  variation 2044607..2044616: note = n is a, c, g, or t
  variation 2044965: note = n is a, c, g, or t
  variation 2045720..2046417: note = n is a, c, g, or t
  variation 2048728..2048737: note = n is a, c, g, or t
  variation 2054225..2054315: note = n is a, c, g, or t
  variation 2055747..2056110: note = n is a, c, g, or t
  variation 2060336..2062932: note = n is a, c, g, or t
  variation 2064549..2068059: note = n is a, c, g, or t
  variation 2071944..2074388: note = n is a, c, g, or t
  variation 2077276..2077285: note = n is a, c, g, or t
  variation 2077776..2077785: note = n is a, c, g, or t
  variation 2079822..2079963: note = n is a, c, g, or t
  variation 2099994..2100087: note = n is a, c, g, or t
  variation 2101621: note = n is a, c, g, or t
  variation 2111187..2111214: note = n is a, c, g, or t
  variation 2128572..2129569: note = n is a, c, g, or t
  variation 2129891..2129900: note = n is a, c, g, or t
  variation 2136592..2136865: note = n is a, c, g, or t
  variation 2137405..2137414: note = n is a, c, g, or t
  variation 2142352..2142967: note = n is a, c, g, or t
  variation 2152571..2152611: note = n is a, c, g, or t
  variation 2162035..2162044: note = n is a, c, g, or t
  variation 2162420..2162429: note = n is a, c, g, or t
  variation 2168678..2168687: note = n is a, c, g, or t
  variation 2168965..2168974: note = n is a, c, g, or t
  variation 2170448..2170528: note = n is a, c, g, or t
  variation 2172418..2172450: note = n is a, c, g, or t
  variation 2175858..2176004: note = n is a, c, g, or t
  variation 2176822..2178287: note = n is a, c, g, or t
  variation 2183532..2183533: note = n is a, c, g, or t
  variation 2192827..2192836: note = n is a, c, g, or t
  variation 2193136..2193193: note = n is a, c, g, or t
  variation 2226691..2226701: note = n is a, c, g, or t
  variation 2228677..2228844: note = n is a, c, g, or t
  variation 2230490: note = n is a, c, g, or t
  variation 2236754..2236902: note = n is a, c, g, or t
  variation 2237173..2237182: note = n is a, c, g, or t
  variation 2242420: note = n is a, c, g, or t
  variation 2244111..2245118: note = n is a, c, g, or t
  variation 2258246..2258284: note = n is a, c, g, or t
  variation 2262189..2262198: note = n is a, c, g, or t
  variation 2262472..2262481: note = n is a, c, g, or t
  variation 2266513..2266701: note = n is a, c, g, or t
  variation 2272669..2272678: note = n is a, c, g, or t
  variation 2298575..2298993: note = n is a, c, g, or t
  variation 2299347..2299359: note = n is a, c, g, or t
  variation 2307329..2307440: note = n is a, c, g, or t
  variation 2307847..2307856: note = n is a, c, g, or t
  variation 2308269..2308278: note = n is a, c, g, or t
  variation 2323624..2324477: note = n is a, c, g, or t
  variation 2335007..2335040: note = n is a, c, g, or t
  variation 2350282..2350318: note = n is a, c, g, or t
  variation 2369126..2369670: note = n is a, c, g, or t
  variation 2381400..2381716: note = n is a, c, g, or t
  variation 2392901..2392930: note = n is a, c, g, or t
  variation 2402695: note = n is a, c, g, or t
  variation 2411490..2411775: note = n is a, c, g, or t
  variation 2431281..2435739: note = n is a, c, g, or t
  variation 2445436..2449828: note = n is a, c, g, or t
  variation 2452416..2455423: note = n is a, c, g, or t
  variation 2461739..2461937: note = n is a, c, g, or t
  variation 2466912..2466921: note = n is a, c, g, or t
  variation 2473868: note = n is a, c, g, or t
  variation 2476490: note = n is a, c, g, or t
  variation 2486351..2489785: note = n is a, c, g, or t
  variation 2490307..2490316: note = n is a, c, g, or t
  variation 2494031..2494157: note = n is a, c, g, or t
  variation 2496343..2497092: note = n is a, c, g, or t
  variation 2504781..2504819: note = n is a, c, g, or t
  variation 2513626..2513666: note = n is a, c, g, or t
  variation 2514241..2514535: note = n is a, c, g, or t
  variation 2515079..2515133: note = n is a, c, g, or t
  source 1..2515428: mol_type = genomic DNA
agtttttcaatcagttgtacttcaatttctacctccggaagctcgcagcattatgcagcagcaacaacaactggtcgaagaacaacaccaacaacatgatcaaccacatgatgcacagcaacaaaacaatgatgaaccagcaaatgaccaacaaggagaggatgacaatgactatgttgattattgacttccaaacagtttatcagttatcaaatgtttaacattgcggtattatgttatttatatttggaacttattttcgtttgtttaaacatttgactttgaatgtatgaattcagttttttattttataatatgctttattttggtaatcatgttatttaatatcaataaataaataatctacggaaattactaactcaatgagcggtaggtaagttttcgacggaataggccgtcggaagtttccgacggaattggccgtcggaagtttccgacggaattggccgtcggaaatttccgacggaaatggccgtcggaaatttcccacggaattggccgtcggaaatttcccacggaattggccgtcggaaagtttccgacggaattggccgtcggaaatttcccacggaattggccgtcggaaattttccacggaataggccgtgggaaatttccgacggaattggccgtcggaaatttcccacggaataggccgtcggaaatttccgacagaataggccgtcggaaatttcccacggaaatggccgtcggaaatttccgacggaataggccgtcggcaaacgccgtcggaaatttccgacggccaaaaaatccgtcggaaatatttgcaacgaccgtttttccgacggatttttttccgtcggaaatccgtcggaaatctcgaatttccgacggatttttgatatttccgacggatttcggccgtcggaaatagcttttttttttgtagtgtttgcttccttaaaaggatttgtttccaccaaactagatccccgctggtcggtgcttaacatcttgaagcaatttgtggatgacagttcaaatctagtttatgcgaatgctggatttgttatcaaatttacttttttttttcttctttcatttcagataagcagctgtaaagacgttatttacgtataaatctgttaagaaatagaatttcatgcattatatataatttacttgaaggaatagggaccacgagaaatagaacaactaactaatatttagttaaaacatattaaaaaggctttcaatattattattttaaaaaataagcaatcttaagaatgattgtactaaaattgctttgagggaaattaattataaatactagttactaaccatcatttcccaaatgtaaataagagattaatttctttttcctttagatagttgacttagaaaagtcattaaattccatcggagaataactcacttgtactgttcaaaatttcataccaacatatgcacatgataacccccttgatatgtggggaatattgaagagggataaaagtaataaatattacttcgttagcttatgaaagacattaccaactcagctaagtaataaattcaaataggctattaaatattaatcattcattttaagtatataattaaaattggtagaaaaaaattatgaataaataaaatagaaaaaagacagtagttttttcctagtcgtttgagtaaaagtgaagcaataatttatgttgctaagttcgtaagaagaagtcagagggatgctaacaattgacaacaatcatatttatattctacttcatctttacctttttttcttttttctcgttttacacccaaaaacgtggttatcaattttcatcaattgattcggatttgtggaatggcacagtagagaagagatgctagttgaataggatccttcggtgtaatatgtggctgtggatctagctttttgtccactttggattatcagagtggtgataatgattttgcctcagacttgaggataagaatgaattaaatttgtgataaatctttacgacattcccttcacttcgaataggacgtattcacgatcggtggctttttattccgacggtacaaatttgtggttagataatcagaataattaatagttttattagtattcaatcagtataatttttatattatattattaatgtaatacattctcttattaacgtaaactcacaataattagattctttgtaaaagcataaaattgttataactagtaagatggttatttttgtaacattttttttataaattatattttaaaataatttttaattagttgataatataaaattttattccattaatgaataaaaattaactccaatgttggaaactatgtcgtaacagttatactctaacagaaattaatcgatagaatgctaataaatgttacatttttattgcaaagttttcaagttagtgcttcttaaattgttattaacacaaacttttcttctttattctcgtagcaatttaagttaatttcgtgttaattgatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttaatttttgttaaaaataaatttttactatattttatttattttttaatcaaattcggattagacaaaatattttttctttattgaattagaggattaagataaaaaatatttaatatttgattatgtttttagcatgattaccttgtaaaataagatatgtgtggaaaataaaatattaaataattttaaggtagtgtatgccaaattcaccttatgtattaaataatttagttaattattttaggtgcagacgtaagatgtgcaaagtgtacatctccttagtgcttcagtacaaatttaatttggttttttattttaaatttagagcaaaatacatattatatctataaaataattatttatcatccagcgcatgaaacaattaattcataattaatataaatataaaaattacgaagtgtgaggataataacaagttcctggaaggccattagtccattatgccattacagagtccagataacagccttttacgacttctcgttatgatcgtatctattgttcggcccgtgttttcaaaacaaggacagaactcgcggaaagagcccacaagaatgactttgcatacatcaccttgatcactcgtttgatagtggatactattaatacactaatttttactattagagtactataattttgcatattattttaaaaatttattagtttaaggtatttttattatgaaattttgtcattaaatttttttgtcatgtgcgttgcacttctttaggtacaaagacacaacatataaataaaatttggcgaactaattttgcttttgcaataaaatgtcataggtaaacattataaaaatcttaatcattggattaatagccacgtgattgagaatttgagattgtttgctggatgtccaaatttttatcgtatatctaattttaaaccatttgattaaaagacataaactgttattatatgttgattgttgttagtaatcatttgtatctctatgtttaactattaaataaacttatatccaattaaataattatgtttgtgattgtgtgatcatgctcttagatattacttatgttggtactattatatcccgtagaatattattattgtgcctattaattaatctctaatgcatgttcatcaatcatcattcatttagatattacttgtgttggtattattatatccggtagaatattggtattattttacctattcatccttaatgtctatccatgatatatttagatgcatgtgctggccgggccattgcttgaccaaaaataatgtagatgtgtctcgcatcagctccaattccaattggttgtgatttgatttttctgaggaaaagaaatcgaataattgtagttttaaaaaaaatccatgtctaaccctcgaatttggtatttattttcattttaattcctgaatttaataaaaaatactaatcatctatgaatttatattccacttattacactgaatactcaataaaaaaaatgtcatttatcacattaattgaacccctaatatgtctttgttaaatttactaaaaaatacgtgacacaagtttcagagactaaaggcaacaacatgttaaaatgagcaccaacttgagatgttgatggtcacattgctcttaaagatatatccatgttacgcgtaaatcatccaagattttacaggatcttctagactacaaaattgggaaattagaattggcaagcaaaaaacttaaagaaacccagaaagagatgtagaaaatagactcattggtgtgggaaaaaagaagctggaagttaagagagccgttttaatggttaaaatttgtcagactatttctggtgtaacaaaattgacataatatgtaacgtgaattaaccttcaccaaaaaaaacttaactaacttaatcaaacattaattaatatatttaaacaagtaataaatacaattaaaatatgacattaatgtcttcaaaaatggaaattatcccaggtttaaaatgagtcagaaattctcgtatttctatacaagctttcaattcagaatatttattgtaatggttatttaattttaatttttgttatatatgataaattattatgaattttctagatgttggataaacttaatatattaattttaaaagaataatttaatatatatgataaactatcatcattgtcatcatgacttccattatgatcgttattataaccaccgtcatcatcatcaatatgactttcaccactgtggtgacgatagttaacgatcatggtggtggttgcggtggcaaccattatagttatggtgaaaacgatcatgacggtgatggtaattgtggtgacgatcatgacagtcatggtggaaattgttatgacggtggtggttgtcatggtgataatcgatttgagatattttaggatgtcatagattaaatctttaaatatttgattttctatttgataaatcttataaagaattaatgattaaatgaaattttaattagaatttaaaatattttaatcttaatcttttactttaatctaataattgagattaatcattctcattttactattcttatgtgatacgttttatatatgtgtgtgttttattataaatacaataccaacttagttttagttaattcctttataatttaagtttcagtttgtagttcctatcttgttaaaagagtaaccatgcaagtctataattctgcgttcattacgtgttgatacgttacaacttacaattagctgaaaattcacatgtatagctactgtgaatttataaagtaaggcatcagaaaaaaaaaaaaacaatagggcaattttctaatacatgatataaaatatattaagtaatgaatattacataattatatacagtataaacttttaaatgttcggccctttttctagtgggctccaaactagggcagcagccagcagggccgggcctaacctaagtaatatcttcactgatagtatatatagttcaaacatttaaagtgtccaacgttctattatgcgtagtatatttaagaagctactagtatataaactcaaatatccatttaggtaaactaccattaccatgtagaagtatagtagcttttacaaataaatgatcctgaacattaaatggagaggagaagaccacccacctttcccacttcacagaacgacaactgtgccagcattcattatagagagagacgtagtactacagtacttgagatcgatcataataaacactcaaacccaaggaagcaaaactaaactaaccaatgaagttgaagcagcagaaaatgagagtagtagtaggctcagtgtggctgtgcctctttctgttggctgtcggggagtcggagggagcggatttggcggcgaagtgcaacctgctggttcagaaagtgctgccgtgcctaaacttcgcgacggggcaggcggcggttccgaccaaggactgctgcgaggcgacgtcggagataaagaagagcgacccggagtgcctgtgcttcgcgatccaacagactcacaagggtagtccgcaggtgaaaaacatgggcatacaagagggtaggctgcttcagctgccttctgcttgtaacttgaagaatgccagcaccaccaactgtcctagtatgttcatcccaccataactcactactcctctttaactttaataattaccagctaatatatctttattaatccaaaaatgttaatcactaaccttagaatattggttaaaaaacttaaaaagaaaatgttttttatttttattcataattgtttttacagtcttataatttttacaataaatattttttaaattttttttaactaaccatatccttattaatgagtacttcattcacttgccaaatactagctcacactccaaatctaaattactgatcataaaaagaaccgagtcacttaataattagcacatgtccaactttattggagaatttattgtatgatccaagtaaccatgatttcatcaattaacctatttcaccagctgatattatgtatttgaattttgttatttttataaattgaaaaacttaattgcataccaattgaaatcgatagaaaccattatcacggtagttcagattacatatatagtaattgatctcctattctgaccttcaaacgaaaaaagacacttaaaagatgaagtttgagtttgacttaaaaacaaatattaaaaaatcctaaaaatattattaattactatttttacattaatgtgattgactaaccggaagaaatattataaataaatttagaaatcaattgtacattcaccaaaaagaaaatacacatgtctacttttctaaaaaatataaaatttaatttttccaaacattatgttgtaatttttttattgttaaaataaaagaacttatgattaagtttttatcttcaaataatgaaaatgggacacatttgatttgatggcagagcttctgggtctatctccaaactcccctgacgctgctatcttcagaaatgcttcgttgaaaaccaattcagcttcaacagtgggaacaacaccaccagtctcagacgacatccacaagggctctaatggaaacatgcttagacctgttctcgttgcagacctaatagctgttgtttgggccattctcctcgtcgtgattccaatcggttctgtcaacatttattcgtgatgggtgcgttcaattaatgactcatgcagtaacagataggcaccactttaaatgaaagtagccgtggtagttgttttgctagtgatggatggatggattttaattagtttgcaggttgcagcatatatagaattaattgatttgcgtctgcaacatgttgttatgttgtctagaatatttcgaccctcttcatgttgtctttattaattaataattatcttaatttgtatggacttcttttccacatgctagactatatatctgatagattattaaaaaagtagtggttcattattaagattttgtttggataaaagttactaagtacagagcttttctacttaaaaatataaaaaaatttcaatagaaaaactattaaaaatatttctaattttatatccaaatagacttcaaaagtatgttttaatttgttttagattgtacatttcgaactgccttatgttatgcttatcgtcggtcacttactcgttagtttttatatctatagtaaatttctattatgttgtctatctaatatctaatacttatctattttactatatgaatatatttactattatctatctatatctactcctccatgtaattattcccaccatccagctattaaagacagataggagtaactcctgcactatttaacgcgtactggataagctttgtcatttagtaactattgttttgtgggatcatgggatgaacttttggtgatagattttattttttctaacattaaaagtatattagaataatagactacagcatttgtaaaatattaattgctacgtggaatagacttttgatgttaggttttcttcttctaacatatggagtatattagaataatattttatttattaatatctcatacaaacatttacataaatttacaattatattttaattttttttataaaagtaattttatgaaaaataattattttaaatgcaattaatattttttctatgaaagtgtgtattatattaaaataatatattttaaggagatataaaaaattatttctatcaattaaaaattttcagttacaaaattataaaataactaaattaacaagttttattattccaccaataaagaagtttattaaagtattgatttcaaatcaaattaattataatgtcaaacaaactttatttataacatttataagtctcaaaaatattttaaataataaaaatttatactgtcatgaaaaattatttcagtataatcttgttaaaaataattattatgaaagtcaataactttcaatacattacaatattcaattaaatgataatgtaaagaatctttactctagcgcatttttttaagttattaaaaaattaaatattctgtataaaataaaaaacgtaaactccactttttaaaagtgatcaattatgtctctttacatagactaatcctaatagatacttcatattaaatagcataattatcccaaaaaaattatccaatcttatttcctaattcagctcccctcagcattatactaacacaccaataggatagataataataggggtgtcctcggtccgtatggatggattgttcataaaaaaagtcacccaaaccaaaattataattttgatttagttttcatttaaaataaaattcaaattaaaccaaaccaatattttacaatttggttcaatttgattttttactaaaatattatttcattaaaatttatatacgttattttcatcttttaaattaaactacattaaaaaattactgataaaaatttatgaaacttattaatatataaaatcttctataataaaaatctatcaaattttcatccattttaaatcaaacaaagatcatctaaaaaagaaaatgatatacataacaaatagtaatataaataataattaaattgttgcgatttgatttgatttaaaaaaatataaataacaatccaaatcaaattgattagcctgaggaaaaaactattcaatcaaattcaaaaagaatcaatttggttcaattttttatttttattttgaatcgatttgatatgaaccacccctaaataataggaaatactaataactataatttactaattaaaaaaagtaaataatttattctaccaccaaacagaccttagtgtaataatctgcaaatattaccgtacgagatattgagactaaactcattatgtgaacccatacacaagacccaatatattatcgcttttgaccttaataacaatatgccccacaatattggtgaacagtgactttatttgaacttgacgaaattaacaatgtgccctaatcaatgttaacattcaacaaaccaggattttatacaatatgaattaggcaagttgacattaaaatttaaaatccaatgaatggtaaacacgctagttaacaacttaacccaaataattaaattatgacgagcacataaataaatttttggctaaactagccagcttgttcccattacttttggtctacatgacttagtttagacggcatacacgaaaattgcattcaaaatcaagcgaagaataccaagctaaccagaaaatccacaaaacttgaagcacggaccacgaagaaaacaaaaggaaccaaaaagaaaaaaaagaaaaaagttacaataggaaactttcttcaacattcaagtagattcacgaaatggtttgcttgaaaacttagcgggggtgccttttatacagcaccatctgatggcagtgtgctctgaatatttgaaggcataaggatgttgaatccatctgcagcagtagaaacaatcattccaggaatctgcgcgtgccaatgtagttccttcaggtctttttgtccctgttttaattcaaggcaaaataaacgaatgaacacaattaatcagggagtcttattctaacattcagataaatagagcggaggagcatttggatatacctggtgaataaacaatagttggggaggcaaatcttcaggagcattaacttgttctttggttttagctttaaattcagcctcctcttcctcatccttttctaaagaaaggtcccatatactgtggagaaaggtacaaaacttgtcaaatctcaaatacataaataacaaataaaaaaggagcagtggtgctatgaagctcatgcgcatgtagattctggggaagggttagccaaaaaaaaaaaaatcccgacaaggctacaactagcgatgcaaagagttaattataaaataacagcagtcctttacgctcatgtgaatcctttttcactatttggatcagaagatgccataaagttcagtgtcatgtagtaatgtaaagatcgaccttttaccactaaatctctcttaacagtataaaagcaaaaaataattcagcagataatgctatcaaaaccctttacttacgtaagctgattatcagatgaagaaactgccaatgaagaggcttcatgaggactccactcaatggatgtgattgagtgcttgtgatattcgaaatgcgctaccacagaatctccttcctgcccacttgtcatatcagctttaataacaagtaaattaataagcaggaaaaaatagacaatgtgaagttactttctaaatcataataatgcaataatactataatagttcttcaccataatgcatctagaagttccttcatacatggatttataggcacttgatttgcacatgaatggtaaaagaaagatgtgataatgaaacaagggaaaagaaagtcatcagacagctttacaaattcaatgtaatatgcctactgggacaacaggaaaaaagaatgataaaaaaattgaagctggatatgacataatttgaaacaccattgacagaacatcacatgcacacagtaacctccctgttataaatgaagcatgtttactattgttttattctttacgaagtcaacttataccttgagcagtctgagatcacgaatagaaatagtcccatcatcactccctgaggccaacatacaactagccaacctgctcagtataatatagaacaaagtgatgaagagatctataatagcagttgatggaacaccatagaattaatgtattaatacctgttccatgacattacattcacatcagcattatgtgccttaaaagatgcagctggtgacttccccaaacgggtatcccatattgcaatgtttccatccacagaacaagaagcaaaaacgtcaggttctatagggctccactgcagggattaattgaacattaaaaatctaattagatttataaataaggataaactagtaaaattagagtgtaaggaacaaaatatactatactgaaactacaagaagagcaactactgctttgcatatgagtaaacatacttgcagatcttcaacactagcggtatgtccagcaaatggagcattatcaacattccacgttccagcagatgtaggctcccacagataaatgcaattattgcaatccccttcaaaaatgaagatcattgtcaagctttatatatctgtgataactaagtatggagacatgccaggggaagacatagctaagaataaaaaactatgtaccccaatacctagaggctcctcgctatgcgaaggtaagggggaggaatattatacgcagccttacccttgcatatacaaagaagctgttttcggattcgaactcattacaacaggtcaccaaggcacaactttaccgctatgccaaggctcgccctcagggggaagacatagctaaactgaaaaaaatataactaaagattaccagatgcaagccttccagtaacaagaggactccagtctatagcataaccttcatctttgtgtttaaatttatacaatgggtcctgattaaaaattgcagcaactccttggacaccttctgtttcagtctcagctagagcatttaggtgagagttgaggtcccagacctacaaattgattctcaagtatcagactgtatagtgtatactaaatagaaggcatggcttaaaacagtatttaactttgattgaaatagaagatggagaaaaatacactccacattgtttaaccttaactgctgctaattatttaagaatttaaagaaatttaaatgttacaatgcttagaaccaggtaaccacatctgtatctaagagtaaactatacctgagctacaatttatcatatctaatcctaatagttactcatttgaagtttatctgaagtattgtcgcccaaactgttacagagccaaagaaagaggcctgcagtcctaattaatttattcaacaaacactaaacaaacttaaccttatttgaaaaaaaaataataataatttatgaagtcaagccaaagttttacgaatccatttgtttcaaatttaaagtctgcaatgtgtaagagtcctggcacagctgtagagttgtgccttggtgacttgttggtcatgagttcgaattcagaaacaggctctttctatatgcaagggtaaggctgcgtacaatattcctcccccttaccttcgcatagcgaggagcctctagacaatgaggtacatagttttttttagtaatgtgtaagagcataataataaccaatacagtaaaagcttgccaccacaatcatgtatttaaatattttccaccccattttatggacactttgatcttacagattctgtcatccgctaacctccagtcacatacagtaaaaaataaatagatttttgtctttttttgttatataaaatcataatctcccaatcctagtaaaaataaatagatttttgtcttttttgtcaaattagaaaactaaatcaaatggttgaaaagtctgacctgtacatgaccagtatcggcccaagctgcacatatatggggattttgtggcatagagcgtatacggttgacacatccttggtgagcaaccttccgcaactgtagatgcaaaaagaatcaaaatgttagtaacatcaaatttgaagcagtcaagaaatgaaacaataaaaacttaaatgaagaggaagttgcctgcaaactgggaccctgagcaccaccttcttcttcatcctcactatcatcgtcactgtcactatcctcaccatccatttcagtgtcatcagttccaagtttaggcaccggctcacgtctctttccagtaatatttgatactttaaaaattccaatagaattccaagaaggtttctctgcctgtggcacatgcacatgcattgccataacatgactttgttgatcaaaagaagtagaatggagaaaaacaaaggaagcaaagcaagtggacaacataactatgagctgctgggtgttaacttttcttgagataattaccagttataataaataaaaaaaggaaagaaatttatattcaagactcaaaatccctttaaagggaactttctctagtgaatatttgtctacaaagcctaatattcgttaccatttttctcatgaaaccactaaccacctccgatttgattaatgaaacatcctcaaacaaatatatatatatatatatatatatatatatatatatatatatatgaaacaacactgacctgagtccctgccacgaaatatactgtgtggggaaattcttttcgaaccaagcccaaagagtcacgtaaaatatcaaagctgtcaaaagccccaaaatgtatttataataacttgaagattactgatactaagcagaaataaagcaagttcccaataaaggtggctaagattctccactgaattgcaatgccaatgccaaaggaacttcacataacaacatatgatcctatcattattaataataacaataccagctaaaacaaacaggtttgtttatcaaaaaagctcaaagttttgctctctttcctctttctgtggagccaaatagaaaaacagaaaacaaatgaaaagaacaaaaaaggccatgaatgaaaatacctcaaacatggccatccaatgtgaaaggcatgaagagaattgtaagcagaaggatcacactgaagctcttcaccttcctccaacttatccacacccggttgccacaccttcgctgggatttctggcgccaaagatgaagaagacccaccctctttcttcgagccctgaatttttttttgcccacaaatttaaacaaaattttatataaaaaaaatgagaggtgccaacaaaagaccataatgaagtgaggttattataatagaaaacattgaaaagggtacgagattgaaccttcttcttgctcttggctttctgacggtgttttatgccgcgagtcatcttcgagttgggaaaactgagggaagccgaataagtcaatggattataaaggaatcgcataacaacttcttaggtcaaatttttaaaaaccagcatgacgagtccaaatcatatttcataaggtgtaatgttggtctacaaaaaaaataaggattaaaactatttttttatgggatactaaggagagcatactagtaatatgggggactagaaatagcaactccctcgataatttcccccttatatcatcaagagcaacaatgcaaccctaacagcttctgtactatccagaaatatctccaactaacaaaatttagggaatacattttgtttctcaccccgaaaaaatatatagcctcttgttttctttacttcaataaacagatcaatatattttttgtttgcaaatacggataaactattgtttttggtcaaaacacaatccgatttaggccgaaccatgatcaactcataattcgtaggtctttcttttctacacatctttttataatatttccaaaatacccttccccctttccctctcactagcaccccttcccttctcacaggaaacacctccttacctctccctttccattttctctctctctcaatatttcctctttcatctccttttctttccttcacaacccttctatgtcaccagcacaattgtcttttttttccttcacaaatcttacaattttttttgtaatatataaagaagaactatattacaaaatatagtctctatgatgtaattattgttaatatattataaaaactagtttctgtaataaaatcattttgtatatgttatgaaactaatttttgtaatatagttatttttatctagaatgagcttcttgagatgtagaagtttgaggggttttttgaataaccaaggaagctaattcttctatcctttgtttaaactcatccgaagttatttttatataaaattaactacattagaaaaattagtttccttaacacatgtatcacaaattttctatgatacatcccaaaaattcatttaaaaaaatatatttctagtgcaaaaaggggcaaacatgtgaagagtaaaagagaaaaggttacaaatagaatcccatagtttgtttatgccaatgacacacggctagagcaatgtagaaaaatttgggcttagcccataaatcagatcaaaataaagaacaggctaggaagctagcccataaggagcagctttacttgtatttatcacacctcacacacaaccactggttggtgtagtgctatgctatgccaacacaaattttataatttgaccttacttttctcagtccaactccaacacgcaaccaaagcagaagaaacccacaccctctctctatgaatatccccaacttcccgcacacactctccacaactaactaacctccttcaaaacacaaacctcgaaccctaagcactagcatgggttcgtgcagcgcgaaaccctaaccgctttcaaaaactggttctgaaaccgttttgagcaggagtattttaaaaaacggttcaacctggaattctttcataaccggttctgaaccgtactggttttgaaccgagtaaccattggcgcaaaagacatacctgctgtagctattagtcgcagagacgcacgctgtctgggtggagccaccaccgaatggggttttaggggttaatgttggtcgatgtcgtggtacggcttaactagtgtttcaaataaggttttttttaactattattgtaatgtttatttttaaaagattaaggtgtaaatattttttagttcttataattgacaaaagaacctaaataatacattttaaataaaaaattatcaatttagggccatttttaaactatttaccaatctgggacagtgggtcgcgtctaaaattgggcatgactggtcccgccttaatttgggcgtgaccaaggggggtcacgctcagcgtgactaaattcgtcactaaatcggttagcgatcgatttagtgacaaatttttttgtttttctatttttttgtttgcgaccaaaattttgtcgcaaaaactgttagtgaccaaattaacgacggaatatttggttttttattttttatttaatattatttatttttatttttatttaatatgaaagtatttttagattgatcttcatgatagatatgatctgttttacttttaataatattttttatttaatatatttttataattttatatgattttatgtaatatattctggatatatataactaatgtttagtataatattttttatttaataaaatttttcaattttctttcggaatttgcaaaaattaaaaatttttattttttgatacttcctcattttttataaatttttttaaacatttttttaatatagaaagtattttaaatggaatattatatgttgatatttctcattttttatattgagactacctccattaaacacattattatcatccctctcatcatctctttcatcctctcataatttgataattctctttttgttccagtcaaaagcacctagtcaactaactcgttattgaaactacaccgaaactcaggctttctatcaatcggtgactcaattgtgtaaaattagtgtagtcaaaacatatacattcaaccgagaaagggaattagaaaggatcgtccatcttgcatggtgaatgatcaattgtgcgagtaagttggtcaccatctttatctctctgggtaagcgcaatgcaattctttacatttcaatttgattaactttgtctcacgcagttccactcctatttttagagttctgcaatatttcaccgctgtgcacattggaattaatggggtgttacaattccgattattgtgtggtgagtgcactttgggatgagtggaacaagtggtaaaacgtgaaatgagtgcgaaaaagttagaaatgaatgtactctgggataaaaaatccaaaatatattaaacaaaaccatataaaaatttagaatatcgaaaaaagttacaacttttgatagaaatgtccgatcgaggtgtacaatatgtcgaaatgctcgaaattaatagaagtaactagaaaaataaaaaatattagccaattaactgacaaaataattaaaaaattagaaaacaataatttttttgggatttcgaagatttaatcgcaactttgaggcacttaaaggtctcttttgggaaaaatttgcgaccacaagcaataagactaatgtcctcactgatcacaaaactaatttaaaaagttgaacaaaattatgctgtaaaattgacgatgcatataactttgaacaatcataatttttcgtagcaatgtccgatggatacatatttcatgtcaaaatgctcgaaattaagagacgtaattggacaattaaaaaatagcatgcaattaactaattaaatgaataaaaaattagaaaacaagaaattttttgaaggttcaaatattaaatcgtaattttgaggcacttagaggcctcttttgagaaaaaattttggccaagacttgcccaggccttctcctctcaatttcaagcgcgtggccaccggtttcgtctcaatcggacattctagtcaaaagttatgaccgtccgaagtttatatacgcatcgattcacctgtgcatgacacgtggcagaagtaggtcacgcctagaactgggcatgaccagttgccccatattgataaatagtttcaaaactgtcccatttttgtaattttttatttttttttgtatttttttggtttttttgcccttataatttaatatttttaacttttttttaaataattttatttctgtaaattatatttttttatcttaaaatactttaaataatgaaatgttatttaaagttttataagaataaaatataaaacaaacaaaattgaaaataaaaaaaataaaaataatttacaaggataaaatttaaaaataattaaaaatgtatttaaacttaaaattaataataaataaatattttaatatataattaaaatttatgataagatatatttttaaatatataaattatttattcattcataattctattagaaatttttaattcaatttaaaggtacaggtgattaagataaaaaaaataaaatatttaaaaaaaataaaatctttaaaaaataatatagttaacatgaaaaaataaactttgaaaattaaatttaaattgaaactaattaacatgaaaataatcttatcttttgaaaaatataatgtaagcatatgtgtatttttgttgtttgtatgttatgggttattttatgttggacattatattttgtaatcatctttaaaaaaaattaaatcctcttaatatccttcatcacatcacaaaaaaaaattattttattttcttttcaatctttatcgttttctttaaagaagattctcttaattttctactcttatcatttcattatccatccttgtggaaaattcattgttcaaaaatctaattgattttgtttgggaagagatttcatgcatatgcgttaaaggattggtgggacagaagaaaatcttttttcttgattttttttataacaaatgttaattattaatttttgttaataaaaactattcaaattcatgaccttttcattttctttctctcttcaaccaccaagtcaaccttataattctcattcttcccttgaactcaaatatcttcctctccttctgtatccttaggaaaatccaacgttgaaacctaacaaggtaatgaaagctttggcttttttgtatttgattactttagtttgatatgaaatttgcttgagaaggaaccataattgtgttaaaggattggtggaatagaacaaaactcctcccttagacttaaatgtcttctttccttttcctctccttaggaaaaatccagatagaagctttagtttttttgtagtatttgactactttggtttgatatgattttttcttgagatgaatgtattgatgtcataactgtattttttaggaaataacttaataagttgatattatatttacaaatgaaaataatccatgattgatattggtcattgaatttttaatcttcgctcatgagattaaggataatttataaacactatttttgcttaatcccattaagacgccttctaataagaacaaaatcacgaccgaactattgagcaccaaaataaataataactcaaatatattaactcctaataacatcaacgaacttgaggtcgcgacactagcgttgaaccgaaagtttaagccacttttgccctcagtatcaattgggggaacatctttcaatatttcaaaagttttatattacttagaagtcgagattaaatgttgtataactattacatataaagctcccctataattatatttttccgcataaacagtctctcattacatctattaccacaattttgacattaactttcccttttccttggccgataattgggatttatattttatagtatccatgattgaatccaagtggagaagatgttttataagagaaaaatatcctcttcatttattggaggagtccattaggaggaagacatacacacaggctttgtggaatccatcaatatgatatagagaagaactagatcattttataacactttttatttttttactattcataattattattccaattttaagtccgttgatatcatttgagttatcggaggagtccattagaaaagagacatacacataagctttgtggaatccatcaatatgatctagagaagaactagatcattttataacactttttttctatccaatccatcatagtacattttaataaagacagaattgtaacaacatcatcaaacaccaaaatatataatatttgataactcagatgatatcaacggacttaaaattagaataatacttacgaatagtaaaaaataatgaaaaataaagagaattaggtttctattgaaacttttggaaaacttcgtaaataaataaaaaatattaaaaaaactacttgatattaacgtgtcaacctaccttgtgcgtcctacctctaccctaacatgtcacaatccacatgtcaatgatgtcatgctaggcgaatttcaagtaaatacatgtaactcagttcattaaaaatgatgggctgagcaaaaaattcaattcatttttgttacatttttttaattctacagtaaaattagtgtcaaatataagcaaacaacaaaggtgttcatcatatttttcacaacataaaacacaggtttattacccccatttaaaattctctaaccgtaagtccatcttctccttctatagaggttttttaaccaagaaatcaaaaagatcacactaatagtaggattttggtatcatctgaaaatcaattatttttccaaaattaaagtgggatgaatagttattaaagaaacgagtgaaagctgggaaaccataattacaacaactccttgccacaatgtcactcattgcatgccacttatgagaaatgagtggaaaatggcatcgattagctttggagggccttttccgtaaacctaacaaaatcatcattcgcattcagactaatcatcccgtgtgcgtgcaagaaaggagccactggggatgcaccacgctttgtaccacaaaaactctcaaggacacataacataacacattgcattatcatatctcacacttctcactcctccccttttggcttttgcaatgtcaatgtaaaattaatggctgttggtaagcagtaattaatgcgaatatttttttatggtctagggacgttttaatgaagaggttaaaaaataatttatttgatatttcaagaaagtaaaaattctttacaccatcaactaattataaaatatcaccttttttaaaaaaagtttaaatttcattctaattattttaaaagtcacatgataaaagaagaaaatttatattgataacaattaaactctaaaaaatagtgtgtacttgatcctcgaccttatctgcctgtgcataaaaaaaatagtgtgcattttttaagaatgtcaagtgttaaaataaataaataaaaatctcagattaaataacatagataaattaaacaatacataagagatttgtacttatactttatacttataaatgaaaaaaagtcctttcaaaagaataaatggtgaaaggaaaaaaatctttttaactttttaacaatatgcaatttgtaaccaaaatgtagttaaagtgtcgcaaggaaaataaattgttagtccaattgttattatatttaatatttttaagcagatttgagctgtaaattaaaaaaaaagtaattagaaggagaagatttcattaaaatgaacaattattcagattttttataaacttgataaatatttcatatcaatgctaaaaagaaaaaaagtggcgcacgggtgggtgagtaaaagtccgtcctgtgtggtaggcaacgtggaaaatgaagagcgggtaaacaaggagagagagagagagagaggtttttacacaaaggagaattgagttgggttgggggcatggaagaagaagaagggcttgccatgctcatcactcaccttcaccatttctctcactctctttctcctccttttacccttcaccctccagtctctcatcaaatccccaggtcccctcctttctcctagatttacttccaatgcattttttttcctaaaaaaatgtttttaattctccacctgttttgtttggactcaggatgctgtttttctctctacactttactttttgttttcttttatgtttttgtgaacctcatttgttcataaaccataacaaggttgatcctatttttgttaaccagttggttggttggttggttagttagtttgtttctgctctgaaatgtgcaatcattaacaacatgcttcctgaaaacataacctagatgttagattttctgttggttgtcttgttttgtgtgtgtgtgttgttacatgattcattatctgtaattagagcataaattgtgaaacttacgaagatgacttggcccttggtttcccatgtgcttgattttgttctttttgtcatagagaaagttaactggtacaatttgatgatttttgcacattgttgcttgtgttctgaacttgggaagtctcattgttctcagggtagtttgagtaggtttacatcaaattttggcataaaaaaataaaagaggtggatttgattcagacacagattaaaaaaatatgatgatttagaaacatgttgagaaacacgcaagtaagaacaatacaaccattttctattgaggttagaggcaatttctttgctttaacaacacaggcaagttatcatcactaggtccactctcaaagctgtcagggtgtgcatgcctgtatcttaatcacggtgtaaaatgttgataatacttgatcgtaagctttctgaagaatgcttgttaagaagggatggatcaccttggtccttttgtataaaatacggtttcttttgcacgacaagagataggaacagtgctttaatgggcttaacatcaaattgtcaaatttggctagaagcaatccttgcaaagattacagtctgacatggccatttattatttcctcatttactggctactaaaaatcccttacttctaagggtatgattgggagttgggttttggagggaaaggtaaggaaagcaaaattttcatttcttaaaaaacattcacttatttgatagtttttgaaaataaatgaaataaaatgacaaattaacattaatttaacgtcctgatctttgatttatttttatacattttatataactctcttaattttttttttaaaaaaattgcccatccttccttttccctccaaaacctcactcccaaacacaccctaaattgttggttttactatctcatcttatatattcatatttgaacatttatgctttaagtgtctgttctaactgtgtgactaccattattggataaacaacatatggtctggattttgtgcattttgtctttgtcctagtgttatacaaaggaaaagctttcttatcaacttagcaccttggattactgatgtattcaatttgatgatataactgtatatcctcttgatccttgaaatatgcagtagggtcagtcttattttggaataaaatatcaatttgtgcattaatgttatggtctgattttgagcttttttccaatgaattgtgctggtctttttatgcatctttgttctactacagtactactaaattaaatgaagtatatgaatatatttgaacatccttttcgcagattgactttctttgacattgatgattactccgtagatgacttctgtggccttgtaatggcagctggaaagtctggaagttccaggatgatggaacctctaaagcatccatctaagaagtctcgaagagataggagccgtggaaaatcatctggaaggtcctccagggatgaagctatggaacaacaaatttggaaaaatttgcctgaggatctatttgagcctgtgattgcacgacttcccattgccacatttttccgcttccgctctgtatgccagcaatggaattccttgctgacttctcaaagtttttctctgcattgtgctcaagtcccacaagcaaacccatggttttacactataactcatgaacatgcaaattctggagccatgtatgacccttctatgaagaagtggtaccatcccactatatcaacactgcccgcagagttgatagttttaccagtggcttctgcagggggtctagtttgttttcttgacatttatcatcaaaatttctatgtttgtaacccattgactcaatccttaaaggagttaccagctcaatcagttagggttgggtctcgtgctgcgataggaatgacagtaaatgggaactcaactggtgctggctacaagatcctattggtgggttgtgatggagattatgaaatttatgactcagtaacaaagtcttggagccatccagaaaacatggattcagatattaagctgccactgtcactcaattttaggtcacacgctgtttctattgacagcaccctgtacttcttgcattcagatcccaaagggattgttttgtatgatatggaaactggggtttggacacagtacataatcccagcgccattgcatctgactgaccacatgctggccgagtgtgatggccggctattgcttgtggggctgctcacaaagaatgcagccacatgtatatgcatatgggagctgcagaagatgactttcttgtggaaggaggttgacagaatgccaaacgtctggtgcttggacttttacgggaagcacgttagaatgacttgcttgggaaacaaaggcttgctcatgttatccttgagatcaagacaaatgaatcgattggttacttacaacatagcaagtagggaatgggtgaaggttccttggtgtctggtgccacatggaagaaaacggcaatggatagcacatggtactgcattttatccatgcctcactgcaatggcctgatgtagcttgtataatacagcaatgacctgagaatatttccctcaaaacatgaggttctttgcaatttgctggtaattgatgctgatgtaggaataataatgttcattgctggttaacaaagcagatggaaaatgatatgggtttgtagtacttcatgtatttttcatgctctgaaacatgcaccttgatcacttgctttcaagacttttccctgtatatgaaagttgtgaaggtttaattccagctagtatcattcatgttttcaagctggaaggtccaaactggggttggctctaccaactagaattgaagccttgtgaatcaggggagaggcatataaagaacctaaaacgttctcaacctggccttgcagtctggtgtcacttggctgcctcatgctgaatccttgttgctcttgcagtcctgcattacatatatatataacatcatgtttctaaagatatttgtgacttcaaaaggtgtgttcttccacatttgagctgttgagactgctgtctgctaagtgcaaactgtggcttttctcaggttgcttacagcgtcacacgggaaagaagctgggatttcaattttgatggctcctcccaactactcaatgtagtacccttcaagtgaaggtcattattattttacggcttatgattgttgtttctattttgagacagtgaagaaccaaccactatacagtattttgcgtttgaccgcagaatagagatttcgatacagtaactttgtttcgcttgtcaaaacataaaagatgaagaagagtgatttctttcaacgtttcaggttgccaacttgttctggctcgaaaatacaaaagctatcttttgagggtataataaagaaaaatgatacatataaataaaaaaatatttcttataaaaaaaaaacaaaccttatatggagcaaagttaaacatttattttgagtttataagtggtttatgatgaaaaaaaaagaaaaactcaatctttaacttagcattaggggatgcaacatttcataaagtttataatgctttaagtggtttacatttttttttaattcaaattgagttgatgacaagtattctgtttgtattataaagtaaataatctttagtgctttgggataactgcgtcagactgtatggaaactcccgtttcaaagtctgcaggacaacggatagctctcaaaggaatcatggagtttttcatttcacattatcttttgaaagttgaaaccctttcaaattgacttctctaaggtgaattaaatttatattatttattttactctaaatgttgaaccacattataattcatcactcaatcggagaactcctgtcatgagtcatgacactggggattaataaaacagtctttgtggttcaaaacctctttagtcctcgcttctcaccatgggcagctttggctttttgcatgcattataatattcaccccaacgtaagtaattggtagaattaaagacaagacaaacaaaagttatatttttaattaaaaatccttaaaagttcatcaaaacatgaacaggaaccgggtcttgtacaagtacagtacatgtggagaagtattagcattttctacgaggaggctaagaaagagatgatgacacaatccaaaataaagctccatttaagccatgcctccactcgttgctgtcctgattatctggaagagagctgtccatgaaaagagaacacataagtcaatggaactagaaagcaccggctatgaaaatgcaaatggtggaagaaaggtaaatacaatctaacacactccttagcacatatatcacctttagctcaagcgacaccaattccttccagggattgcttaacctggatcgaattccactaaagcatacccttccctaccagctctactaaaatcctttagacacccgcatacacataaataaacaagcaaaagtatttttgttatgaatgcaagaccccaccattttgattcaacgagtattgcaatccaaattattttcatattttttttggcagaggccatcagaaaatatttcctcttcaattccgggtttcaaccataaattagctattcacgtgctttggctataaaggcgtatggatgttgttgttaaccaccaacactttatggaatacaagacatatcacataagaagcaatgtaacgattgcttgcttgcttattttcttctgaaatgatatagttgataagttgcaaacatttattggcatccgacttttcgagtatgcttaaatatatacagtcaacaacaaatgtttaaacccacgacaggaatagagacaaacatcacggtcatttagtttgagaaaacgattatgtttttatattatgttttccttttcagttacaaaaaaatctgaccgtgttttgtatttacaaaagtttgtttatcaaacacttaaacacaaaaaacaataaaaaaaagttaattttactggttcttctacaaagttttaaaaatagaaaataaaccaaaaacaatgtggcgtttttgtaattaaaacaacaacatcaaagccttatctgactacactagatgagattcgttacatgaatcacatgaagtcacatgttttttataattgaaaatgaaaacaaaatagtagaaaacattttgccaccaaaagaaacgaataagatgatgtagaaatgtttctcttacatgatccaatgacaacaaagacgaagaaaccgagcagcactgggccaacagggtagtcttttccctttttagtggttgtgtctggcacaaatcctcttttggtgatgttcttctcaaacttctccaccttcctgtccgcaaggcgccttgatgtcgtctacacaaaaccacaatttccacatttcaatttcaattagcattgcaaaaatcaaacaaacaaaaccaatcaacaagagttgcatagcataacacagggacggcacaattggatttggatggcaccagatccgatccataagctaacgaaacatttcacaatcagaactaataaccataaaattcagaagttaattcgacgtataaataactataacaacaaaacccctacgtcaacaacattattatcaggaatcaattaataatttgagtatttgacctaattttcacaacatcctgattctaattgcagaaatccaaagagatttaagcaatagagtgaattccaattctaaaccaaatcaaattctaatgtcattctcgaaaatttcaaacacgacaaatcagatatcacggataagaaaaataaaaaataaaaaccaaagtcggcaacacaaaaacaagacggagaaagagaaactgtagataaaaaacgagagtgtgaaagtcaacgaagcagtggcgttagagaatgaatgagtgaattaccatttctgttaaggaatagggatcgccggaaaacggtgatggaagaaaccagagatcgccggaaaatgaaagacggtatttatcttcttccggcaatgccctcttcaaccttatttgtgaatgcgtgatccgagtgaaacacggtttctcgttgtttctcccttttactattagtatttattttatatttaacaaacctatttttgttcaactacaattaatttagtggatccccgataatagcgtcacggcttcttaccgattggccaatgccatgtcactgggacacgcggcgtaaggttattcgaacagctttaatacactgcgtgaacaagtcttcgagatggctccaattaggcgtgttaggttaatcattttttttacgaaattataataattgattcacctaaaatgaacagaagaagtttacgtacgtaatttaccttagaacggtgttttgttactatcagaaagggaaatgataagcatcagcaaaccattgttgtataacttgatttaaaaaaattgtggaacattttcacatcatttaggtatgttcaggattacgttaacttgatagtacatttgataatttaaattaaactcaaatgataaatgtttattttgtataataaatatttttaatatataaattattatattataataaattaatagcttgaaatttaaatacataaattatattttagatttataatgaataatttaaattatactataattttttaaattatttacattttaaaaaatatatatcaaattttaatttaaaaataagaaagattgaatgatatagacaattaggatattcttaaccatgtactattttcaatatattttctttcaattatataaaaatgaacaatgatcctgtataatatacaaagtaaaatactaatttataatatagaagtaaatacacaatttaatttacgtaagctatataatatttttacacaaataactaagaaaacttgattatttatttgttttactatttcagttaacaaaaaacacatgttacccatttaatcatcacttatctaaaatattaatttattattttttaaaagtaatattaagccttttttcgttttacatcttttaaactggaaaacaaaaaaattcttctacgaacaacccaaacataaagatgccttttatcaactcgacctttatcctctccattcaccgatttctttgtttaactagtaaaaaatctgctatgatcataaatgcctaatgttcaaattgatctatgtcagtcaccaaattgagtggcaacctatctcacatgattatcaatctttctattcttcatcaattgtaaaatactttgtactatgatcccttgatgagaacaaagtaaaattaaaacattaattcatccatgcatcaaatatgaaatattacatggcctcaaaatgaacatcaagatatatacaattttctcactcttttattcatttatattttttttatatcaaatctctcctttatcaaaaatcagaaaccttacccaatgaccatagaatttagtgggtaacatatgttcaatctatgggaaaagatctgaatttgatatgagagcatacatttttggaaatggataatgagttttaagtgtgattaagtcctattgatgagtcccataattggttcaacggattaaaacttgttggaataccttaaaatatcattggaaaacctaatgtcttaattatggtgacactaaaaccaaaaaaaaaaaaaaaacttatatgaaatattttggtgaacaaggccgcaaagtcgcgttgaataaggatttcctaggctagaataaatgccacgaaaccaattcaggccacagtagtgcttactagagggatatctcaagcccatatttttttaagacatttggtggagttttgggcttactagactgtactcaattttataagcctgcttgttattaacttaaaaaaagtacgacatcatgttggaaaaaaatatacacactcatttataatataagaatattttgttttgtcatctaataataaattatactagtaataaacttgttgtttttaaaataattattttaaaaattatattaaaaaatctaattaatttatgatataaaataattatactagtaatttaataagaaatgtattaatattatgttggttcaaatagaatttgattcaaattttttaaataagattttatttttttagattataggtattttctatggaagataattatgtttaagttggataagactattaagaatgacaaaatttgttcttcgagtttttaagacaattgcatatttaagatttgaattcaactttaggttaaattggaacaatctcaagctagttgatgtatgtgtttgatgattttcaaataagattttaagtttgaatgttttaaatgaaataaatgtaattatgagaataattttaccaaaaatatcaggcaaaaatctctaataaaaaataatcattaagaaaataattcatcacacctaagtggtggtaaaaagaaaaaaaaaattcaagaaggaaagttggagctcttcaaatatcccggcaggtcggctgttgttctgttaatggaagcaggtcattgtctaaaaacaagcaaaaaaacaaaaaacttgttcgatttatttaactaccccgcatcggaccccaaaaaataaaactatataccacttggtaattgtttatgctttctacttttgacactcacaacaagttttaattctgacttgtcaattaccactatagtctttcattcacattaagcacatgtttgatttggtttagattaaaacatgttatttttcttcttctttaaactctctccaaaaagtgtaaaaaataagtaattactttttcaaaacaaactaaaccaaataagtaccaataataaaactatattgcatatacagtataccactcatgcttcttcttagtttaccccttagttttatggaatatttgattatttactatcttttactagaggcattaggcaacaatgattgcaacgaagaatcttctctggcttgcagaaacattttgctttccattttacctaaaagaaaaggcttcgtaaacatttcttcaataaaaatacattacaaataagataatttgaagatttaggactttatgtaaaaaaaaaattaaaaaaaaaccgaccatacaagtttatataattttatttatacagaatgtgaataatatttttattttgagatatgtgaataatattttattgttgatgctttaaactttttgtgatatatcatatggttttcaaaaaacttggtggcacctttctgagataaagcacgttgaagtggtttcttacttaatttgatctcaccttgcctcttccaaattagcaccctgcatgtccctactcatcatcttgcgggtcttggaagcataaacatcaacacgtcctttttaaaaatgtttaaaaccaacattcaactaatccagtcccactaatgtgaacacgtcatactattttttaaacactgttccaaacaataatttgtaccattagtatgatatggttaataagttaattacaatattaaaagttatcatcgcacaagacatatgtgacgaaaataaagatggagggagaaacaaaataactttaattttatacctaggttgcttgtcatgctaatattaattgttttaaccctctttgtcctcatgggattgacatgtagtttgtttggtttagtggccgccgtactccatccttatatattagttgaataaatggattagttcaatccacattgatgtacatttaaataaattagaataggatagttttttgtaaggttcatgtctaacttacctagctcgtgggttaatagactgttctgtaagttgaaagattaaaaaattcgagaccaatattttttttctattcaattatttaatgtgtttaatttcctttgctcaaggcctcaagcaagataggtgcttgaagttgtttgcttcagttgaccaagatgggtgccttgtgtacgcacctgataaagttaatagaaaaggaaaactggtgacgatagaaagtggttattggttggagatgcttatgttttgaacttttgataagtgggatattgttgtgggtagaggtgattggacaagttttgctatttgatgcaaaaatagtggtgtctatttttcctcaaaagtgcccaaaccatgcatggttagcttacatttatgataagttaatcttataattaaaatgataaaaaaaattatttactacaagtattctacagaaaaaacaaaaatacatgaaatgttaaacattattaacttactgtaatactgtatagtataatttagagtcgccagtttcttcagaatttgtttaattccaatcgctattaatagcattgaggcattgccaaattgccttccacttctcgtggcgcacaaacaaggattacgcatattgttcagggccggatccagaaaaaaaaaaaaataagggaggtaataatggtggggattaggaggcggcgcttccaaaatttttttttgaagaaaattaaagaaacaaattattataacaaaagtgtgaaaaatgtataatttaaaagataaaaaattaacaaaattagaatgtgattggtgctcaaaagtaaaagtgtagtcactgcattcataaaagttacaaacatacatatccacactcactcttttcttatttttcatcctttcttatttttcatctttttttattattttttttctatgtttttcatttttttctcttatacaaagtttaaattatttttttattttactttattttattattataaaaaaaattctattcttgagaatttaaagggggacattgcctccaatttaacacctgcgtccgcccatgattcaggtgaccctacattatttgatattgattatgcatgttttagttattattcttcgttagtaattaatttaatcatgttttattacattaatgatattttattaccattttctttactgtcattgtacgatataattccaactggatcataattcgtcatggtaggttgcgtgtcttcttatgaattttctgattatttttctttgaattttttagagtatttatctcatttcataagtgacagattaatttcttaaacataaacagatattaaaatgatgatatttttcacaagttgagctcaagatcgcgtgttcaagaatccaagtcacttccatcagatgtatctataggtcctattttgataataacaagatttattttgataataacaagatttaattaaagatgtttgttaatttatgtttatttatcacggggtatttttaatccctttacctgtcccattgcacttgacatgtacaccggtacacgtatgtatatttaattattaattaatatacacaaaagaagatcctgttggggaaatgggaatgcccatgtttaaaaacaacgtcacgttgcacattcaatgaatgtgtgtttaatatcatgttacaaaaattgattataaattcaaaattgatttatgatatactttttacatgtttaattttatgttaaaaaaatccaaaaaaagttataagttgaagtaacttaatttaaatagtttcgattagatccaaaaatttgtattaaattttactctaactaaattttataataacaaaaatatttaaacataaatcacgtcattttaaaatcaattttaaaattagtttcattcaaaatcaattttaacactcatccaaacacacattaaacaatttatgtcatgttacttgagggcagtaccacgaatgaactagtagagattattttcatttttttctttttttacagatttttttaattgtaaaaaattatacaatcaattaataaaaaaatattatataacttttaagacaaataatattgaaattaaaaaattcgatatacataatactcctacgaatatgaagtataacaatttgtaattaaatgacttttgcattcattattttttcttgagataaagaaaaattataattcaatcattattcataattataacaagtttttttgccttcattatctgctcatacgaatgaggtataacaattttatcggggactgtacttttattttaatccatctatatgtatatgatcatgtacaattcacttggtcaaagtactcgttttatagtttccgtaccagctatttcttacaaaatattatatctgaggcaagaaaataatttatataaatttatgaactatttaaacaataacaattctggtccaaattccgcctttcattattttattcaattatgtgtttatctaacgtaaaaagcatttttgagtactatgagaagtggaaatacaggtgtaaaacgggttaactcaactaaaaaagggttgggattgggctgaacccgttgtttttttagagtgaaagttttaacgtaattcatctgtgacggattgtgggttgagttcactcgccaatttattttttcaaataaaataaattatttaattattttatttatcttaaaaaacttacaaatttcataatcaaatgtaattttaaaaaagataaatgttataaaattagtaaatcaaataaatatttaagagattatcataaaaaaatgtaagtgttaaatgtaatttcactttaacaaataaaaaaaagatgatggattgaaaatttcaatccaatcctttagacgagttatgtagttgatgtatcgagttaaatctgttttgacatccataaatagaaagatgtgattattgtttactatatataaacatgttttaacattttaaatgcatttataaactttgacagtgcattagatatttgttagttttttttatcattatgatattagtgtaaattatctttcaattttgttgatgattaatatttatcaaaaaatttgattaattatctttattgaggtatttcctttaaagtctcaatcaagttttttttttcagctacaaaatttgaagacctaattgtttaaagaattcaagtttattatcactttgactgatgacatgttaatagatatttgttagtttctactatctcttttacacctattatattttcttagacgctataaaataagctgaggtgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttagacgctataaaatacgctgaggttgaatcattgatatatttgttgaggagaaattgatctaattcaaagttgttgatgtttataatgataaatcatataaaaaagagattaagttacaagaataatattttcattactaaatatatcatacaacctaattttactcactagtctatataataatgtcaagttgaatataatcaacatattgcggaatgtgtaaacatttcctcacttgtaaaatacatacacaaattttgtttaagagnnnnnnnnnntttatacaatagtatatttattcagtatctcactttttaagagaaattcaaaatatataatagaagttattttttttaattgtttagcttatttatgtcgattgattgatttttgtacgcggaattggtatagtatttaacatataaaattagttttgaagttgaacctttgtctacatcatgctgagaaagctctgatgatgtgttgtttttaatatttatttcaataagcatttaataagtcatcaaaccacgcaaaacatgagaactcgagctgctctttactaaatgatacaataaacaagctaggtactaaaattgtttatatataaattaaatagaagaactaactatttatatgcatctataattaattaaatagaataatttaattcatcgattaaactgaccaaactataataacgaatattatttaatatttgaatactactactatttactttatttttaaattcattgattggatattgcaaaaagtaacttccaagagatacttgcgagccatgaatcatctggttattaaccacccccttcttcacacgatattttaaacaatattggagtacttatatgaatattggagtacttatatgaatgatttcttcacacgatattttaacaatattggagtacttatatgaatgatttaatctttaacacaagcctgacagacaatactaagcggaaattttattttatgattattatgatgagtatggttaatcgatggcttcaagaaaccagttaaaaaattaaaaattaaaaattaagaacaaataaaaaacaataaacaatataattttacacattttaatattttttaatttcttaataaatgttctaataaatatttcttatatgacaacattcatttggaatagggcaagaaagttgtgattggtacaaaatacagattttgtgagtttacactggatatcctcttagaaagaacttttaatttcagaggacacaaaaaaagaagtgagtagtgatgacctaatcattttatggccactctctttctctttgattaagtgtcttctattcttgtctttctctttccatctaaattaccactttgcattctttgatgctccccaaatacttataaaattatgtttttgttcaatttcttaaatagttactatgaagaccacttttattttatatatcgaataacattatcgtagttggagattccctgccttatttcattcaattattacataaatcaggtttttagttttaatttttacaataaacaaacctttttttaattttttttttttggatctgaatacacgttaaagccatatttgggggcctaataaatacccttacatatggaatgctcaaaaagttaaaactaggacactacaatattaggaaaggggagaaaaaaagaaaagagagagaacaagttctaatgggtaaagtgacaaatgacctaaattctctcacaatgttcccattcttgtgttggatcaattaaatattggcagaggagagtggtaaacagtgatgttcttatagtatagtgtctgaattcagcgtaaagttagatatgtggctaggtgcaactaaactaaaactataaactaaacagtagacagattcgagggggaaagaagaagaagagaaataacacctcgagaggttctaatcatgcgtggtgcctctatctatctatatacctacgtcttttgactctgggtcctccctcccatggcaattttgataaagtactacggggtatcaaatgccattgtgagcaaaagaagcttacgccttcttcttgaaattttggttccatgcaggggcacttttgccaacacaaaagtacagctaaacaaacacacgcacgcagagttaacgacttagcgtgaagaagttgtctactggcatggacggatagggatgtgaacacaaagcaaacaaaagttataaaaggctgtgatttctgctcagtgggactatgccttttctgccctctattttgttattattgttattacacttgtgttcaaaatatacaataataaatttattttttataataagcttgttaaaatatattaatgtttattgctatattcttttgacaagtattgttttttgagtggatagtttggaaagagataatggcctataataatatattttaaaaacatttgtgctatgctaccgtattattcttatcatctttgctttgccaaattctcctactacctgagctcgatgaacaacaactcattgctttaaagctcttgtcagcttcattctccatgtttaagtgaccttttctttacagtgtgcagctaacttctaagaaataaaaataaaaatctctcgaacacactcacgtgcttgtgttgttcttgtttggttctagggccatgaagtgcgagctagtagagcttctttgcagagtgatagtgaaaatcgaatcttttgtaggtttagttttggcccttcctttttgttctgcgccttggttggtagctgctgctagctgacaagataataaggagtatcaatttctgtttagaattagaaacccagaatcttgtgattcttttattctttaaagggtatttgaatttttcttatctgcctctagtttcagtgttcattttgcatttctgaattttaagctattggggtggataagacagcatcttatcaaggtcacatctcttattattatttttaataaagatgtcttttttatttttccttccccttcaacctacttgtttttaggaattgggtttgtgttggtggtggtgttgttcatcaaaatcttgaattttcttcaaccacaagcctaaaaaacaaatcttttagtgaataggtgtgtgttagccttgtggggattctgtggatttgacagcggttctctcctctcctctctctctctgcctctgtctctgtctctgtctctctctctctctctctcacacacacacacaagcctacctggaatcagctagagttgacacccacaacctgtttgaactgtttctttttaacttgtgttggttactgttgtggatgagtttgctccatgtagttgggtttggtctaaaagtggggcatctacttttggtgctatgttgctgggttgtgtctgtcgtttaccttaactggtttattagcagtggaattatggaaaccaagatgatgggtggtggtggtggtgctggcaagatgtggcacaaaaaatggtgggagaagatatcagggcagggttgcaaaatccaccaacagtactaccagtatattggctctaagaaagttaagagagcgttatggaggaagattttgctgacatgggtcgtgggttggttcatagtatctttgtggatcttctgctacatgagcttgcaaggtactgagaagaggaaagaaactcttgcaagcatgtgtgatgaaagggctaggatgctgcaggatcagtttaatgtcagtatgaaccatatccaagccatgtccattctgatctccacctttcaccatgctaagagcccctcagccatcgatcaggtactagtctttactttgttattgcaaatcaggacctaattcctcaccttttgcttttagtctttgtttatgttaccttaatttctgtacacataggtttctgagttgtttcattgtcattaattttagtgtctaatagcattattcccccccctctcgtggaaaatttattcggattttagtattatatgttttgctaacaaggttactgaacttgagcatgacctgatttccttgtttccccaccttcttgttggatagaaaagatcctactttcttctatccttcaatctttagtctcatctctacaaattaatctaacttccaaaacttgcagaaaacttttgcaaagtacacagaaagaacagcttttgagaggcctcttacaggtggtgttgcgtatgcggtaagggtgctccattctgaaagggaacaatttgaaaagcagcaaggttggactatcaagaggatggatactctagagcagaacccagttcataaggacgactatgccccagaggcattggagccatcccccgttcaggaagaatatgctcctgtcatctttgcacaagatacaattgcacatgtgatttctgttaatgtgctttctggaaaggtaggtttctgatacttgcaaaattttatttgtggagctagtctgagccatatattattaattatgaaaattgtgaaaatgctatacaataaactttgatgtcttgatcataattttaattcatccattctaagctctttattcctggtagtatggttttgactggtcttttagtggtcattaatttgttttgggagaatatttatgaagaaaaaactatctatgctaccattttgttgtttttgtacccttgtgcttcctttctcttgcttgtcctgatgggactgctcctgatggagaatagtacacgtgaatagactctaattttgtgaatatcacaaacctgaattgagacacgttgttcttgtttgatatctgaaatctatggcaatttatttggaattatgattgtcacagttattcacttgttcatcaacaggaagaccgtgaaaatgtgctgcgtgcaagagaatctggcaaaggggttttaacggcacccttcaggctgctcaaaacaaataggctaggggttatcctgacatttgctgtctacaagagagatcttccatcaaatgcaaccccaaatgaaaggattcaagcaaccgacgggtgtgcctaaatttttgattttttttgcatctgtcattcattaatttttttggtaattttttatgattttttatcattcatataatttagcttattcccttttggtcatctaaagctttgaagtaactagtctactaaataattaattgatgcattcaaatttttggagagaatattatgaactctattaatgtagaaggatgaacaattattggttcttccctgtgataattagaagttttggaagttacaaatctacttttaaattcaataaaactgatggtaaaaagaaaaagaaattatgaacacagttaaagagagtagcaaattttatgtcttcactactgcttgctgggcaggtatctagggggagtctttgatgttgagtcattagtggagaaattacttcagcaacttgctagcaagcaaagtgtaattgttaatgtgtatgatactacaaatcatactcatccaattgccatgtatggctcaaatgaatcaggggatgttttctttcacatcagcactcttaactttggagacccttttaggaagcatgagatgcactgcaggtaagagtaatgctacagaagaaatctaatatctccgtcctccttaatgctcagtgtagtttgtaagaataacagtgtgccaccttgaaataggtggaggatatgacttaatacttcatgatttagtggttttgctgctagcaatacctagtctagagttgttttatctggagttgtcatacttttttagggccattgaatctaactatttttattttaatatatattacaattaaaatgtacaaattgtcaaaagacttgaagtattcatgaaaattaagcttgatggtaatgcaggttcaagaagaagccaccatggccatgggtagcaataactacttcaattggtatccttgttattgcactccttgttggacatattttccatgccactgtgaatcgaattgccgaagtagaagatgattatcgtaaggagatggaacttaaaaaacaagctgaggcggctgatgttgcaaaatcccaggtatgtaacttttattttattttatttattttttgaacttgtttttgcttaactcatactgatcatgtgggctttatccattgtaaccacagtttcttgctactgtttcccatgaaatcagaacaccaatgaatggtgttttaggtgagttgtcttctgtctatggtttagtcgattatccaatttttaatttttaactatatacattccacaaaaaagaagagcttcttcagccatgaccctgctctaaattggattttcagggatgttgcatatgcttatggacacagatctagatgttacccaacaggaatatgtcaggacagcacaggaaagtggaaaagctctggtgtcacttataaatgaggttttggatcaggctaagattgaatttggtaagctagagcttgaggctgtgctctttgacatacgggcaattttggatgatgtattgtcgctattttctgagaagtctcaaggaaaaggagtagaggtaatatatctctcgtctactgtgcctttttatcatgatggaattttcaaaatgtgcatagtctaactatagttaatggcttttcataatatttttttgggaactgcagttggcagtttatgtgtcagatcaggttcctgaactactaataggtgatccaggaagatttcgacaaataattactaatctcatgggtaactccattaaggtaagtttatggtagagagaagaacattatgtataattcaagttatttagtctgatatccttcatataagttacttagagaagttcccttgtcctacatccttgccttataggcatgctacggtcatcatagtctcatgaaaaaaatattctatttactatcctgacacatcggtaaagttgtgccttgatgacttgttggttatgggttcgaatccggaaacagtctctttgtatatgcaagggtaagactgctacaatatcccccccctcctccccttaccttcgcatagcgaggagcctctgggtaatggggtacgtagtttttagttttttactgttctagccaagcatgactactaatagagcaaaattgatgtgtatttcttgaaaatattattaaaactgattctgtaattgtttggcagttcacggacaaaggacatatttttgtcacaatccatcttgttgaggaggttgtccattcaatagaggttgacaaagaatccaactcagaaaataccttgagtggctcccctgttgctgatagtcgccggagctgggaaggattcaaggctttcagtcaagagggacctcttggttccttttcaaccccctccaatgatcttgtcaatttgattgtatctgttgaagatacaggtgaaggtattcctcttgaatctcagccactcatctacaccccattcatgcaggtaggtccatccatctcccgaaagcatggaggaacaggcattggcctaagcattagcaagtgtttggtgggcctcatgaatggggaaattggatttgtgagcatacccaagactggatccacattcacttttactgctgtattcaccaatggacactgcagttcaaatgagtgcaaaattcagcaaatcaacaaccaacctcagtctgcatcttcagaattcgaggggatgactgcattaattattgacccaagatctgttagagcaaaagtgtctagatatcacatccaacggcttggcattcatgttgagatggtttcagatttaaatcaaggtttgtcaatcataagcaatgggaatatagttattaatatggttttgattgagcaggaggtttgggatagagatttagtcttgtcatctcactttgtcaataactcaaggagaatggaccagggggttcctccaaagctgttcattcttgttaattctagtagttcttttaaagctagtgtaaacttgggtgttcataatcctactgtcatcaccaaacctctgagagcgagtatgcttgctgcctcactacaacgagccatgggtgtccaaaacaagggagctcctcatagagagcttcaaagtttgtctcttcgccatcttcttcgtggcaggaaaattctaattgtagacgacaatagtgtgaaccgtgcagtagcagctggtgcattgaaaaagtatggagcagatgtggtttgtgttagctgtggaaaagatgccatctcttccttgaagccaccccatcagtttgatgcctgtttcatggatattcaaatgccagaaatggatgggtatgtatgcacctggagtactttctttcagaatctgataatttatcattttggagtaatatttggaatttctacaaacatagaaaacagtttttaattcttttattgatctaacagaataattgaaaatattttactgaacagtttacatcaaaggaaaactttttgcactgcaaagatttgtgaaacaaactttgtattcttagtcttccatgaactcaataccaactctacttatccttatctgggtatgccttcggcttcctcagggtatattaagcacacaaggtgtttggagtctaacttgctacagcaatactataaatataattcatttgacaattctacaacaacaatggctttgtctcattgaggttgaatacatggatcaaatgatgccattgagctttgataaaaactaaattctaagggatgttatttaccataaaatctctttcaataatttcctttaatgtccttttggtctcctatccttttcacaaggctaaaaaccatgcaatgtactctcgtcattgtgcctttaatgaccttttttacatgtgtccaagccatcttagtcgattttttgtcatgttcttgataggtgttataccaatatctcctagtatacaatcattctgtatcttgtactttcttgtgtagtcacacatccatcttcacatactcatttttgctactcccacttttttctcttgatgttctttcaacactcaacattcactaccataaaatatgacttggtgagtactttttagttgtaaataacctccaatgttttctccattttaattgcctggcttgtatcttgtgtttggcattttcattaatttcccataattttataatattaattctagatatttaaacttaaaaacttgtgggatgacattccaatttttacttccaagtcaatttttttcttatttcttgctaaaatggcaatgcatatattgttttactcccactgaatctaatgtttgtctccaaaactaaactttatagttaactttttcccttgattccttgatttaagttatatcatttgcaaaaagtatgcatttagtgataaacactttggctattttcgggtaatgacctagcgttggcacacaatccgtcgttaatgatccacgtttgggctttgaacaagttttatgttgattgcaagggactaatacaaacctcttcctttgtccagcctttggaaccagctatgagcccataagtggagtcaattcatttgaaaattctaattaaaaaaattatttgaagaatttgtttatctactttttatttctaaatcatgaattaacatgtgttacgattttgcaaataacaattcttttccaacagatttgaagctacaaaacgagttagggagttggaagatagtgtgaacagagaagtatctatggatgactttgagaatattacaaactggcatgtacccattttagccatgactgcagatgtgatacatgctacacacgaggaatgcctaaagtggggcatggatggatatgtttcaaaaccctttgaagctgaacagctgtatagagaagtctcacggtttttccagtcatcttgaaaataaaatacagtgctgatctaaaccagataaactgatcatggaagcatagctgtttgtactccaggacactctgaagtgggtaaataggttcagaagtctcctgagagtaagttccctatttaacagccaatgcatgttttagtatttcaccacctcaaagtttgggggttgttcactagagactgaagaatgttatctatctcatctgaaaggaaaaagaaaatggaacaaagggggacaatattgtagaagttcagaaatggttcattctacctttttgacctattttgttgtcttttatgctgtgtttgaaggtccccggtttaaaacattgtttttgtggcagggagtgtacataggagccaagtttgattggttgcaattgagttgtaattggttgttaaggataccaaaacccatattaattcttcttccatgtaaagtcagcctctcttctcatccgaaatgattgaggctgattagaagactagggtgtattataatacaggttctggagtttcatccttgtgtatgtaataatacaacttatagtgatctagcctagggacgctacattttatgtgtattgatgcatgtatcacaagggcgaattcaggtgaaaggaagaaaattagcttcttggcatcaaaggggaggaaggaagctagtccaccatcaatctttgtatatgactcacaataaagatggtgattgatgtatcacaccaagcttgcttcctttggttcttaacagtgctggaattcggtttggaaacatgtaactgatatattatactctagggtttgagtgatccaccatttttttggccgatttgtacatttccaatttctggatttcctttgactcattgctcttgccttgcacatctcatgaaattattcctttttattttttattatctcaacagtattttttcaaaaaaaccgaagttgccaaattttgatgtcaggagttacctaggttgattttaacgtgcactaacaaggtatcactgggtataacaggttaagtaatgtttttaacattttatttgtccgtcacattttgatagacaggactttatgctctacaaaattgttgtatggttcttcgtctaaattagtaacagacccgtcttgttcttcaattcatgaaggaggatctgaattctagtctcaaatatactaatataaaattattcctgatacatgcttttgcctaaaataaacttattcctgatacatgcttttgcctagtatatcaacttttggatatgactaaaaaataaaataaaaatagaaaaattaagaaaaaagattctaaagaaaatcaaatcaaattaaaataaagtttacttgagtcagatcaattgatcaagttataggacatgaaccgtgggtgcagagttttaacttgtcaccccgaattttctcacttttatagtaagacataatataaccctctacttacacaaaagagacaaaaagtatcaactgttatatttgttttttaagcttcatttggagtttttttttaacaggccataggaaagttaaaaaaatcaaagggaacataaaataaatcattgctaaaataataaaaacaaaaattaaaagtctgaaaatgattcaataaaattgaaaaaactaaaaacgttgaactgtataactctttaaagtacaaatgagaattgactagaaaaacactaggctaaaataaaacgaagtgtcaacgtacgttggaagttgcaacatctacacaatggatgcaacattctcaatacaggttcttttaaaacagcatgcaatgccatgctgccaatgcatagatatggctctttcatgagttcgaaaatcgataaactaatactaattggaaaatacaagtccgtcacatctcctggaagtaacttgagtacgtttcactgcaacagaactgatatttacattgactttttcccccaaatcaatgtgagttccagacacttgattctacaataattaacatagatgcatgcatcaagtcagatgcttttcctcctcgtagcaggagactgtgacaacgtaaaacacatagtaaaagttgcatcctttgtataaatatcattaattggtcattgtataccgtgtattctaactaagaaacaggtttctatgtttaagaaattccactaaatcaatcatatttaattcaactttgtatttattcatttcctaatgaattaaaatgtgtttgatttgatagtagaatatcatgatgagatcaatataaaagtaactatttattactttaaaaaattatagtgagtttaactcatcattttaccaaacatacactaacctgatggttcgtttagatagtgaacgtgaccttccttaccctgatggccttatcaacattggtaatggttaccagacctacaacattcattcacaatttgagcaatttgcttgtttaaaaggtgatgccaagccatagcaggtgtagcaataattggataataattataagggcacttgattgttgggtgtacaagacttacacatttcagatatcatatgtggggctcactagttccgtcaatttcacaataaatttttccaccggtttagtaaatacttattggtgtggatatgcatgtttattacctggagcaacatgtgacgtcaacattgtacacagggcacaatgaatcaatgatgaagggaactttgttccaacacactacaacagaaatgaaaaggaaatgcatcagcgttaacgatatattaattcttgaatatgctgaaattcaaaactagaaatacaaaatcatgtcgttgaagcttcacggccgttatttaggcagacaaataacatcccatacacttatctttcaatagggaatcttagttttacacattattaggttcttatccatcacaagggattttaacacacacatatatagtactattaaaagcatatttgtgttactgtgtatccgtttcaaacgaatgtaaatagcaaaaggacagaagaatttaacttgtctgagaagtagaaataaatgtaactaaccctcaacccatctgaaactaaaatctctataatttgaacttattacactatattctgtctatttgtattaaggttagattcaatttggttattacaaatgtgattttcaatgcaaatctaacggatatgattattaatttgttgtgtgttttcatacaattacaatagaatcttttgtttagaggaaatgcagttagcatatgtacacaaatagtctctttaaatagggttttcacttttcttttccacaattcatcaactaaaaaattgtatttcatcttgaattagaaaaatctattttttaatctcaacctcacttttttttttaatttcactaataatatttttttaaaaattttgaaccttttagactattttcgatcttaaagctacactaaatctctaatcaattgaataggaaataaatatttaaagttaaatatagaaaaagtaattgaagtacttaactataataatttaaatatcaacagaaaaaattcaaatgaaaatcattaagcaataaaattcacatattgatcataataaagggataaaaatataattaatttgttaatatttatatgatttgcaaagaaattttttgtaatcaaaaaatgtatgactaaaattcacatctgagtcgatatgtccgagtggttaaggagacagacttgaaatctgttgggcttcgcccgcgcaggttcgaaccctgctgtcgacgaacatttttatattttgattatttttactttgtgatttaatttaggcaaaatttagtaaatataacttaagatgcagaaaaaaatgattgatttacattattgactaaatattttatttgtaaataaaatttgtgtgagatctaataaatcactatttaatattaataatgttgaaaatattaatttataagatgatatattatcatttaattaataaaggaaattcaaaataaagattttaatatatcgaactcaaaacaaagaaaaactttattaaaaatctagaataaaattcggtcatttattaagattaatttcataatcagattaaaagaatcaaaatttgcgaatataacttggtgtttaagggggaacaaagacctaattacgatagtatttatattttggaaatttgactgttggtacctaaaagatacgcgagggtgtagaagtgtagtatatagagagggtgtgtgtgtgtgcgcggagatagagagagattgggagagggagagaagagagaatagagaatagagatggatccagacgcgttggcaaaggcattcgtggagcactactacagcaccttcgacaccaaccggaacggtttagcgaatctgtatcaggagggttccatgctgaccttcgaagggcagaagatccagggcgcttccagcatcgtcgctaagctcacttccctccctttccagcagtgccaccactccatctccaccgtcgactgccagccctccggcgtcaacgccggcatgcttgtctttgtcagcggcaacctccagctcgccggcgaacagcacactctcaagttcagccaggtactctccctctctctgttagggttttattcgcactccgatccgtgataattactcgattcacgtttcgatctgcctaatcctgtgtttcgctgtgacggcggtctttgacgttgacgcgcatgctggtttcaacgcgattgacatttctgtgcttattgcttttgaatttggatgctgattttgctcgtgtgtttgattgattaacgtgtcgatttgttcctctggaaaacctaaatttttaagtgttatggggttttcgattgttattaatgctattgacgttggaatctggaatctatcacggagagaaggaggaattacgaaggttttcaaatgaattggcaattgattggagagaatggccagtttgtgattgggaatctagggtagctgcagagtcaaggcttgtttagagtagagagtgagtggcaaaataattatccaaccttttatcataataatttcaatggactgtattgattggatcaaagttgttttttggattgtcatggattgtactacagcatatctgttggatatccaaaggcaacttggtttctttacgtttcattgtgccctcaaccacactattaactaggggaagtccttctttaagctctcaaattttggatgctttcaacatgcttcttgatctcaaccttcttcctcatgtgctcttaccaaccactgttcttgtctttttcattgatatcaatttgctagcaaagttattgcggttttctttatcagtgctttggtaggttattcataattcccctcttccaaattgcgacctggcctagtgacctgaatctgagttcaatttggtgacctgttgggtccttcaaaacagttttttattcaaatttgactcaaatcttcctgttcttctcacaaggtcccaatggaatttcacaagaattacactaggaattttaatgaattttcaatctctataagctgagtgcattcaactctgacctctatgtaagcaggtgagattatgatatgggtatcatgtcaaggtgcagcgccaagtctctctttaccaaaattgtttccctaaaaaaattaaaatcaatgatcattacctgaacaaacagctaggactttgcagttagtcacagatgttaacatcaaggagtttatgtggaagttaagctatgatcactaccagtaggaggcatgcaaaattgcagtgatcctcttcgttgagaactagttctctctttatatttaattcaaccatttttttttattgtgactactgagtttccagtaaattattttgttctatttatctcttaataaatttaaggagcttaatttttttgaaaaaacatagatggattgaataacttatctgtatggatgggatggttgggtatccatctatcaaatgaattgtgattgaattgggtttctattaatcatcttaggtcttctttgtaattaaagaaaataattaaatttgtggtaatagatgaagttgggtttcattacagagaagataaagtacttcatgtgattgcattaataattcaaattttcattttttttgtttgttctttatagtaaggttaatttttacgatgtactcattttaccttgaacttagaagtgattgcctcatgatagaggatctaaattcctgactctgaatggaaatgatgggttgtccaaatcctgtcatttcactcaaatgatggtgcctaaatggaagtggaattttatttacagtcttacctccttggcatatttttgttaacccttactacacatgtttacatgtgctcttatactggtaaattgtacattatatttttcctgtatatgcagaaatattgtttttggtgggcacttcatcttattttcttgctctattgtcttctcatgttactgtttctctaatttctgtccatcactaattttgtccactcttttttcagatgttccatttgataccaacgcctcagggaagctattatgtgttgaatgacatattccgtttgaactatgcatgaagacatatgacctgaaaggccatagatgaagtttgcctattgctagctgtttcagattgcacatttgaaattgaaaatgagttatttttggttggttgtgttgaacgcttaattgtgcctgttgtgtttagaattttctgttgtgactggttaaaaactcaccttcaaggataaattgttgaaagattaccgagtgttggagtttaaaaacttcaatatttttgtgatccgcgatattgaatccaagcatcatgatccagtttacctctacaaattagtttatgcttcttgtcttaatttttttcctttctatttggtgctgaacgaaggattgttttcttcgcctaagatcagtatgactaggcttggaaaagatattactgtagatgttattgttttataataaattgtggttaaaaattaaaatgggggctattggtttatgtattgaaaaatatattaatgtagagtgttacaggtgattgatataaataagagtaaattatacttgctatcttttgtgttttttccaaattgttatttgatacctcttcttttttgcatcctataaaaaatctcttaaatgaatcttcttttttctaatcactgtttaataatttaatagaaaatagatacatgttagtcatgtgacttttaatgaaaatttatgtctaaaaatattctcatctttttcaaaatcatacattttgggttttacaaactctcatattcttcaacaatacatcttcacttaccaccaccaacttcttttcctcctccttcctctttcactgcagcatatctctttcttctcatagtcgtcttcgtccatcaatatgacgttcgaacgcatccactctcgtcaaagaaatcaccattatcgtagccactgctaccaccatagttgtcgccgcaatcaccatatccacctctatcatctccttgtcctccgtcgtagcttcggccatcatcagtattgcgtctggtttcctggatactagcgtcgtagaggtccttgacacgtccgtcagagtcatattcaagggatgagtatcaggtacaatttgaggaaaaaaaaatactgctcaaatatttcaattaacgttaattaatgacgttaatagaatgagataaaagtaatgtataaaaaaataggaatatcgaatgcaatgtgagaaaaaacacaaatgcaagtaaaattccctctaaataaagattcattcctttctcctactcatacaaactcgtgcatttaaaaagttatttcctttttaggaggataagttattaaaaataaaatttaaatattatatatatatatatatatattcttttatgtcatttgacaattatcaattaacttatatagctagtcttatccaatacttttaattaaattagttaatttacaagttatcagctagcttataaattagttttatcaaacagtctaaaatgaaccgagtcagtatgcttaagtacaaaagagattaaaatgatatgtataggaactaaaatgaataattgttaaatataagaattagaaggtaaaatttgtgcaattataaaaactaaatgtgtgattaaatctcactaaagtaacaataataacaatttgttattcgaacctcaaacaaccctaatagcaaatttttattcgaaactcaaacaaccctgaagctaacctcattccaacatttcattcaatgatgctacattttcagataccttgtacagttgtaaagaaggtagcagccataagctatataaaatttgcgaagatatcaagagtgcacgcaaggagatgctaaagaaacttaatccattcaattcgaaaccccaccccacctgcattcaagaccatttcatattttacaaagtaacaatgttcatcgttattttcactatacaatctagactgtttcaaactaataagtcagcttgttctagacatctagatacaaagaccatcgaaatggttgtgccacaaactgatcattcaaaataatgaagactaccaaggctagcgttgctcctagggaaatggataaaaatcatcaataaataagtcatctcctacagaagttgataatgatgcctcctcactcgtacccgcaagttcagcctgcaagggaattgacaagttatgcattaacagcacaaagcaattgcattctaaaaggtaaaaatggtttatagctctgtatggttactattttgtctttatttttgattgagcacggaatgccccatcgaagcctcatgctaaacaatgtttaaattattcaactagtggcaaactaacacatgctaaagagatattggttgctctgcttaataaaatgcaaacactttactcttcggcttttagactaatttatttaccttagcttgacgatatttctcaagcatgcgatgatattgctcacgagcatctggtgagttgaccatggacagcacccttgaaacagcctctttaatttctacatcaactttctgttttcggaacaccttgagaatatcttcatcttcatcttcattttcgttgatgtccatctcttgtcggaaacctcgtaaaccagctccttttctcctccatcgtaggacaaccttgtccaagattccaactgcccatattaccttgtaatgcttcctaacctggtagcccctcacatgagcctgcccaaataaattagaaataaccaaggttgataataatgccgttgaagatcaaagtatgcacgtgcatgtgtagcttgcctataaccagctgttttttggtttaaaaaacaaatttattcactttcagagtatctttaagtgctagttatatataaattaagaataacatctatgtagctcttggaattcattttgttctagtcaaactataaagttaacatctattacctgtatcttcactactttttggcgcaacgctaagaaatctttgcgacctttccaacctcgatatttcttctgaatcgataaagcagctgaagcagctgaattatattcacgtgagttccgaaaggcaagttttgacatagcagaaatctctgaaatggtaccaatgccacctgcactagaagctgcttctcttgctcttcgttttctaaaagaatgtgagcgaaaagcagattgtatccgcgcagctgcctgagttacatttctgatagcagccaaggtatctttgagtgatgcctgatcctcactggcagtaagattttccttggagacactgttaacagtcatatctgcctgaagctcagcattacttttagataattcactctcttccagtgtaagcgatgacagatggcttgttacagctatctctgaaagataccctgccagtcccttgtgcccactgttggctgcaatagatgcagcagttttacccgttggatcttgtgcatttggatctgtcacagctccagcagatgctccagaagctataagtgaagcaaccattttttccctatatggaataacaaagcttcaggaaaataacatccaaaatactttaaaatggaacagataattataaaatggtttctgaagaaacaagacaactttcttgatacgatcatcagttccagcagatgactggatgaaccaatttcttttaattagaaataaaagtcagcagggggcgagccctgacacaacagtaaaattgtgccttggtgatggtcatggatttgaatctgaaaatagtctctttgcatatgcaagggtaaggctgggtacaatatcccttccctttaccttcgcatagtgaggagtttctgagccatggggtacgtagtcttttagtttttttttttagaaataaaagtcaacaactcggcatttgctttgaatgattaagcaatcatgctacatgtggttattataccctcagtgttgtcatcaatttctacttttgacttacagactaggcattcccgaaagccaattaacttaacctacagggattttaataatttcagaatttgaaaacacagtgtatttgatatcattttaaccgaacacatccttttcagtttttcttacatctatcctgcagtctgcatctccagaaatttaactttcagacttaaaaatctgaaacacttatctttttccttgcattttagtgctctatacctataataagagatcagatagtttattctcctttccttctccattttatctttccttgcttctgcattcccttctccaaatgaaaaaaaaaaattgcatacatattttaccaagcacattttgtctgtcaagtatgtatgctttccttatcttcattacctataagccttatatagcaatattaacatcattcaccaaaactaaataaatcagtaaacatagtagcaagctctctagagttctctattaccttccaaaacgtgcagcccaatgaagggcagtccacccattgatgtcacggaaatttatattgactccacaagtgagaatagggttcaaggcccactcaaaacctaacccagcaaccatgtgaataatcccttgctctttcttggacaaagagcagcctgtctcttcatctttttcctgagatctgcaagaaagccactgttgaagcttatcctttagaagctcttcaagaagccaatcaacagtaccagttgacgttccactgccaactagaagagcctctataatatggctccaagagtcatcatcagctttctgttttatgagaggaattccagattctatgttgtcattctttattgttgatgcagaaagaagcatttgctctaatctaacaagtaataacagctcttctggacttctagtggcttctgtttctgattgagtacatcgagtgcaactattggtcttatcacgatattcaaactctctgacctcactgcaggactcccggtttccagaagtaatgcacagagtaacctttccaggaaggtgggatggagcttcacaagagattacaccatcttgaattatctcaacaggaacttcaacatcaccaaacatacaagcccatgcagaatccgagggatgacagagaaaagacccaacaacaatgacctatgcatatggagctttaggaatcaaatttggacaaaatcaacactaaacatcattttttaagataagaaagatgaaaggaaaaaaaaaaaagagacaaaatttatgccccaacttgttaagtcttaaatgtccaaagacataagcttgagcaacatttccctaacctaattattataaatagactgagctttatatataattgcttcataccaccactaccacaagaatttcatatagatttcaagattttcaacaaagttaagaataaattttaaagctcttcaggaacctaggtaaggtataagcaccaatagttatgaatcaaaggaatgagcactttcattgtccacaagataccagttatgcaaagagaaataaatcattgcatagggtatgcaaggtgttgggctttaaaggcacaaaccttggtagtctcagtggcaaaaccccattctggggagattgtcttaattgtaaatttctgtttttgtgcaacagtcaagcttgaatttgcatctggaggtgctccaatttggctttggtcaaacaatgtttcatagtagtcagaattaattacttgtgtttccaccatagaagaataggcaggaaatttgacttcatcaacaccttgaggttgtgagaaaacagctgctaacatgggaggggaatcagaagttgaagaaacaccaaaatatgccaaaaatgttgtaagttaaccaggtgaaagtaaatcatacagttttcagaatgattactgttgaagttgagccactgactgttttcctggttggaaactggtacacttcttgcagaagatactgaaatttcctgctttaagaatcaaacattttaagtattgcagaaacacatgaagaaaattatttcaacatctgagaaaacataaaattgcaaaatgatataaattttattaaatatgtcgaagcaatacttacattttcaattggcatgtatacatttttctgtggtaacttgactgcagatgaggacttacatgattccagcacctctgtccataaagccttttcatttccatcagggtaaccatggtctattaattcctgataaaattcaccaccatcacctataacaacaaacacttttagcatcttttaccttcctctattcccatttgattttccataatgaagaggacaaaacaaactataaagggctgaatttcacttgaaattaaaaatataaagttaaaaaaaaggttttgaacagataataactaatttacaaggaaaaacttcaagcaaaggcaaaaccaccattttttatctagttggagttacagggcccatatgatataaacagaaacttcctttcgagcctcttgttgttgcaaccgggatttaccttattgagcgtgattttgagcccgaaatccattgtataagtatacttcgagactgttttagtattttccttgaatttttccttaaatttagtattttccttgtttaatttggatccttattcaggttggctatcaccatcctgtaagtatgttgtgttatattcttcatggcatcttttaaaataatatcacaaccttttctctcaaacttcaaattttcttgttattattaaaggttagtcaagtgctaacctgtcagccacatgcaatttatcaagactagaacatttgttttattttccttatcaaccatataaacgaagcaaaacacttcatttattatgtaacatatggaattttccactcaaaccttaacagcaagttccacattttgatatgtttttataaagtctactggggtaatgtcaaatacaaagaaacctagccgtgagtaagttgtttagaaccattttttttcctggttacttggcttataataagaatcgcatatttctcttaagattcatattgagaaaaacccaagtccaacattgactaaaataatgaataaaagtggggggacaactaccacctaatgagctagcttttggggttgaattagtctcaaacccaaattctaataattcacacaacgcaaccagcatataacaattagggaattatgtttcagtgagaaaaattaaacaaatacaccaaacaagaagatggctataatagttgtgaccaacttaatctaaacaggtatgctatgaatttccatcaacaaattacagaaaactagctgtgcaggtgtaagatgctgcaagcacatttagataagtagaagacagatatctgtaaaagtgaacatgttaaacacacgatagattaagcactcagatatttcactgacttaagccatgcgttctcaacagatcaagtttatttaatttaccttgcgtttcattatatccatcataaaatagtccttgatcatcaggtccagagaaagctgcagattgttcttgattgctgatcaccctttgatcgtgctgagggtttgaatcatgtgcagtttcaggctcactgccaaaggaaacaatatcttcaaagttgtcctcattcaaacttaactgcacctccaatcggcgcaaagcttgagtaacctcgagttcaggcgaggttcctgattctgtatctgtcccatccatgtgacccattttattgttcagtacgaatatatcagacgtaacttctgtagaccctggactggagaaactctgattaggttcatacgaatcgccaagtatggatgttgacactggattctgagtagaatatgggctaggactctgagtatatgcagaagaggaacttggtgataattgtgccccagctccagaactgagctttccctataacatgagagtgagtgcattaatgcaaaactcaaagatgggctgcacaacaatgttactatgcacacagagaataaaacaatataatttaataattccacccaagataccaaatatgattcttaagaagatttcaattttttattgaaggccttaagaaaatttaagtatatctttatttgaggcacaaagccatcaaatgaaataactagtgcataaaagcaacaggacattacaatctttggaataatcactgactttttcttataccaattgtccttatcatagagaattaactatatgggaggtgaggtgtaggcatctctgtaggtaatttctgcttggtagaagagcataaagagatgttcataaacatagggaatagaaaagtttcaagaagttaagagaatgcatggggaatgactttaattcatagttgaattgtgttgcacaataattattaaagggtctaatattcatgcaattagaaattattacaagtcaacaatgttaccatacatgacaatctacaatttggaatgcaatgtaaaaatcctttacactatcagtgcatactaaaattcattattaaatgactttggaagcatacatgtacatttataaatgaagtttgaaaatagaaaatgagagaggggagggggagagagggagttacaacacagtagtaattataatggtgaataaaagaatcagtacaccaaacttaaacaagaaatcttaacagctaatggacaattgcacaagccatctacaaaaagtaaatatgaaagaatacagaaaatgtttgaaatttcatggaacaggaaaatgaaccaaattatttgagtttcacaagtgaatagtaaacaggcaggatgtctgtaaaacaactaatccaaaacatgttcagacagtgagcaatcttgcacaaaaggattccccaaaattttctggagggacactatgcacaaactacaagtactattattatgtttatctgatatcatgtatcggagactcacctcacttgtgttcctataatgcacaagaacaatatgctcatatgccctgccatgaaacaatagtatgagtgataatgaatgactattacgataacatatatataagcatatcacacaaatagttatgtacatcgaaggctgattctgtttcaaagtctaggataaactaatctttgcaattcacttaaaatttagttagcctctaggatggctttttaccgaaaattgcatgtttgttttaaaggatacaacatgtagtgataagcttaataatatgaaggatatacagttagctaatagttaaaatttactcacggatccaacatccaatagctccgcctctggaaagtagggttctgctctccgtgtgcatagtaacaatttaaggcttcaacatttccaacctagtcatgcagattagtacaatcatttaaattgaagaaatcagtatacagaataccatcacaaagacaaatgttggcctacactcataaatatggcaacaataagtgaataatgttttgataacatgctaaaaaagaatcactaaacagaaataagttatatctaatgtatataaaggtcagttgataggcaaatcattcattatttcaaaagcatcgtgaaagacttcaatgaaacttccaataaggatttttaactatttttaataataccatctgtcaccattcaccaagtttgagacatctatcaaagatatgaatatattttttctaacagttcaggagagtcaacaattttccccctcttaaatattaatttatgaactgcatttctacaactgatacccctttagacacttgataacaaattttcctttttcatggacaactaataaacacaacagtatagacactactaacacaccttcagcctttcatgtgcttctcccacagttcttccatctcttttcttacgccagttatgaccatctttacggaagaaacgcaggactcttttgttaaacagaaacagagatccacctgttaagaagatcaattgataatgttaacaatcagcattttatggtcaattctgaagaaacaatgacaaaatctgtcatttatttttatttctaaaatcaattggataaagggaacacagatcttactggttggctgttgcgggggctcttgggtgaactggaacttttcatgattctgtaaaatgtacatcacttctgcaggcttcaaccatctggcttgagcctcttgatgcagatcattaatatcgtattcgtaacctaaaaccacaacataaataagtcaaaagatttagaacccttcccatcatcatcatcatttttttcttttcttccttcttatagcagaagaactagataagctggggacatttttatgctttaacaagaactgcacaacgtaactaacaacttaattttttttcttctctgtacggcaccaatgaattattccaatattccatatcatttggaagcaaaatgtgttaggggcagcaaaataattgagtaaattaaatcaaattgcaaaaagcatgctacagagaatatactaaaagtgctttactgtcagtgcgagtgtttgattttcaccgattccaaacaaattccaaaactcacatggtccctattgaaagcaccaacctcagaaaactaaacagaatgcacacacccaaagtcgcaagtgatgtggttcacttcaactactcaatgaaaccaagtcaaactcaattcacttcactatacatcgcaacaaaacattaaacatcccaattttccaataatacacccaagacataatgataacatcattaatcattaagaaaaagtaaagacacgtttaccaggtgtcatggtgttgaatccgaggaataaaagctacaagtagtagaaccggacacagagcattgttggagccgcagaggctgctagattcgctacggtgcgagttggttccgaagaataatggatcggagaaaggaagttgcaaaagcagaaagctgaaacagacgcagttggcgttagttgaagcttagcatagagttgatttgaggttgtgattaaggttaaggttatagcgaaacgtgcttttattaaacaactttttttttttttattaacacaagttggggaccccgaccaagaccaagaccaagagatattactattagattgctactactatgtcttgcttttctcacctctttaatttaattttagaatattaaagactttacattaaagtgattaaaaaaaagactttgcaagttggagcaagtgtgatttttctaagcggtaatcacaatctggtagtccttttataatttaataaatgtgtagtagtattatacacaatttacttttttgttaactttgctaactaccctcttaaatatttaaagaaatatcaaaagacgaaataaatatttgattacgcaattaaaagtgtgattagactatagagattaacaaaatattataaatagttctactcttcgattataattgtctttattttaaatattttcattttttaccttaataaaatatttaatgtataaatgagccaaggtgtttttaagcgatatgcaagtactgcataaaaaaaagcgagatatgcaaggcgaacacattcactaattgagtggatgatcaataaatcaaaagtttcgtcatgcatattttaataatatagcatgccataattaaaaatttaattaatataaaaatatttaacgtggataatacattgaaattaaactttcattataaatttagaaaatgacgctcatgaatatcgggaaaaaaaagaaaaaaaatgccgctcatataattattgcgcgcgtaaatttcgccacaaactaatgattcaactgtaaacgtgactttttctttttggtacaaaactgtaaaacgaacagaaatgttttttttttttttttggtagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaaaaaagttatattatgataaatttatgatttgataaaaagaaaaaaagaaaagatattaatagagtatttaaataaaaaataatttgtatatcattatttttttccaagcgataatgataatattttattcctgaatgaatatgaatctgtgacttaaattttctaaataatgaaaaagagtactgaaacatacccaaacagttgttcgtcactactattgcgattcaaatgtgaacaaaaggaaaataattccttccagaaattcacaatttttcttacagtatcttttttagtagtatacatatactacatgtatttaggtccaattaattataatatcaataaaaaaacaaaatgtaaaatataaaatgtgagcaaaaggaaaatacttccttctagaaattcacatttttgttacagtatattttttagtggtatacatatactacatgtagttaggtgaaattaattattaataaaaaaataaaatgtgaaatataaaatgtagtgtgaaattgtgaatgaggtgagtgggttgaatatctcttgggcaacctgattagcaatgatatcatcataaaggaagacctggtcatcattattaaacacaaaagacaagtttgtactgtgtgaacgagggttgaagttcaggattaatttcaggtaggtgaaaacttattagaagtattaggcgtttgagttgatatattgactttcaataaataaataaaaaagacattgacttcatcaacatttcaaaacaaacaatttcaacgtatgttattcattaatctcattttatttgttatatatggtacatgtttgagaaatgctagcagatttatgagaaaatatttaaaataacttatcattttaatcatattttaaattcttttcagttattttgaaaagctgaaacagatgagaagttatgattatttcacgagaaaattgcaacataagtgtgtgaattaaattaatttgagagggtatggttcaagaagcatgtggcatttaatcaattaatgtcatttcctcacgaaatacttggggaacaagaggtgaatttcaggtccctgatgacacgaacgagagagaaagtgtgtgtatggagtacacgtgtttgattcaaagccatgttaattggtgaacttagataagaaaactggataatctttggggaagataaagtcatacatacttgtccatttgttttaaattctttccatcgtgggaataaattattccaaacgttttacatatgttgtgcatatgggatgttatttttcagagtatggtagtattttatttgctattataaatttaatagaaataaataaatattcattatgaaaatagtatttaagtatcattaacaacttgagtcttgagcattaatatatctctgattaagacctgattgttttaaaactaaatagaattaatttaaataaatttatttaaattcgttaagtgtaattaaaatgtttacttaaattaattttaattttaaatttaccttcgagcatattcttttccatctctattaataaactaaaatgcaactcttgatataagaagttttccatgagtaattgctcttactttaactgggtaattgggtcgagatcaaagtcgagttttcttcccacaagcataatgtaaattgtaggatagatatagtaaattagtaatattattgtttacttaaaagcacaaaatataacactataagaaatttattattttggggcaattttacgtcctcaaattgatatgggattcggggcgtgcaaaatcccaattgtcctctaactcggcttaacctaaagttgatttgtacaggtttgaattttaaaaattagatctgttatattttagggatgagttcggattaagcttcaggccatcttaacctgatcttaatgtcttattttttttaatattttttaaacaaatatatattattaatattttttattaaatggataacattttgtataacatgatgttatatttataaaattattatttattttaaaatgtatattgtaaaatatatcttaatttaagggttttttttcttcctttttttcattcttagattcagctatatattaagattgatatattatatattttttattttgagattcaactatacaaattgttaagattcatatatattacgataataataagtcaggtcaatctgatcttctctttaatttatcaagttttggtcgagttagatttgagtttaagtaaatgatctgaacaaattttaagttggataagaacaaaaataaacatctcttaacccgttttactctcacccttgtatgtgagaattttgacaattgctgtaattacattagccagaagtcaatttatgacaattttaggattcctgtaacctgttttaaaactcttctatttgtgatgattgtgttgtgaaggtttaaaccttctttgtttgtggaggttgaaaatcctcttctatttgtagcagtattttcgaggaggattttaagttttagtttcctctatttgggatgagttaatttttaattttttccttttccatttatagtattttttaaaaatattttttcgaagatttaccctccttttaattgtcacaatttttgaaactttttcaccccttaaatttgaaccaaattgtaatttttttaaatgcataacattcttcaaattgtaattacttaaataatatgaaaattttcattattataactatagcaacaaacgtaattcaaacagtaacattaaagataaattatcattcattgtaagttttactttataactttttctttacctcactttataattaacttaaaatccacaataacataaaatggtttcacaataaatgtaaataattgtatgtaaaaagcacactacagaatcctcttgcattcaattaactaattcgcagcattacttggctgaaattataaaagaaaaatacttagttgaactaattaaattaacaagacacaagttaacgttcacatatatgatcaaataccatccaatcactaaatttatttaatggtttttcaagtcttagattagggatcctaactagtataactatgaaaccaattaaccctgattttgtaggacacgtccgaactgaatattaaaatcccaaaaccatatataatagtggcctctaattccttgcttcagaaccacataatcggcggaaggtgaagcacccaattgtaattagcatgggaagcaagttatccttaatccaaatccaagtccaatatcaaagcatatacaatcacatgcacgatagcagtgaatccacagtaacttaagccccaaaaactcctctcacaccatctttgtccccccacaatcatttccaacattgattgcatttatatgcaacgtccatccatgaatcccccacaacacaagcttagttagcattctgtgagtgtgcttcactctaattaacacaacacagacacaaacacagggtatacagccttaacagtagagtagtactagctggaaaacatgtcggattggggtccagtgtttgtgtcgttggtgctgttcgtgctcttaacaccagggttgctgtttcaggtaccagggaggtcaagggtggtggagtttgggaactttcaaacaagtggtgctgccatactcattcactccctcctctactttgctctcatatgtgtcttcttgctggctgttaggattcacttgtacctcggatagttcactttcaacctcatcaatggtggggaaatcatttttctttttcatttttgttgggattattcaattcagtcatgtttctgttctgttctgctttgttattcccgttcttattgcgtgttgaaataacaacggggctttcatcatgtgattgtatttttttttttcttgttcttgacaccgagcttggtcagatgttgtgcctgtattcagttttcctctgaatgaatgccagtacttgattttatactcaattgcattttagatatctgaactgaaaattcaaacctgtataagctttgcatcttcatgtatgtatgcgtttcagttgacgtagaatatgttaatttcggattaatttacggcatttgttcaattcaactcgaggcttgatttgatttggtgtaacgcgggaaaagaataaaaggtgcggcactttgcagaataagtgaataaccaaccactcgtgacacagtttattttattctccccttgaataattgtgaatctgtaaaccctgaatattaaacatcttgcataaattttcaaatgaatgaatcgtctggagcttatatgagagttgatttaattgtgctgattatgacagaatatttttgagatatcaacaaacaaacaagatgtaattccatttaccgataatatttttcacttcgtccaagtatgatcttagtgcagttaaattaggtatatgaatttatatatatttcttaaaaggttttattaatatacacgttgttttagtctcagttttttaataaactataattagaaaaatattttaaaatacataatggtataaatactaaaaaataaagatatatactttaataaatatttgtgaaaattatgaatgtagacactcttatttcttaatatgaatgtgtcaacaaattataaccaaaaaatattatagtttgttaacgcaatcataaaaaaataaaaatgtgtaggttagcaaatttccttcttaaaatttatatgtattttttgattttatttatttataattaaagtaaatgtagctctctaatccgatataaaggtaggctcaggcattaatttaagaacccctggaaaaatacgagttgggccggtctattaaatttgacactgtggttaagaaggttcagacaagacacacagcccaatttaccagctccgttaatcatgaacaatattcataacacagtcgaagttggaagcttaatttatggcactggagcccaaccaaccagcggaggataccaatactacttagaaaaacttttatcagactctcctcccttcctccgcagtaaaaaacaatttggagtgatattttcctgattaataatacgtaaattagtttccatataatttaatgataaatttatccgagaactttacaatttaatatcaaaatagattcttaaaaaatacaatttattatcaaattgattattgaatattataacttaatcataaaataatcttacaaatttaagaatcgaacttatttatcgtactttgcacatttaatgattaaattgtatatttcatcttttaaatactaatttatcacaggatcatactttcataacaaatttaattatttacttataaatctacgaggaaaacattggaaatacattattcgacatgctttttaatatattttgttattggataaaattttacagacattttttattatatatattagttggattcacaatgacatttgtggtattgaaacaaataaaaaatattttgttaatatttcccattgaagaatctcatacaaaacgaatgacagttgaaacaagaactaataggtcttttgctttgttcgtttcttttcctatgtatatataaaaaaattcatcgcgagaactattcctatcctaccttgataactgatatggatgttgaatagaatttgcctttactagaatatatttgtaatcctaaaccaaaaaatacacataaaaaaaaatcaaatttattatctcttttctctctcatttttaacaatttttttaaaaaagataatcttccaagtaacaatatatactactttctttttaattgttaacttttaactaaaataaaatctgataaaaaagcaaacaacaaatttgatcaacatattaacaaggaaaaaaattgttccatatctttttgcggttatacactctattagcaataatacgagaaatgcgacaggcgattgaaaaaaagagattaaaagaatgacgtatgtgatggaaaaaaaatcgaaagtattggatagtagaatatcgtagttgtataaagaatctctctagaaaacttctccttaacgaaaagtaatgcgagattcaagatgcgctgacaagttatgctctagattgcatcaacctacaaggcatagttgatgctaattttttggttgtcaattataccttgcttctttgctccactttcctcagtcatgcaattgcctcagacccagatcagaatcatttttcaatttcctatttaataagcttagcttatagatgatcatcacacagcatttaattcattgaaaactgggacatctgtgaagtagtgatcactatctaaaactagttactatatttgttgtaaaacaagtagtaatttctgcagggtgtgatggcatcagattggggtccagtggtgatatcagtagtgttgtttgtgcttttaagcccagggttgctgtttcagcttcctgctaagggcaaggtggtggcatttgggaacatgcaaactagtggcttatctatcttagtccacaccatcatcttctttggactcatcaccatctttctacttgccattggtgtgcatatttactctggataatcaatcatcccatagcaatgatgtaccgctatatgttgttttattctctacggttggtgtttttctttttgttcttttttattctggtttaaattattttgttgtaatgtaacttttaagatgtgatcaaggatggatgacttaattaatttcttctttcatttctctctcatggaatattgatctgtgtgatgtgcttctctttgctcatttatgtagaagaatatatgaatcttcaaagttttagagacaagggtaaaaacaacatcttatagttatatcgtggaggactggtagtaacacacttttatactttgtctctgcatgcgtatggtcgtatgcttgtgtgtataggaggggtaggatgtaatgtaagatgtcgcggtattaaaaaaaattaaagagctaggtacaatattggataagagttaggatcaattccttagttgcgtcttgtttgtgttttcttttggctgtctcgaattgttctatgaaagttaggcatttagaggtttacttgtaacggaatgctaaagttttgatgctaacagattcctataaacgaagtatgaaacggttaacatgttgattagagtttgaattttaatcacgtgtatgaaaaaaaattaagaggaaaagtttattttaattatcttttatatcacacaccgaaaaagataatctccaatgatacccttgagtaaaagaatggagtcgtggtaggaggggggaatcaactagtccctagctatgcttgtttaggcaaattttgggaagaaagggtattgaacgaaccattttggtgagacgatatcattttctgttgtttgatggacacaaaaaaggtagtgactgattaaaaccgtgtgggtctaacataacattctatgctactatgcaagggacaacgccaaaaatacaacatgtaaaacacagtgaactttcacctcatttccttcgtcccatcatgtgtaaaactatatataattattcatttttctccaattttgcttttcaattcgatcaaacaaagaaatatttcccctcttattttcttttcattttctttatctaaacaatgtaaatttctttccattatatctttgattattcttctttcgattccttctgtccttcactttctttcctcatccagaaggtcatatttaagaatcacagtatctggcaacagggaccttgcattcaagcatacttattaatatcggatagtggcgcgtaccaatcacccttaaaaaatgctatagctctatagcggatagcgctacatcgctatagcaaagtatataagtaaacattattctgaaatctgaattatatatataaattataaacaacataatccccccccaaaaaatgacataaatatcaaacatttgcataatgcagataatatagaaaattataagtaaaaaaataaaatagtccaataataaattaatgaacaataaaaaaacaaaaaataattagactagaagaaaaaagtaataaatagaccggaagaaaaaacaaatatatgaatatactttatataataaaaaacaaatagaaaaaaatttattgataaaataaaaatataatataaaattgataaaataaaatataatgtaaaactaactagcttaggagagttgaatgctttgaaagaggagaggagagtttctgcctgtaggcatggcaacttgacccgcacccgtgggcatccgtccgaacccgccccaatgtcaacggaaaaaaatcgagttgaccggtttcgggttcgggttcgggttcgatttttccctgcctgttgaattcgggggcagggacgattttgataatgctgataaccgccctgcccccgccatgctatatttaattatttataaaaatacttttatatatgtggaataccttgggataaagacttagttttattcaagaattaggagtataactaattttattttccagcaatgaacatctaatgttgaaattttattgtaattacatgcatttgagacttagcgcgatcaaattttatgttatgattgttgtttaaaattaattttttaatagtaatttttaagtgttcagggacaaggacggggtcattttttttagccccaccggttttcgggggcggggcccccaacccgccccgttgccatgcctatctgcgtgtacttgcttaagctagtctatgtgtttatcaagtattataaaggagagtttatgtcttaaaaaaaggagagtttttatattagacttatttactagtactaataattacgggaggagaaaggaagcttggagaatttttataatcactacttacaagccaatatttacatttttatttttaaattttaatagtggcaccaataaaaaaaaaaaacaaacagcacgacacgagtacagaagtgcactgacacctgatgcttttgttttaccttttatgaggcttgaccaatagcaaaatggcagcagctgacgctttcacttcatcttcctcaatgggcctcattccgtttcgtctagcccgtgcttcctcaacacaccgcaccacacccgctttttctgccacacccacccgcgatagtggcagctatcgccactttctcatttgctctattgtggtgcagtctatgttgatcgactgccgcaccgcaccgctatttcagtattgcgcgcaataacgccactattgataactgtacattcaagtactgaatttgaaattttttcccaacttgaaaatattttatttgaagcaattctattaataaaaactgcagattttccccatttacatttctttccaaaacttatattcaccctaactaaggttccacttgatttataggcaaccaaataaataatatgggaatggaattctaaaacaagtaaaaattagtttagccttagttcaactcaagcgaggcataactctgtcctcagtttatatatataattaccaataagagaaccgtggtctcgtgagtcatcagatcatattttccctttcattttatagtatatatagtcatataccatgtttggaaatggcaaataaaaaaaaaaaaggaaaatcagaagcctatataattcaaattttacaaaagatatataaaaataaatacaataattgacatcaaaagacagtagctgggaacaagtcctcaattcttggtgctggctaattgtaataaaaagagaagccatatccacaaaagcctgatattcatgactcctgcttctagtgagagaagttcagtaatcttcattgttctatgggcagcatgagcaggcaggcacaaaaccagtatagtactggtcaattcgattatttatcttttcatataattttccactctgaaacagcaagaaattgtaatgaagttcttaggctcgtgatccaaccaaaaagaatgagataatcaaagacataagctttgcggttaagtcaaaataaacagcagaaatgggaactccaaactggctaatatcgaaatttagttacaagatattgtacaccacacaaatataatatttctacaaaagactaaaatgtaatttgcttttcgaattggaggctattacctgtagtttatatggattatgtatcaaagccaagcaatggtagaatttgccaatttagcctaaaaaaaggtagaatttgctaacttagccagcctcaagcaacattaatatacccggcttcaatcatttctcaacaggaatatacaaaaccagcgggaagcgggtgcaaattttgtattttatacttctaaaacaaaaccaatcttgcagatccaacccttaattgaaaaagaatttcacattttattttttggattcatcaaaggccatacaccaagatagtcataatctatcttattctcaaaattttcactatactagtagctcccaatagaattttgaccaaactttataatgaagtatgaaattcttaatagtatgaaaatctgtttcaaaaagaaaactacaaccatcaataatgactgagcaaaacaaccacaaagaacattatttttcaaacaactagcctgctaacatcctgttaaaaaagggtaatagcaaattcagcacctacatcatactgaattgcagcctatctatctgtgatatgggttttgccaattccccgatagatgtggcttaataagtttaagtttaaatatcttatggcttgcaggtgcatatatctatgcaacaaaaattatcccaaaaattccttactagcttttaaactaattatctcaaaatttcagcaaatctcaatgcatgtagcaggtgcatatacaggaaaccaaacagacatatgataagcttgtgaagagatgtgatgggcaaaagaggtttattaattgataagctcgtgaatcgtttttaatgcactttttacgtgcatataggtcatgtttaggatcatttgtctcaaattttcagcaagataacagtttttcttttaaaaaattctttcaacaagattaaaatataacaattatttcttcaaaacaagttaatctaacacgcaagtcttccaaacactaccctagaaatggacctgagtagtctatactagatgttaggttcaaatttcattaccaactatagttaaaaaatagagcaaaaagcaacaatttttaacaatttttatctatccaaatatttctcaaagatctcccttcctctaaatatttggtaaaagtggatgaatattggaggggtagaaaaggaaaaagacaataaacaacagagaaacttccttttgggtcccacaacacaaacaagagatcagatagataaacacaatgattgccaaaaacacgtaacttatccccaatacacacaccatcaaatctggacaatatccatcttcaattttcttcagattctaacaatggtagattaaaaaacaaaacctaaatttctgcaacaaataattaagcaacatctcaaagttttaattttttgggtttcttaccagggagatccttacgtggcgtagcgtaacagagaatagaacgccccagaacggagagagaggaaacgacgccagcgacataaaacaccataaccaatccgagaacccacggcatcagcatgaacccgatgaagaaagtcaccgatccacacagcatcagcgccaccgaaatccctagtagtagcgacgcgaaacccgccggagtaatctgcgcccccgccggagaacgcctcgccggcggctccggaacgatcggcggtgaccggagaaggttgaagaccagagccgagagctcgcagaaaaccctagattgttgatcttcctgtcctctcatggtgtctttgtatcagggaaagaaggaaaagatgtagcaataataataatagggagaatttaaacgaagagcaataggataaaacggagggagatggaaattaaacgtgttgtcgttctaaggaaataaggaaatggaagtatttgcagaaagaaagatggaaatgaattatgtttgcatttggggagtcgcgttgcaagtaatgacacgttgtcgttttgcgtaagattaaagacgcagaagcagaatagaaaagttgaagaaaagagaaagtgataaatgagagaagatgggttgcgttgaagagaaaaagtgttgcgtgacgttaggattttggttttgagggatgggatgtgatgtggttgaatcatccaagttgacataaatgaagtggtacacgtcgcacgaccaattaggaagataatagagggctactattgtaattatattttattttcaactaacgacggttgaatgggtcagttttacccgttttggcccatcctattattagttcacacaaatcatgactaagggtaagttaaccagtttagtctgacaaataaataaaaaggagaactgaagaataattataaataaaaatgattcataaatcagtattgcttcctaaatataatactattctttccataataaaattaagtacaaatccaaaactctacactattctttttgttttcttattaaaaaattattgggccaatgaactagttcctgcttagttaaaagccaattttttttttgttgggtaaaaacaggctaatgaattgatatctctgtctcaatccttataagaaagtaggttaacgataagtcaaatttgttttgcaacccatatactcatgtgagtaaaatttaagcacttatatctttcttttttttttaatatatacgggaaaaaaatgcccaaagaaaaactataaagcaactagaggaggaaaacaaatttctctagcatcgttcaacaatgaagggtaatgctcaagaatcaccaagtctatcctctctgtataagcataatcagtaagcttgtccgcacatatatatttttatatatttatgtgagtaaaattcaagcactcatacctttgcatgtcacatatatattttgatcaatttaaatatattctttgctataatttatttgaaagtaataaaatatgaatattattatacttttaatattaataatgaaaaactaataaaaggaacattaaatacaaataaaatacataacttaaataaaacatattactaatttaatcttaattgtaaaaatattacaaataattttattgacttaattataaaatatttttagaactttcaatttgtttttataaaccataataaactcttacaaatacttactttatttaaacgggaacttttttaatgaataaatgctctaccaatgatagttttcataaatacttagcatcaaaacccaactgccaccatgcttatcacgccttggaggtagggcacacaagctgggaaataataaattgtgtgggacctcatggattttttaatatcaacttttttgtttgttgctgggcattatttaatacattaattattggcatatatcctatcaccggttttcatttttattttatgtttacattttcttagttaaatttattaaaaattataaaaataaattcacatttaatgaatttctctctcactattataatttttaattaatagaatgtttaaaagtaatattagaaaatattcttaacacttgcggtgagatattaatttctcaggagccgattaaacaaaattaactaattttttactaagaaatttaatttttaaacaaattataaaatttagttaaatcacatttttttaaaagcaccctaaatttgatattaagaataaaaataaattattaaaaataaaagctcaattaattgaagggtagttttagaacaataacattaaaatatgataaaaataattaaattttattatatttgagtccattgaaccttttttggttgtttataattaagtttgaaggaaatatacttatgggagtgggattaaattatttaaacaaaaaattagtaaaattatttaactaaaaatagcacttcatttgctaaattttagtatgcatgttatttgagataatattaaattgttaataatcaaattattcttaacataccatgatgcctatctaattccgggcagatgtgaccccgatccatatgctactttgattttactatgcgagtttcataattcagttgcacatgattaattattattgctacataattcataattggagtatgcggggaactggttcgctgatacgcacaaaatttattgtgtcctaaatagaaaatggtggtggtagcagctcaaagtgctgtccaatttttaatatttgttattattcctttctgaatatattatcaccgtcaagatcatgttactttcattgctgttggagtgttggtaacgtacattacaggaaattgactaaactgttgactttggcattgcttaacttaattgacatttgatatgatattcttcttgtcccgttatatcgtctaataacctccagaacagattgaattaatattataataccatcccttactttcaccgtgaactgttcccatatcttagctttatgagacttataataccatatcaatattatcgcggaaagagccttatttttttaggatatatatatatatatatatatatatatatataacttattatgccggaaattaaagcatatggtatataatgtcacttattataatttaattaggcacagactagtagctgaagcaaacttccccatggcaacacattatgtttaagagcttctctagatgctccatgtttcaaccagaatagaaataacagaaggcaagtagctaaaccatggcatagttccctatgcatgtattaagcacacaattgcaaaatatccacagtggtggctttcagctgcatttacaaaccagggagcagattatgcgtcacccgatctgtttgatcatattcaatataccgtgtcaccacgttattcaagtcatcagcttttttcagtgcctcaatctgcaacaggtgaaaaactattattgatagaaattggaatgtctataatagttttattgggataaagagtatgttcactgttataatctataaattgcagctcgaatgggctcaccaactggtccgataactagtttaaattagcataagataacgacttaaataagttttagaaaggatttaacattttttttattcgtagataatcgaagataaataccaaaaattacaacaatttatgcatcatgttcaacaaactaaattagagtccctgagtaaaaagtatttaatataaattttagtctaaaattccgtatgctttttttgttacaacagaatgtataagattcctccagggttttttggtgtataatgacaataatgaggatcaaatctaagtttttgcatatctatcccaacctctacctctaggccaatcatagtggtcttatgagtgtcatttaaatgcataaatttttaggttgtattcagccttaattaatattgcctttctatttatttataccgagttcaagaatcgagttaaaaaaagtgtgttcaccacatagaatgatagtattgacagataacttgaagtgcatgactttgtatacatttttacctgtttcttcaaaagctcattttcatttctcaagatatgttcctgtttgaagcagcaaaaagtgttaaaaaagaaagaaaaaaaggttaacaaaccataattgaactttgatccactgtttatcattcttaatcgaccttgtttgatattcagacaaaaaggaaacagtccaattatgtaatgcagacgaatgtgtggaaataaataaacacggttcttcacattatccggtatattgtttagaatatttctaattataatttgtctctaataaagtggcatgttaatgatacaaattgcaaagtatcttttttgatcctgaaattgcaaaatatctatatgtgattatgaatatcttggaactttagtgtcgtgtctggtactctggtgtgtgttagtaccatcagtttgtatggatatagggcgccctgaaactcaatatatatatatatatatatatatatatatatattcatactttaatgtgaataaattttaattgccatactcaatatgaggaatttgaattattctacatctaaaatttgaggcgttgtgcatagcaccttgatattaaacgtgtcctggacataatttgctagtatgatgaatgatgattagttctatccaactagtcaacctaacaacttaacttatccttaagtttatagttcagattaaagcaggggagggtggggagtggtgatccatccatataagtggttatcaaacatacaaaatcgagaaactcttaccaactgcatacctttttcttaagattcactacagattccatcatcaatcgcatctgcataaaaaacttctgcattagaacagtcttaaatgtaaaaaggtggagctaatgaggacaactgcatcgtcaattgaaattttaaaatttgttgctctggccgcaattgccatgagtcaaaagtcacagggaaatcttcatcagataaacttcggtagttcaagagagaatgagttttctaaaatagacctttagttaacacttaacaacaaaaagaacttaggcaaacgtaaataccgcaaattgagcttgcaacagaatggcgatactagtaatctcatacgcaaacaggatgatatacaacaccatcactagaatggaagggatcttcatagtataaacatttcacgcccagaataattggttctaaatgatagtgatttgaacagagaaaataacaaaattaagcagttaaaaataccagaatttattttgatatatatctcaagcacgacactagagcaaagcctttttgccttgaagtaaagataaataataagctcaccttattctgtaaaaaaaaaagaatgtttttgttaagaagggggaggtctaatatctgtttgggaagaagttaggtaaaagtgcaggcgaagcggcctgggaagaattaagcttaggatgaagtagtcccctccggtatttggagccatcagagttgaaattataggacaagttaaatactctcaactttcattcaaggatgaagaatgcagtacaacagttgaaaacttgacaactagttagttgaaatagggtttgataccttgctaagaaacctactcacctcacagcttaaactgtcatataaagctattgcatgcccgagcaaagtttgccgctagagttggtaagaccccggcaaaaactgattctataaatccacaacctggcttgaagattatttccttgactctagtctaggatacaaattataggtctcctgttaataaaaataaccagaattctaaatagataaacatggacacaagatttaaccaggatcaccaagtatgtcctcgggactagagcagttgtttctattattgattagaacaaatagggttacatcaattatatagaataaatcacgatatagatttgcaatatcaccccaatattgtattggggagggggggtgggggtcaatccataacgcattacaaagtgagatcaacttcctattgttggatttggcaacatctaactccacccatccctatccctgcacaatgtcatccatcctggctaataatgttatctccatacatcagcgtactcaagatttgaattttgtagtaaccttttttcgttttcacttatttcaagaacttggcatggggaggatgattggacttgctaaagagtagggtgagttatacttcttgcaacacatgaaggttgatggtggtaccaacaaaaaggtgtagtcttcaagccaataggcaaatttcgagacttgaacatctgccaaaatctggcttccccacaagtgtcttggacatccaccatttagaatgccgagtctttatttactcatttgtttataaaagagtcagtcgggtgttttgaaaacaccatcgtgcaacatttcttcctaataacaataaaagtcttgcaccttttcaccttgttcattatgattacattcattaatgattgtacttgtgtgacatggacatttcttatgaaaagtaaatctaaagtttgtcgatttctttcgtcttgataaaatttaattttgaaagcctattaagagtttcggtttgacaatggtacaaaatatgacaatctaatgttaagttcaattgtctgagcttgaggtgcgtatccttgaaagtattactgatgacatgtgcattgctttgagaaaaggaaaaaagatcgtttaccaggtatcctatttctcagtttgtttgtactgaccatctctctgcatcgtatcagagttttattgcaacaattgatgcaatcaaaactcttacttcagtccaagaagctctgaaatatgagtgggttcaagccatgaatagagagataaggacattcgaaagaaactcaacctaggagatagttgacaaaccaaaagataagaaggcagcgggatgtaggtggaaatacactgatgtatcaattgagcaaaaccacaagattggaagtgaagaaagtctagtagtagaaaagtcccaataccaaagattgatggggaagctaatttatttatcctacattagaccagataatgagtctgtttggatacaagctataaatatttttgaaaacttatctattggaaatgtagaattttttatcaagtaaaaaagctgtaaaaaagacttttagccttatctccagataggatcattgctaatgttattaatgtggtcatccaatttatgcatgatccctgtgaaaggcacctgcaggaagttgatagaatccttcaatattcaagaaaaggattgttgttcaagaaaaaagtacgttcatacattatccatagaggttatatagatgcagactatgacgagttagttgtaaataaaaggtcctcgtctggatactgcatgtttctaggaggaaactagtaacagggaggagcaagaaacaaaatgtagttgctcaatttagtacataaacaaaatttcaagttatgacacacaatatatgttttttcttatataggtaaatgttattggatataggggaagcatcatgaagagtgaaagactttgatttaaaaatgtgttttaagctttcaacatgcttgaagtgtcttgaagttttgtaaatgaatcaagtataagagaaagataatatgttgattcttgcattatattcattcatccattaacaagcttaaatggttttcattaaaacatcaaagtttttatctttttggttaaggattcaatctgattaaaagatttttggaaaaatgattttttactgttttaatcaattacttgatggtataatcgattattttgttcctgattcaatctggaaaaacttcatgaataacttaatcgattacttatcggattaatcgattatttggcctttgagtgaaactgaactgctttgttaaatgttttaatcgattactgacatagtgtaatcgattacatagttgaaaacaaattttaagtttgcctggaataatcgattaccatcatctgtaatcgattacatagttcattttgaaaatcctaattttctgacttaatcgattatcaaaacttgtaatcgattacacagttcattttgtgaaactgaactttttgccttaatcgattacagctcgatttaatcgattattttgctcgttgttgaaacccagaaatcttcttgaacattttaatcaattaagtgataatttaatcgattacataagcgttttaatcgattatctggcgcatttaatcgattagagttagttacaaaatctgttataaataaatttgaaggcttgacttgttttctaacttgaccatttcgtatttctgagtatacacaagccttctaagtctttcaaagtgattttctaggttctattactttttgcttcattcaaaacattcatgggtctttgaatgattcttgagcaagaaacttttcaaggttaaggaaaaatatgttctgattttgtttgctattcaacctgacttagtaacttatgtgcattatattcattagatcatcaggttgtctctctccttaatctttgtttgtaaattcgttttgaatttctgttgtaattgactattgtaagtgggttctttttgcttgggtctagagaatggttctctagctaaagaacaaagtagtgttatctggttcttcctctttagaagtctaatagagttttagatttctattctttatctagtgttggtaaagggaggttttgtaaaagtttgtaagaacaaaaatttataatagtgaaactctaattcagtgtgaattaaaagaaattggatgtagcttctgttgtgaagtgaaccagtataaattgcatgtgtttttgtttctctatctctattactcatcttgttcattgattctttgattcatattcattgtccaacaagttctgttttgaacaattgatttttagggactgagttatttgattgagtaaaaatatttcttatttttgaaagtgataaagattctaaactctaatttgaattaattttaaaataccaacattttaatcaattcaccccctcttgtttattgtaagtattcctattattttcaaatgttagttttattagtagataaaatcaaatgttaattttcttaaccatctaattcaccttatatttccaacacaatatatatgtgagaggtaatggatgaagattattcttgatgacctctcaaagtacaataggaaggacttataaggctgttttgtggtaacaattcagttattagtatggcccataattcaagctagcattacagaacaaagaacacagaaattgataagtacttcatcgaagaaaaaatggacaacaatctttagtcacaacaaatgagactccaattcatagacgtgttcaccaaggggcttcctttaacaagattttagaaacttattggcaagttggatatgattggtatacatttaccaatttgagggaaagtattaatacaattgacatttaagagagaaaaaattatcttttaatttatcttgtaatttatttatttttatatattttagtttatcttttgatttatttatatatatatatatatataaatacacatattataacccataatattgaataaataaacaatttcttctctttcatctatattcagcgtttttgtccggtgaaatgggggctagcttgttttattgttaagagaagcctcaacaataaagtgaataatgtctcttaatgcatacacttcttgtcctgatctaattaagacggtagaataaaacttagaaagaactcgggggtgattgaagtatcttgcattcaaacgtataagaaaataatagaaattatctgtgcaccggtgacaaagaaaagtaatgaatcactactaactgccttcgggacttgacaagtgtacactgtctaattactaggccatataatataaatgctataaacttgtactaaaagtataagcttaaattatctggtagagttccaagaaagtttcatagaaattttaatcaatcctccctccggtaaatatccctacaggattttttttcattgatgcaatgttcaaaactcaaatgatatttgctatctaaagtgctttattcgttttaagaaacccagaggataaagaagatatgcttgcatgacattcttagaacaatagcttttttttttttttttcattgccaaagctgagtgatgtatagtttacacttaataaattgaaattcgttcactgaatagagtgtttaacctttgctgatctgattcgcgaaagatcagaacgaaccactttctctagttccataaggtcagtcacactcagatgctcaagttcagaaacaccaaaatgcctgcaatgaaatttaattagatcagtgattcgttcataccttaacgttgcagaaagaagaatgcaaagaatcacctttgcaccacttgagaaaacgctgcaccagaccagatatctgcaatttcaaagcggagtccctgctaccaaataataattataatatcaataatctcggttgtgatatgtttttccaagcgtcagttcaacatttttcataatttgcttcaaataattcccctaaaacaacaatattttatgtatcactttcttttgctctgtcattttttagacaaaaagaaattaaaaatacaagcttggcgaagctaagcataataaagcatattttcatttgaagtgaaagcgagcgagagagagagagaacctgagataaaagcaacaaaacttgaatatgcaagttttgctgtattgagaactttacctttattgtaacattaagaaatataatatcgacacccctagctttcatattgaaattctcctacttatttagttcccatgttagccacactatctatatgataccttgacaatattaagtgctctcttcatccttgttaccttgcaactgttacgagacagttcagctcttatatatgtttacagtgataactttcaagatgttcttatggcagctacggttagattttcttactctatcatgtcttgtatgagaagtgcaatatatctagcatacatgaaaagttccgtacctttgtgtcagtaccgcttgctcctaaatgatcccaatatcgctgcacaacctcggccaaactgagaacattaaattcacggatttttcattctaatattgaaataactaaacaacaacaaacgcatgatatttgataggcttgggtgcaagtagcttaacaggtcttttttctagccagggatatgtttctgcgtttggattaactttcaattatgtcaatatcaattctaaaatcaagttaaagccaaagcaacaaatagttgcttcaactttttcaattttccaccatgattttgagggtcaaaattggttctaggaggtatttaaacacactagtagttaaaaaattaatattagtgtgcgtacaaaaatgggatgaatgaaaataataaatttaaggggaggggaggtcatcccatctcattgcagtctatgataagctttagcaattgtttacctagggagactatacacctggtcctttcaggcatgggttttagttcatattaactaaaacaacctcataaacataaaatgaatgtttagtagaagtattaaaaagaacattagggttaatcatattggtgttatgttagtagttttaatggacaggacttgtattagttttattattgcttaacctaattaatatggtagaataaatatgtgttaagtttgcatcaaatatatacatctgttttttttgttttttttttttacagaatgtacatatctatcatatcgtatgtactcaatgatctttcttatttgattctttcaatttcaccatcttattgtagtgatatcatcctccaatcacaatctaatctatctcaacttctgcggccaattaagtaccaaagatttgtagcttctttcctactttgcatttgtctctctttcgtgttggctatgttctaactagctttgacaaggaacaattcttgttttttctgaagttgtatctataggttaaccgttaacctataattctacacttaaaaaacaatgtagaggatctgaggctctaagctgttaaaataattttattaatttaacatatatgcgatataatagtttatatatatatatatatatatatatatatatatatatatatatatatatatatatcaatttcatataagcttggaccgtcggattacaactgcaggacggtgcagttacatctgaattccagaggacctaaatttaatcagcaacttataaccttagtgttgtataagttggatttattggaggtcaacttaattaaaagattaagtttctgggtcaagtctgggccttttttctaccttcacttctacccgtcattgcaattaagaagttattgggctcctccaactatgtttcatggtccaaggtagttgagaagtggtgaattggacaagggttgaagaaaaatactgaggagaaaattaggagaaaaatactgctttactgtgtactttatattgcagtctattgattcttaccttcacaacgtctacaccaattttcatacttgttatgagttgtggactcaatcttcgtaaacaacacatgagtgttcttgaaattattggacagtggttatctatcaaagctaaattcaatgctctcttaccaactggaaaaccaattgctgaagagaggtttgggttgaaaagtaaaggttgaaagctataagtgaaggtttataaacaaaaataataaatagaagcaatcaagaaaaattgtaaggaaaagcaataaataaatgcaggattaaataaacttgtttttaaattgattctccttttgaagttaagtataaggtctatttataggcttgaaactcagaagatcatctattggatcatatctttctacctcataactataatatctcgatcaaatcacaccataatgagaggaatatggaggttttgtacatgtgtgcgattgtataattaacaatgatttaaataaattaattgatattacatatatcaacaagatccatctatttttcactagcctataacttaataacttaacaattaagcatcttggtttgtagtagttatgagatggttgacctaaaatgtgtgagtgaggacaaagtatcctaaaaagttttatgttggtttgtgggacagtcattgattttgacatcaaccgaaacagattctcgaggtctaaaaaaaatagcatcagaaggttagaaagttctgactaacaagaatgttgagcaaagtgttactgtgtgaagtgtcatgatatgtgagttgttgtgaagtcgacaattaggagtattacagtaactacctaaaaaatgtgacttagagttgcaaatgtttttttcttaaccctccaattcatcaggagaaagggattttgactaatccaaaatttaactaagaggtaagtaaaatctaataaagatcggacttgaataatacctaaatgatttaatcttacaagacatgagtaatcgttgcaccaatttgatttagaaacagtcattaaattacacccaaatagcagcttcaataaatgtttaggaaccaaaccgcagctgtctaacatgttagggaaattatatatatatatatatatatatatatatatatatatatatatatatatatatatttgaagttctatcagaaagttatataaaaaattaaaaagtattacttaaaataaattcatttagacacacatttgtgccaacgactttgaatgagattttctcaatgtttagggcttccttgaatattgttagatataaaacgtcatcttaagctaagttttgggttatataacataatataatgttagatcatatatgactattctctctagagatgtaatttaaatttgttgctcccattcttctaagcaatattttagaacaaggtaagatgcttaagtgtagtctcatgtctgacaaagctatgttacgctttcatctaatagtttaaattcgtgggataattagttcatgatggtattagagacatgtgacacatatttttacctaaacaacttagggtgtgaatcaactcacatcggattcattgaccagtaatcctttgtgaaagtaagatttctacgaaaaaaccataaaacaaacacactaataagctttaggagtaattgattcaagaaatggtattaaattaaagacttgttctattcgaagtattgacagtggtggtccaaactctatctaggactaataggtgtagaccgataaatgatttttgccttgaagtgtgagggtagtagtctgaacttcttgaacctagtctgcatgagtggtggtgagagtatctgcaaaggccaaaggcacactccgatgccaagttagtgaagaactttacacaaagaccaatagtaataaatgcgcgtaattataacacagatgccaatagtatttaaaggagtaaggatggactggatctctatgctaaaggcccatgattcgaagagagaaattattcgttgttcttagaataacataaagtgactttaatctccgagagagtttgcagggtcaacattttagaggaacgggacttggattcgggttgggtcctagctaggcctgattcataacaaaactcatattaaagatgtactatacataaaatcatttttgtatttttacttaaaacgatttgataagctttgaaaatggttggctcttccacatgccatcgctgagtttctatacatgacctcgggtcaaagtttcggaattgcacctattatctaaatagaagttaaaatatgttggatttaaaccactcagaaaggggcggaattaagggactaggatgggtcatcactcccctaaaatttaaaaataaaaaatatatatttttaaaaaattaataaaaaatgaaaataaaatgaaaatgaaagaaaaaaaaaagaaaaatattaaaaaatgtgaaaggggnnnnnnnnnnnnnnnnnnnnnnnnnnnnnnnnnnnnnnnnnnnnnnnnnnnnnnnnnnnnnnnnnnatataaaaaaaagaaaagaaaatgtaataaaaataaaaagagaaaaagagataacaaaaaaagaaaaaaggaaaggaagatgataaaacaaaaaaaaaataataagggaaagaataaagaggaagagggataaaaaacactataaaagagagaggtctggacacataaacacacagaggagaaaaaaaatatacaaatcccaagagaacagaaatagtaaaaaaagttgtgtcatttggtactagaattagtgaaagagaaaggttccagttatcccttcattcctttcttttttcctcttttcttctttctcctcctatttcttattgttgttgttaatcttctaaaataaaataaactactatttattcaaggctagcaagaagaggaaagttcatcatttacctcttattgatagagtgattaaacttgtattcactcttctattttctataataattactgaaaaatctttctcaactataaagataatcaagactagacttcgaaatagaatcaaagaccaatttcttgatgattctttgattacatacattaaaaaaaattgttttgagttttaatacatattcaattatagataattttaacaatatgaaaacatgtagaataagagttaagtgaagtaatcttaatttttgtaatagatttttttaaatttttttgtatattaaatttgtattatttttgaaatacttttatttatgttataattttttttatgttcatcttctctcaataaaattcctgtctccgccactctcctcagacattttttatttatcaattgacgcttctgccacgtccctggatatggtacagggtatgaaaaagtgacacctgtacctgaccatgcagttgatctgaaggctttttatacttgtccaaaatcccacactgtatacatgaacgctatttttaagtcagatttaatttttcattttccaattaagcatatttctcaagatttctagatctctttaattcaaattttatgctatcgttgataatgcttttttaatgaaccttggatatgtttgagtcttactataatgttggtaactgatattttcattgggagtctttttgacagtgtttctttgctcgtggtcactcaatattagaaacattttttctgattgttgaatcatttatatgataatttatttttttaggttattcaacgtgttaattgtaacaagctgaaaactcagttgtaagcctcaatttgcagatgactgttaattagaacaaaagtatttgtattgagttggagttgtaccctaattatactataatgataactaacttagattaatagtaatgattggtatctacaagttgacaccttaaatgaagttgatgttagtgtcttgatagtcgtgaacttgtataaatgttcaaataaaattgtttattacaattgagagactaagaacttatgggaagtaaattctatgttggtagtattctagaggtgaaaactcaaagaaaataaaatacataagaggaaaattatttgggactaaataattttttgattttattttaacttttgcttggcttgataatatacctagtgagtccacatatttatagtaagcaatggaactttctagagaaaattaattcactagtgcatgaactattattacctagatacatgtgattttctaagtacatgaacataatttccaaaacaccctgtactaaactcccatttataatccaaattttctatttcactaccaaaatgagacaccctatttgtcaattcactcaaacacatacgattataagattgaagttttctttcatagctccatgatcactactttaagaaatttctagagctaccttccatgttagaaaagattggccaaataatctataaccgtcgacgttatagtaaaagcctacactcatgaatactctgaatcgttttgaataatgaaaggaaataacggggaagagtagcctagctataatgaaaataccaaacccttaaatcggcagaaggaaaaaaaatgaagcaaagctacaccttgggaagggaacaaccgacttcaacaaaacaagtagggcaaaaagtaaattaggatattaaaccaatcaccagggcggtttgacagtgaaaacacatggagagtaagactataaggagacattgagattgaatgacagttttttattttatattatcgatcaaaatatatgtattattttttaatagatttaagaattttatttaacttaagaataaatagtataggtagtaataataaagagtttcatattattatacaatgattattgtatatataaaaaaggagttatatgtttgagacaaaatctgtcattgatcaagtaaaacataaaagaaaaagaacattagcaatataaatatacatatataatacaaaatcgataatcagatgtaagtaattaactatattgatttgattatcaccatttatagacttatattcattaattatattttttattaaggtatctttaatgagagatttcaaattaggattttatatcattttttgatggatttcacatcgtcatttaggattgaagatctctcaaaatctttctcattttttcttttagtagtaaatctcattttgggatcttagataacttttaaatcttacatggacctcacttttaaatattttatttaaatatttattaaataaaataaataattaataaaacatggaagaaaaaaatttgtaaatattaagaaattgaaaatgagcataaatttaatttttatttatgactaaatgttaaacaaatgcaaaatacataaatttgataataaaaaacgcaacacattaatgctaacgaaaaattaaattttattattgttgtaattgtaatgttttcaaatatgctattccaagtctgtttaaagttgttgatgaattccttttgtatgcataagattaggcctgattaggtctgaccttgacctgatttaaaaacataaagtttggtttggcctagttacatgtgataggcttttttaggtttggtctgacctatttaaaagcctgattaagcttacaagcctattaaaaaaacctatttttaataaaaatttaattttacaaaatactttaaatcaatttaggaaagttaacgaaataattttaaacaaaaaacgtctcaacatcttacttatatttttaaataagtaataatcattttatgagatcttcaatgtgattttttgaagtgattgatcatccaccttcataataagaaaaaatatttttagaaaaataaatatattatttttaagttttaatatatatatatatatatatatatatatatatattaaataggccaacctgataggcttggcagactttttttaaagtttaaatctggtctttttatttcaacagacttttcaaaaaactttagcttgacctttatgataaacaagtcagaccaggccaggccttaaccaggtttgaccaaagacccctgataggcaatctgtcccattttcatccctatacatggtcataatcaacatcgacattatcaccgaatgtatctcgtttgtcttcaacaattatgttatgcaatatcatgcatatcaacattatatacttcaatgtatccatgttccaggcacacgatggaacacatataattgtgagtcgagatttgagcattccaaatgctcgttcacatcctttctcgctgcttcgcgacattttgcaaataattttcttttagggctttgtggcattggaatggtcttcagaaatgtggctcaatcagcataaaataccatctgcaagatggtacctcatattatatggagttccattaattgtaaattgtactagaagagttcgaccttgcaaaacataatcaaacacaggcgattgatttaatacattgatgtcattatttgaaattgcaactccaaatattaacgtcaaatccacaagtcttgtgaagcaataacttcaagttttattgtggatttgcgattatcacttctatgatattggctctgccatgcaactgaacaattttttcactctcaatgcatacaaccaatagaacctaacatgcctacaaacctcatgcatctccaatttgcaataggcaattgatgtcattgttgttaggccttctcaagaactcttgtccaaatatctcattgacaccacttacaaatttttgtaagcattgagttgcaatgcatttatcaattctaacgtactcatccacataattgacaggtgatccgtgtgccaatatacgaataactacagtgcacttttgcaatgatgagagacctattctacccacaacgtcaagtctcctttgaaaatactcatcgtgattactaatagtgttgtcaatttgaatgaacaattgtcgccgcatttgaaacctacgtcgaaattgagtctttgtgtatactgaattttctgagtagtcattcatcaatcgtagatgtccatcttcacgattgcgattaatcactcttctagtccttctgtattgactgttgttgccttcttgttgttgcatcacacgtaagtagctcatgaacaattaaatagcaaattatataaatgactagttttgcaacagctagttttataatgactattaaattatataaatgactagttttataatgactacaactagtttcataacatctagttttataacaattagttttcaaaaaaaaaaagacggttacaaattaataataaaaaaaagacaaatcaaacccgattcctaaaaatacaaattaaaaaacgatctcaacaaattaaaactacttaacaaattaatgctacatacctagtttacgcctaattattttacaaaaggcctaacgatcttggagttgactttcggttgtaaatgtgtcattcattaaaatgtcgtaatactctctttccaattctttcttccttaagattgctagtctgacattgagaacgtttatttcattcattgctttctccacaccaattaagtccacagaattggtaaatgtttctactcctatcccattgctcttcgttttggttgccttttgacccattggacggacaattggagacggtgtgtcagcttcagaatcttgtactgatgtttttgaattagatgacgatgaatatgtcccagatgcaaaaatcttcgtccttttagagccattttcaataaattggtctaaccatttcggttgttcttaatattgggaggcttacaaaacacgaaagaattgttttatggtattgaaagaaaaatttgagaactttgagaactttcagtgaaagggatttgattattttgcataaaattcattggtcgtggcaaatatggaaaaaatggaggaggattttgagaattttttatggaagaagattgattattttgcataacattcattgatgatgttggttacaagtagggaaaaaatgagggaagattttgagaatttccattcaaatgagaaagttgataattctacaaaaaaaatgcaataaacttgccaatatactgatttggatctattaagaatgaaaataaaccaagagattgagattgcaaataagatattgagaaataaaggataataaggagaggagaattggtgtgcaaaatataaacagtatttgttcaatttataggttgcaaaatatttaattaaaaaaaatacatagtctattgtgaatagattaaaaaaattaccaatattggttgcccactaactaaaaggcaacactaattttttttaaaggcaacatttaatgcaacatctattttttaagttcaaatttaaattgtaaattttttaatcttttttctcttcatcttcatcctcattttttcccaatccacgtgcagtcccttcctctttttttctctacgcctccccgctccccttcccctccttttccttttctctccgaccaatcccttcctctttcctcttctcctcctccccctttacgtttcctcttttcttcctttcccttcatgttttctccaccctcaaccaccaccacattcttttcccttcttcgcccccaatcactatgcccctcctcttccttcgctcttgaccaccacgactcccgccccttcctttgtccccaaccaccatgagccccctcttttcttttctcttctccacacatctcgacagtgtcacgcttcccttggtgccatcgtgtgcaactcagcaccgacaagggccatcgcccctacttcggtgccgccacagcctacatattatgtttcttcttccccttttcatttccttttatgtttgatttcttcttctttctgttgattcctacctaaatctattagggagagaaagtaaaaaagaatatattttattttcaaaatgtgtagattttcaaggatcttatacaagatttcattctccataatgaaaattttgactcctcctttaatagaagatttattaaacaatagatcttaaattcaaaatctttgttcaaaatatattattgaaaaatattctaaaatttttctctcaaaaggtgctcaaaatatattattaaaagatattctaaagtttttctgtcaaaaggtaaaaagtgagagacaaataaagcgattgaacatttgttagcatatcgctccagcttgattgagacgaatgtgaaaaacaatttggtccataactttttactattgtaacaaaataccttttcttggcattattctcatggaaacaatattcgtacatttgaaaatctcttttcaaatcaataaatctttcagcataaatgttctctctctgtatatatattccagcacaaataaataaattatctacactttgaagtcttttcttcaagtaaaaaatagatttaaaaaatgtgttctagcaaactctagtagcataaacgtggatattatatcaaatcaacttccagtagtgcagcagtgcagagagctgacaccacaaacttatcctcccaccttttaacaagtagttcctatccatatctaaggctccgaaaaccgtgacaatttgacacgactcagctagctaatggatactacttttgcagtttgcactagtttagttaatcattcatttccatttttagtttccaaccaacgaaaagcaattacatagcaaagcaaacaaatcaaattacaaaagaaaaggcataaaacgaaactaatttcatgtgcgacgtgacgtgatccaaagaagttggacacatatactaggctacggtgtacggaacggaaatcataaaaggtactgtgcggtttgcgcgtacctgtcaccgttacagagctcgtagagcttgcccgtgctggagacgatgaccagcgccaccttcgcatcgcagagaatcgataactcgcgagctttcttcatcaatccattgcgcctcttggagaatgttatctgccgcgtgcttttgttctcgattcgctttatctccaccttcttcttccccattcttcttcgcgccaaaaccctagctcgctaccttcttttctattcggatttctctctttactatctccctccttctattactatctctcctcatagccataggcttagcgtgctgattccttaatcgacacgtgtcccatgaccagactgcgatttaaattaactgatattcgtttcattttttaatcatctcatttcatttaacagtactagtcaaaaaagtcaaagccacatgctgcccacattgtgttgctaggtactataattttgtaaaacttaattaatgtaataatgtgtctttatatcaatttattttagaacttaacgttatactttgatcatcatccaattattcatataattaaaaattattttagatattgtatttaaaataattgtgttaattaatattataaaaatttatcttacacaatctattaaaattaaaaatctttattttagataaatatcattttaataatttaaattttcttaataataattttcaaaatatgcattcaatacttatttaatcaatttatttatgtcaaaaatacatttaatttaaataattaattttcaaatatccattttaattagtttattttatgtcaaaagcagatttaattaaagatttccaaaaaaaaaaagttttaaataatgattgatgtttccaaaaatgatcttcctcgttcatttatatttaataatgaaaacccatatggataacataactacataagtgaaggtccattttgaaaaaataagttggctgaaactagctaacgtgtcaaaagtcaaaactcgaaacaattactataattaattaattaataactattagatgcactgaggtcattggcacgtgattcagccattcaggccaacaaagtgggtgctgcaaacaattattactagtactggcagtattcttgttcgtattcctattattctaataaaaattattttaaacattcaaattcaatgccttcggtgcataaggatggatcacgatcttctacagttgcataaagaactgtacgggatatgagattcttatccatacaaaaatattcctttcataaaattataatataaaatatatatttaacgctataagcatccgttggatgcaactgcagaaccgtgcagttttttttttttctaaactgcagggatcctaaaccacataagtatagatataagttatgataagtagtcaatgtaaaaagagaagaatagaaagaaaaaagaaatgttaatagatcattaacatgtagtttgctgaataaaaattaaagcaggtaattcattcgtatattaatatttatatcatcctaactcctaagtggcaagtaacgtgcattctattttgagaaagtgataagaaagaaatcagataaaaatggaatggatgaaaaaataggtagatgtttataatttatctatcaatactcttattaaaagggaagaaacagtaaccgaagcaaagaagtgcagttttatgaaagagttagcacacacaaacaacattgcttaactttgttcctacttcaaacatggtagacacttacatcttccttacattcaaagccattttcttccttctttttttttttcgttttcaaataaaattggaacggcaaatgtgctggtgcagtggatcttatgcaggaaacgctaactatggtaaccatcctgccatgtaattgctcatgcttgggcctgctgtcaccactgatactggatcaggctgatacctgcacttgaaaaatagtatcattattaaaaaataattgaaatctaaaaaacttaggccaagaatgaaaattctaaataccattatagttatgctaatcaaatcaaccaactcatatgaccccacatctattctaatcatatttacatcaaagatgcactcctaagcatatcccttactagtgaaccaaatttgtcattgatgcacttatctaccttactagtgaattgaccatttgatacagtttagaagagtaattaacaattgtgaactgtaaagtgatcaatgattgagtcaattagcattgagtgcatacccaatttgtaacgttggctcacactccatttgttgaaagagggcttcaccatgagtatgagctggatgcctgccatatcccatctcttcaactccgggattcagttggagttgatttatttgatacccttccaactgctacaaatcagataaagtcatttatacccatcaattttcgatatcacaatatcagttgtatcttatagcaatgttttggtcttgcatgattcttaattctattttaaaatgtattaatcatatgttatatactttgtgggatgatgcatatttacatatacaggttgatgaattctaagtttctaacttaccctttgtctgagagacctgttagcttcactcagcaagtgttcctacacaagtgacatgtataaattggtgagcaaccggaggtatggcatgagatggtaaacggtggcaaaggaaagtaaaattgttttcatacataccttacgttgaagatcagagagctgatccagcatgaactgggtctgtaaatcaaggaaacaaacttaacaaaattacatacacatactacatttttacttagaaattacacattttgagattgatatatctatatttagaattatgtaacgagtttctcctcttcactaatcaatagagaaattaaagaacagtaatttccttgttagttactttaccctttgaattttaatggtaataatgtgcccccaatacttgtatttccatttcttacattactcagagcatgacttaaataacgctctcaaaatgggcttgaccatatagacatagggatatttcaagattgggctcttaatatgttcctagatctacaatttcatatgttaattggcaaagaaaagttggaaacttgagtacccttgttgatcttatttgcttcaaggacgaatctagctgcctttcaagagactcgagctctttgctgcttaaaggaccaagatcttctcccataaggttcctgagagggtaaaagttaaatacaacacaacattgacttggatgctatatagtatcaaccaataatcatgagccatattattagaaggcccaatagggcatccgtacctctgggaccgttgtagggcctcataacgtgccttcagcttcaagtactcttgttgactgcttaactcctatagtcgtggtagcaaaatcaaactatatagttaaaggaaaaaactatataattaaaggaacatatatagcgattccttttatgtttttccttagtgacctggtcaagacaacagcatttctattcgagcaatattctacttgcaaacctctcagctatcacaaagggttggataaaatatgttttatagtctttgaaacatagttaaatttagtttttttttttaatttttctaataatactaattttattcgttataaattttatttttataaaaaaattattattacttattgatattgtgacatatatccaacacgttacaatatgtgtcatctcaaaatcatctttaacttaacgtgaatagtcatatattactcaatgctgacattcagagacttctaaaaaaataaatttatgagaattaaaagtaataaaaaattaaaagaataattgaaattaaatttagtcatatttatagttactaaaaatatttgtgtaagccatagccaataataacaaaagcttttataaaacatatatgctggcattcattttctgagctttatcatctttttnnnnnnnnnnnnnnnnnnnnnnnnnnnnnnnnnnnnnnnnnnnnnnnnnnnnnnnnnnnnnnnnnnncttttttctaggttgaggcataccaaaaacattcaacgtgttaaagtttgataagtcgttgagttgagtagaaaatagaaagaaaacatgcatggaatacacaaaaattaaggaacgatttattcacacgagttgaggaaaaaattaaccataagaataaaagatttaatggattcaattaaacaactgacgtcgcaaatgattgttattgttaaatagggttttgttacaataatactataagcatatttgtaacaaataaaattatgctgatacataaataaataaacatgataatgacgggatgacgtgaatatgtaaacatgcaaacacaagtttaaaacacaatccatgaacatacacactaaattacgttaattagcaatcaataataaaataaggcacgtaaattagatactattaataacataaggcaaattaaatccaccctcaaattaaattttatttttctacttttcttcgattgcgagtagctacatttcagcacatatgttatcgatggccaaattcatgcatagcttcaatccctgccaattttttgttgttacaaaaagggcaaatactgagtatatagtgagctagagtataagcaaagcgttcagaccagagcatgcggttatatatcatagttgcatttcttattgcaacaaatagcattttcaattcctaatttggctctattattgcttaaattaatttacttatcaaagggaaagtcaaacttgattattctaattattttagatttatatatttatgaaattttctaattacaaaatagcgatggctcatgaaacattttttgcacgaaagaaccaaaactataagagcaatgcttattctacaaaacttaatgggttgtgtcaaaaaatggaccttgatatacaattttttgtaaacaactagacaaattcggctcagcacatttagatcggagaactgagagaaggaagtactattggtacatgatactaatggcacacgatcgtacacaaataaaattataggctcacacaataaaagttactataagaacaaaaaattacatccgtcatctactatatggagatattcatgacaatatatatatatatatatatattaagattttattatttacactattatctaagttttaaaattttcaaataatgcttaaataaaagaattcaaataataataaagggtctgctacaaagtgttttactagtatttcgttaggctataattggaggctcgccttaaaagtccttatgaaggacatgggcaccttatgcataaatttaggaaccagatcaaatttatgtaatcaaattaattcttagtatttcgtgtacgttatgaaacctgatttcctgtataaaactaggtaagtgtatggtgctccatatgccaatttgatgatccgaaaatacttccaatttctgtgttccccatacccacctcaaacactggatactttctagccattgcactaaacgggcctagaagacatacagtcaaaagttcttgtgtgtgggaaactatttggagcagttatactgatcatgaataatcttaaacttatttgaaacagcctaacaaagaaaacaagtggaaggcaaatgacttaattttattttggatgaagttgtccttaaagttcatgtatctttgtaacaacatcaccaaaactatggtccactgtaggatcaattttaaatgagcatgaagtcttagatgcagatacagctacaacaaagtttagggtgcctaaaaaatgaattccatgatacaaaagactaaagggacttcgaaattaaaccaatatgtgctgtctctatgatacttttgtccacatgcaattaaaaagtaacgcatattaattaatgcacacttgaattaagtcaaacgaaacacttgacttttgttgttttgacaaaacctcttatatcaaacaacaatatatacgcaagttaatatttttataattattaagagtgtattaactgaaaataagaatagaagtcaaaacaaacacattgtattttgaactttttttttcaaaaatagtacaatgagctaaattgattatactgtatattatgatagtagatttgcatgaacaatattaagctttatttttaaaaaaaaataaaagactttttttcaaatccctggattcagaatttgtagttgcgttaggttattagttaaacgttttacaccacaacaaattcaattatatcagtcaatgaacaaaaatcagcataacttttgtttgctaaagaaaaaaaaatacgttacgatttcagtatttttatttatatccatgaaattctttttcaagctggaactataaggtgattttactgcacttgccagttgtttatgtaatcaacaaggtaaacctctgatcaaccacgagacacagcatatattgacaatgctaaacgtaatataaaacagctataccccacgttaaggataattatagtaaatagttgcagcccaggaaccccaatccccttgtaagtaaaacaaaaacagaaatggatgaggtaataaaatcagccatcaatttaggcaaattaaatgggcaaaaaatgcatttaaatacgatagatgggactattcaccattaccaaggcttcccgtgtagacacattagcctcaggcgcaccatagttacatttctggtatctctctagcgttttgagcatgctgcacgttttgagaaaaaaaatatatgtttgtataagttagatgtcaggtacttagtacttacaaaatgatccaagataaattgagtaaaactagattctacaaatataaattattgctcaaggacaaattatccatttattaagacatctttttacttcaattttgctttaagtccaacatcaacaagaaaaagggcacacattttttccaagcaaagaacaggaacaacttaagtttgaaacgaagaaacccccatttggaggcaaggatgggaatgctccataaatataggaaaaactataagagatgcagaaaatcggtaaacgagctggattggaagatcttatgagttatgacaattaagtaatgttttagttttagggctactatcgaaaaacatcatatgacatcaacctctgaatttcttgaccaggaccagagaaggtcaccgatgacagaatttaagggaccaatcctctatttagatgagaagaatgaaaacaagatgtgaggaaaaaaaaatttataagaaaattttgaagttttttttctaaagttttcatttttgaatcaaaaagaaaagaaaaaatctcttttttttcttctctccattcaacataaaattgtttacacaacaattttttatagtaatactatatttttttctctactaaatcaagtattttatctcacaattttcgttatcttctcttcttatatctctatttagtctgtatattatagcagaaattgtacaaactaattatataaatacaatttcccaattactaatgttaataaattgtacaaaatgggtagtattggatttgacgatgagacatgagactggtttcgttgataaacgtgataatattaggccatcaaaaggagccaactacaaatcaattatcagttatagaaaagaaaactggtgtcctattgaatgtaggtgaggtaagatcatttgcatggagtgccaccttataaacccagaagaaaaaggacggaacataccaagttactaacagaattttcggtacaataatcagatctgaaatgaccagagtgttgcttccacaaagaaaatatacgaattgaaccttcggaagacgcaaaataatttaattatttgaaatgccaaaccaattaaaagaaatcgtctgtctatgcagataggaataatgaggtgattggaaaacatgaatttgatgctgatttaacaaaatgtccactctgatttaacaaaatgtctctatcatgaaaaacgttcaaatgaaaaagaaaaaaaaaaaatcttgtgtcagtagtaacgtggagaaattaatcaatcaagcgattgactccaaagtgagaacctttggtcatgattgtggatcgaaaacaaacaaaccccagagtgtctgtaagtaattgaagcgcttgaccaaaatagaaaatcacgcaagctaaggcaaaacataaaataaattttaaatgggagaaaaatagaacactgcagagatcgatatatggtgagaggtgcaggaggggaaaaaaaactatctagaaataaaaaaaagaaaccctaggcccccccagagatgtggatgagacatacataaaatattttctttaaaaacggggcgtattaatttgacagtgaataagagatgagttacgttgttggagcgatgtttgaagactgaaaccgaaagcaggctaggtgctaaacttccaaatggaacaaaataattgatatatatgcttcttttacacaacacctaattacaccgaaaagaggcctgacccgagactccaaaattacttttgggaaacgcttttgaacctgatctgtttgacggagcagaaaaacggcaatctcaaatgctgggtttagcaccaaaaatgggaaagaaagagaaagctcaagactcacccaaaaagaagaagagaaacgagggcagagaaaaaaagaacataaatagagtggatacaataaaacagtgatcctctcttgcttaatttattttatgtatgtctgttccggtttaacgcgtttccagttgcagatctaacagcaacgcgtttgcagaaaccctcaaacctcctaaaaacgccgagacatttcacggaaacggaaaaacctcaacagtggaaaatgaaaaataaataaataaataaatctacttttctttctttctcgtgttttctcaaacaaaactaaaataagcggggggaaacgccagctgtctggaaacaaacagcaaaaaaaaaaaaaaaaggagagagatttgaagatctttaaaagcaaaaaaaannnnnnnnnnaaaaaaaaaaaaaacttatttcttaacaattactcaatctcaataatactgttaaatgtgcatatcaattgaaattagattgttttagtttagacagtgatattgagtttttttttatgcaagtgatattgagtctgtacataaggcttctaaaaataatactaaatgattaacaaaattgtattttactggtaaaatggaagtattattattaaatataatttcagggtattaaattaacaaaattgttgaattgagtgactccgtgttatgtcataaagcactaataatacatccattaatttttaatgaataaatttacgcctctagtttaatattaatgatgtactaatagtgttaggattgctatcaaggagagtctaaatatatcatctaaggaaataaaagtacaaagtttttcttgtaaaagatagcatttattatgtcaaaaattaatataaactagtctaattaatgcataatttgctaagtgatttaaaatctctaatatggtgtatttgttatttattacccactatccttaattagcaggacactacttaacaagaccgtannnnnnnnnnaaaaaaaaaaaaaaaaaggagagagatttgaagatctttaaaagcaaaaaaaataacaagaaagaggtttttttttttgtgtgtgtgtaatttgtttacattttagtgaatatacatataccttgaactgctgcagaactcgtacagttttcctctattggagaagatgatgagagcaacctcggcatcacaaagaacggaaagctcgtaagctttcttcaaaagcccgttccttcgttttgcaaaggtcacttgcctgttgatcttgttctcaattctcttcaactccactcttccccttcccatttctctcgcttctctttcttacacactctaatatccaataaaagggaaaaacaaaaattggaataataaaccaaaaccctgtgatgaatattttcgtggctcgctcgctccgtgtatgcttgtacacgcatatatatttatatagccacgatgtcaagatcttacaataaaaataataataaaaggggaatattatatatattatgatttgtgaaattattattattattatttgtatgaatgtgagagcaaaaccatctttatcaagccctaatgcaaactccaaaatcaaaaccccttgtacctgtccttttctccctgctatcaccctctggtgtgtttaacacactgctaactccatgacaatgacacgcctaaggaaatcaaaagtttcgttttgtaagtggggaaggcattttctgcgacctagctacacgtaaagtggaccttaggatatacttataataaatttttataatttatatcttttttctatcacatcactagctatatctattttttcttctttttattctaatctttctcttaattaaaatgtacattttaatgtgtgagtaacactgtatatcaaattttaaaagcaaactaaaattatctttatcagcaaaataaaatttattaaacttgggtaaaggggtgccacaacttatgcacatagtatcatgtcattgccttcagtcctagtagattttattatattctctaaacatattttcattgtgggatggattcaatcatggatcaaccgttagtttatgttttcgtacttttcgtgtgagacattcttcgtatcataaaacaatttcctttattatcttcttaaactctgtcctttttaaaaacaaaaaaaaaatgtgttaaataactatttgtaagagatgaatagtatccctaaaaacataaagagatgagtagtaattgtaattacatataattataagaaaatgattgtactaataattaccttgagaacaatgattaagaaatcaacaaataaaaaaatagataagatgcagtagaaacattaatnnnnnnnnnnaaaaaaaaaaaaaacttatttcttaacaattactcaatctcaataatactgttaaatgtgcatatcaattgaaattagattgttttagtttagacagtgatattgagtttttttttatgcaagtgatattgagtctgtacataaggcttctaaaaataatactaaatgattaacaaaattgtattttactggtaaaatggaagtattattattaaatataatttcagggtattaaattaacaaaattgttgaattgagtgactccgtgttatgtcataaagcactaataatacatccattaatttttaatgaataaatttacgcctctagtttaatattaatgatgtactaatagtgttaggattgctatcaaggagagtctaaatatatcatctaaggaaataaaagtacaaagtttttcttgtaaaagatagcatttattatgtcaaaaattaatataaactagtctaattaatgcataatttgctaagtgatttaaaatctctaatatggtgtatttgttatttattacccactatccttaattagcaggacactacttaacaagaccgtaatagttcaaaattacatcgtagaaagtttaaagaataatggaagaaatcataaattatgttagaattgatgaaaatatgattaattagaacgaagcgaaataaagtttcaagttaattcatcatttggatttttttttaaaaaaatgaaatagaatgatgaatgatgaaatgaatttcatctcatttcatccaaccctcataaaagtatagtatatattactttttacttgtattcaatcgcaattctattcttttaaaattaaaaactcagacacaattatcatttctacgttgcattttttacaaacacgtctacctacttaattactcttgcagctagcttgttacttttaacttataagagtatcaacggaacatgattgcttaaatggattgtaacttgtaagtatccgcgttgaagatattacaaggtaactaattatacttcattaacttgccaaacaatagaatgaaaaaattatttcattatattataaaatagctataaaagtattgttttatttaatttattttactctgttatgtattatttttccccgctctattgatagttagatatatcttggcgaaacctcaaagagaagaggtgagccccataatgaagatggagagcgaatcatagctagttctacgtgtcaaaagaaaaagatgaagacaagctgatctatacttgaacaatatcgggtccgtaacttcgtacaatcatgtgaccataccatagtactgcttaagaagtgtatctggacatctcgtactcatagctcgtatgttctttccccaatagatttacgatcactatgatatatatgaatattcatatttttatatacctaacaaattattatttttctcaccattacgaaataattttggttagaagtggtaattaatttttgtagaaaacagtaaacacatataaataaatattttctttttaacattatttattttaaatttaaatatcaatcaagatttgaattctgaataacttaattaaaaaaaaagtcattattatgtcaactttattattagaagggacacaagttataataaattaaactcctatcaaaaaaacatgtatatctatctataaatcatattacctataaaatctatacttttttactttaatttttttctcactaagtgttcattacatactagatgtccatctataacttttcatttacataccccttcaatactaagtagatcctttgttgagtaatgcaactcctctaaaagaatctttttatgattttttataaataatgtcttaattttttacattatcaaataatattaaaaatcacataattttttttactaatgttactgattctgcaattgggtctagtgctaaggcccattaagggatcgtggtcgtaattttcggggacgttccacaactaaccaagaggtatatacaatataaataagagatggttacatagaaaaagttacacacattctcgttctctctctttttcattcacactgtgcacacatctcatcccactgagtattgtttcgtgcatagtgatcatcttctggaagtattttcttctatataaatacctcccactgagtattgtttcatgcatagtgatcatcttctgaaagcattttcttctatataaataccttaagaaataatttgatctaacatcgaattactagccgtccttgttggacactactgttgataaaacaacataacattggggatgcatttaggttgaccccttcccactcaacttattgatttgttttgcggaccaactaacatttataataataatcactttaaaaattatactaataataatttttaattagctaatattaaaatataaagaaacttttacgctgatgctacatctctattaaactttttttattcattcgtttaaaaaaaatgcgttttttaatttgtttagaagtcgctagtgcactttgcttttatgcctttcattttatctattcgagatcaatattcaattctaaacttgttctcattttcgttagattggagaatggatatatattttcgtcccaggagagataagagaaacacgcccccgctctcttttcttgcaaaattattcgtgggtaaagaaacttgcccctacccagtccactttttttcaaataaatattataataaccatattttaattcgaactatataaaagtatataataatattttctagaaattaaaaggtaggtttaaaagaatcaaatcatactactaatttaaatttgtaaggtgttattcaaatattattatagttagtgttatcaggtcaagtttaagttgagtcaggaattaattgaaaattatctgtattctcaaatttactttcgcacctccatttaaatttcggaagaaaaaaaatctatgataaattatacatgccctctaaaattcaataaattacacttagtattattttctttttcacattactttgagttttctttatctatataactgcttaaaatattaaggggtgtttgtgttaatgggaagggtatacatatgttgttatgttattatgtaaattgaggaaagtttgtgtgtggggcaaaaaacaaaaggatataccgagagaaattttaaacttcaagaggtgtgcttggatgaacctaaaatggataaattgttttttttaataaaaaacacattcgttatcacaaaaaggataatagtaatctcaccattaactactttaatttactttaatttaatagtaataaaaatattctgatgtatatggatcattggaattgctgatgtctgtggatcatttctgatgaactaaggtgcgcatgtctacaagggacgaactaagcacttgcaaaatgcttcatttctgatgtatgtggatcattggaattgctgttttcagggtctggttattatctgatttggtggtgtggaaatactctgctgatttttttattataagtttacatatatagtagattcttggtgggagggaaagaatacatcatgttttttttggagggagacagtagttatatgttttatattcttctatttttggtttcagagtatagttataattaagataagaggtgtataagctcctttcttagtgtgtaactatgactctgtcatgcatgttctttacttggtagttgttggtacttctggttccagttgatatatattatttgtctttgttggctgatataaataaataaaacttcaagggtgtgaggaaaaattgtccaaaaatctaatctcgaataggttaaacttagtttttttttaattaacgttgaggcgaaatagagtatagatgagctactcaaatttataatttttttatcatgtcaaagataaataattacaaagtaaagataaatttacagcatacctttttttttctcttttctataataaaatgtggtagcataatgtttttggaaaaaacacataaaattaaagagaagataaaatggtttaggaaatgacatattataaatgattcattaaaaccaactatgcttaaactatgaattttctttttcaagttatactcaagttataagattaactttcttaaacatgaaacaacatatttagattctattcacaaataacgtctcaataactcatacctttttttcacatgcaagcttattgtcatttgtcaaccttttcatacaagtttccgggttcttttaccattgtttctttctaattaagtttgaatggagatcggagatcgaaatacaagtctgacacgtctctcatgtagtgattggcattatctcgatgctttaccaacatcttggggttattcagaaaagaaaagaaaaagttgaactacttctattgtttagttaaatgcattttttgttccttgaatttttaacgttacaagtttgtnnnnnnnnnnnnnnnnnnnnnnnnnnnnnnnnnnnnnnnnnnnnnnncactaattttttttttaatatcatattaaaatttgtgtagggtattggaatattagaataattcttttctgttgtaactaccaactgtatttcgcattttctgttgtatctaccaactgtattttgcattttcagtttttagtaagcttctgttttcgtgattatgcagtagcttgctgactgatataaaaagattgtattcctctttttcgggtaataaagatgaataataaaatttcttcttccattatcagtttgtaagatggtatcagaagatattctcctctaaaatcctttgcttccgcgtttttctccttccttttccattcaacaatggcggcccaaacagcttttccagaaccaataacaaatcctgctaatcctctctaccttcatccaaacgaaaatccttctctaatccttatttctcctcccatgaatggcaagaactatcatacttgggttcgagctatgaaacaagcgttaatatcgaagaacaaatttgctctggtgaatgggagttttcctattccagattcttcagctccaaatttctatgattggcaaagatgcaatacaactgttctctcatggatccgctgctcgctcacagaatccattgcaagatcaatcctctctgttgaacgagcagatagagcatggcaagacttgaaagacagattctcagagtcagacatttttcgaatttcagatttgcttgaggaaatttatcatctacaacaaggtgatctttctgttggcgattattttacaaaattaaaaataatttgggatgaatatgacaatctagatccgataccttcctgtcactatgcatcttcttccttgttacgaaattccagagatagaaaccatgctgtgagatttttgaagggattaaatgacacttatgctgcagttagatcccaaatcatgcttcttgatccttttcccaatataaacaaagttttctcattagttattcagcaagaaagacaatttaatgttgatccaatgcttttatctacaactgaacctcgagcttatactcatagcactgatcatcgaaatagacaatttcaaggccgaggcaggggtcgaggtcgcaataccaagctgtgcacatattgtggtaggacaaaccacaccattgatacatgctttgtcaagaatggttttcctccaggatataaatcccaagttgatcaaaagaatgttaataatgttgattctcctgcaaataattcattgtctgactctgtatttctttcaaaagaagaatattctagcatcattgatttgcttaatcgatccaaggtgactgaaactggatcaacttcatctcacgcttctaatctggtacaagttaatgcctctgcttctactattgattctggaattcctggtaagtcaattgaatggattttggacactggagcaactgatcatatcacaaactctatacatcatttctcatccttttcaatcataaaacctgtttcaataaaattaccaaatgaatcacatgtgtttgcatatcattcaggcactataaatctttcaaaagatcttattttacataatgtcctttatgtaaaagaattccatgtcaatctcctttctgttccaaaattattaccttcttgccaacttatattttctggtttttcatgcaaaattatacaaatcaattctcaacggatgattggttcagctaaacttcaaaatggacttttcattcttcacgaatcattgatgcctcaagtcaatgcttgtcaagcctgtcccactactgattcaactttatggcatcttcgattaggacatatttcacaaaccactatgaaacaaatgtgtataaagtttcctttcttgtcttctcatcatataattccttgtgatacttgccattatgcaaaacaacacaaactgccatacacaaccagtaccacttccagttcatgtatttttgagcttttacatactgatatttggggtcctttcatgacttcctccattaatggtcacagatactttcttactgtagttgatgatttctctcgatttacctgggtcatattaatgaaaaccaaagctgaaacacgttcacatttacagaattttattcaatatgctgaaacacaattcaaaactcatgttcggatcattcgcagtgacaatggtccagagttttccatgacttctttctttaaatccaaaggtataattcatcaaacaacttgtgttgaatctccacaacaaaatggtgttgttgaacgaaaacatcaacacattctaaatgtcagcagagctttattttttcaggcaaacacaccacactctctctggtctttttcaattactcacgcagttcacttaataaatcgtctcacaactcctcttctttccaatcgcactccttatgaggttttacatggaactcttccttcacttgaccatttgaaagtttttgggtgtctctgttatgcaaacacattggtttctaannnnnnnnnntataaagatggcacaaaaggatatctccttctagatctcatttctcatagtattttcacatcccgaaatgttgttttctatgaaaaccaatttccgtttgccattagaccttcttcctcatcagatatttcaaataatattcaaaataatctttcatctcttgatcttgatttttctaataccaacccacaacctttatccaatacaccaaatttagatttcactactgaaaatcttgaaccaacagcaaacatatcagattctcctactcatattccagaaatacctgttaggagatcagctcgtactcgagttcctccaactcgattacatgattatgtttgcaattcttcaatcaaaataccttacccacttaactctgtgatgtcctttgctcattgctcaaaatcttacacacgtttttgtaattcaattacttcaaatgaggaaccaaaatcatacactgaagtagccaagcattcttgttggcaggaagcaatgcgtgttgagattgcagcccttgaacagaacaatacctggactatagttgatttacctccaaataaacaacccataggatgtaagtgggtttataaaattaaatatcgagctgatggtaccatagaacgctataaagcacgattagttgctaaaggttatacacaatttgagggagttgatttctttgatacattttctcctgttgccaaaatttctacaacccgtgtactgctttcagtagctgtttcacagggctggattcttgagcagcttgatatcaataatgcttttctacatggagaattagatgaagaaatatatatgatgcttcctccaggatctcgttctcgaaattccaaacaagtatgcaagcttcaaaaatctctatatggtctacgacaagcaagcagacaatggtactcaaaactatcacaagctcttctgtttttaggatataaacaatctaatgcagatcattctctatttgtaaagattactgcaacatcttccactgttttgttagtctatgttgatgacattttactagctggaaatgattctgttgaaatacagcatgttaaatcatgccttgattcccaattttgtattaaagatcttggtacattgcgatattttctgggtcttgaaatttctcgatccacaaaagggcttgttattaatcaacgaaaatatgctttggaacttatccatgatgttggtctcttaggtgctaaaccagcttccactcctatggaaccatcaacaaaactaaagtctgatacaggggttctttataatgatccttccaaatatagaagactaattggtcggctgctgtacttaaccataacacgaccagatatttgctttgtagttcaacaattgagtcaatttatgtccaaacctatggattctcacatgatagctgctactccggttcttagatatttaaagaaatctcctggacttggtctattttttagctctgccaactctatcattccatcaggtttttcagattcagactgggcttgttgtttggagaccagaagatctattacaggatattgtgtttttataggatcatcacttgttgcttggaaatcaaagaaacaaactactgtttctcgatcttcttcagaagctgaatatcgggcacttgctagccttacttgtgaattacaatggttgtcttttctttttaaagatctgggaatacctttatcacaacctatttctgtatactgtgataatcagtcagcgattcatcttgtccataatcccagctttcatgaaagaacaaaacatatagagatagattgtcatgtaattagagaaaggattcagactggtttgatccatttatttccagtctcatcctctacacagcttgcagatgttttaacaaaagccttgcaaccacatcaatttcaagatttcatttccaagttgagccttcttgatattcatgctccaacttgaggggggatattggaatattagaataattcttttctattgtaactaccaactgtatttcgcattttctgttgtatctaccaactgtatttcgcattttcagtttttagtaagcttctgttttcgtgattatgcagtaacttactgactgatataaaaagattgtattcctctttttcgggtaataaagatgaataataaaatttcttcttccattatcagtttgtaagatagggtcaattttaaaataagaaagagtgaatatttattttagtttaagatattcctccaaaatattttgatactttaaattcatgaatctttttctttacttctaacccattcacaagggatcacttgatttccatccgtattgttttaggataaaaatataataacatatatatctttaaagggaaaatttaatatatatatatatatatatatatatatataatattataaatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataataatatataaagtaaattatgattatttaacaaaaagtagataaacatttagaaaaacgtaagtaacaaaattatatttttatgacttttattatctttaaattttaaatgaacggtaaaatatatgtacaattttattcttttcatatttatcattaaatctttaaatatgagtaattaattatcacagttttaagaaataaaatagaaaatctctgctagataatacttagtttgcgggacctattagaacttaacaagcaaatttaatttcaacacgactgcaaaattctatttttgttttggtacttaattatcatacacctcctctttaagtgaatctatatatactaaactctgatttcgatcccttcttctgcgatgcatttataatttatcttatccagtgttgtgttgcgtgtttatatatatatatatatgctggcttccgttgatgtgtgctgtagagaaactagtacgggataaaaatgacataaaagtttagtagtttacatattctaccatagtagtttataagggtttatctaaaaaattcattatgattaacttcaatttctaaattttgaaataaatgcctggtatccgtagccacattaagttttattttacggaactaacaattaaaagcttttaaattaattccaccatatattcctgcgaagggacatttaccgaataccgacctagctcttggaactaatttagaagagttctgaaaagggttggagatcatgttctgtttcatatgaggagggaaaaacgtacccctatcaactagacatgttattacctttcctgccaaatcatgcgcttcttggattgcagttcttgataccttattttatggaaaattttggaaaccaacatgatggctgcaattcatgatatgccaaatcggtgctttgtcagaagcttacaatgaaagtaatgtgtggtctttgtgtaccaaaatcaattaaaataagaactattttagcttgaagaaataattaactttagccaaatatgttttctggcactagtagttaaacatgtgtataacgggttaatatcaaacgggaaaccgatatagaatcattttatatttaagtatatagccgaacttcagtcctcatatttgactctattcttattcatgatttagttcaattaaaaggatattcatattgctcattttgataagttttatttttagttccacgtgtattttttctgacaattttattcgaaactatctgatacactggatgtggatattctctctcaacaaagattctaaccttgcttcaatgaataagttaattgaaaagaaacatattttagcaactagctagagtatttattaaaaaataaaatgttaagtgttgtgattattttttttagtataatttatttttgacaaattttaaattggagatatttcaagtttctattaatactataaaataatttcgttggtataaaacattatatactatcaaatacaccaaatgctagtatgataaattatattatagggcttcaattacaaattgtttaatttttcaatagacaaaaggttatacaacaataaatctcattccattagataaggttatactaataaaagtagttctaatgcttgatagttatttatttattaataaataaatgaattttttgtgtgtgtagatatcataaattatgcctttgttataagtggaagaatgtgccaagaaataaatattgttcaatctcataggtttaaaaactatttttgtctaaaataattgttattttttatttatttattattaaaatacatgtttttttattttttccattttaatttttatgagtaatgatataattagcgagtagcaaagtatcattactttatatgtcacctcttattcttgacttataatctaccacatcattaaattcattctattagaggtatatattattcgttttgcctgacataagtctcatgattttttccttaaaatgcataatggattaagaggcaacatagcggaatggtaaccctccactggaggctaaagggagtgtgtgtctatagtttatgtgtgtgacctaaaccctctttttaatgttaaggctctaacttgaaatcgactacatatatcgttaaacttatcacatttaaggcattgtctattatgactcacatgtttcttacaatttagtttttaaaatacatctcaatagatcaaagaagaatgtttataaactaagaccttgactcctaatcgtcatgagactttttatatatattgaaatagttccaacctttgcatcatttgctcaacatattcaaggtattgtccacatttcaacgaatttaaggataagtgtgtctatagattatcattagttttaactcctaaacaacttgaaactttttttatatataccaaaacactggtttataaaataaaattaatgataacaactaaaaacatatattttaataagacacaaaaccacatttgctatattaattgcaccatcaataattttatatacaatgatgttattttataaatcaatctaatcattgaattttaattatatattactaaactatttctatcaaattttatcaaagttgaacaactataaatatgtaattacatttttttatttttatattctaaaagtaaatattacataattttttatgtatattagtacaatattaaacaagtttgaattaaaataaaatttataaatatgatacgaaatttcaattgatagtagattttgagataaaattattcaataatacaacatacaatttgtgtatgtgatattggcatgattaatattacacaaatattcatagattttcaaaagttaaggcaccttatcactctcctttgcagcacatgggtaagattcgattttacagatctcctaactcctaaatatgtgatagtggtagggaagtttcgtatgtgtatttaagtctaccctggacgctaaatctgacgagttgattatggatgcttaatgttagctttcattggattcaaagtaaaataatgaaatgttaaatatacacatcatctccatccataataattatttgattccaatccagtcctcttctgtgttctaaaactatccattaccgtatctccaatagtaccacatatatatgggtattggagtgctatgtcttaattcaacttcatcccccaaataaaagcatatgtccaacgaccaacactccacatttctttgaattttactacccaagaaaaatagaacgtgggttgggccattcttgcatttcatgcacttgatcgtacatcccagagagagagagattttttttttaaaacgataaggttaagaattagctggaacactgaacaaggtcccatgtggtatacatatatgatatatatatggacatgcatatatatatatactgatgaaccacttaccaatgttgttgttgtgttgaggaggggaggaacagtggaaatgaagtgaaccatgaacaatctgaattggggcatcgaatcgaagatggaaacatcatgggacccagcacactggtgcaccaacaataattaactatgattttattatgtgcatggagcaagatatatgtcaagactacttgggctcgttcgttcggggaaaactgtggtgtggtccaacgtaacaggaactactggctggtggaccatggaattgaccaatcaactggatattagcctcatacaaatatggctctggctctgctttgatgattgagactcccacgtttttttctctttcctctccttctttcttgaaagtgagagcgaaagattttctgtaacgagtgagaaactgtctttagtactatagattcttttgtgtattttactattaaattaaagagtctaattaattagtgttattagtcaaataattaagaaatttaaaagaaaaaatatttattatataaattataagaaaatacggaaagattatgaataacataattttttacttttcaataaaaaaattatactttgaatcctttaatcaatgttcttagatcattagttagtatttgtctaattaaataacctcaagaataaaatatgtttcagctagttaaagtataatgaaattgtgaaagatataatatgaacaataattaatagaatttaattaaaatattcttaaagtataaaagtttttaaacagccatatattcaattatatatttattctttacaataagaatttaattttattacactactatagtatataaaagaaaaaagttgctctatcttaaattgaactgagactcccttaaatccctaacattagagtgagtgtgcttgaacatgcggaaaaaaaggagtggtgggaagacgaagagatctatctatgacactagtaacctaagtgccaattaccacccaactagagtctcacatttcttccaactctaaggttcgatcaaaccaatcttaaaagatcgttgaacttagggcgtgatagagtccatgaagcagggaacaactcgtggccgatattatagtcaatggcaccacctatcatcatgattacaactataactgttttcatgagaattatgataaatacctaggtctttaattttttattattataattgtatatcatatttttagttgttgtaataatgattttttttacatatattatgatttcttatttttttatttatatatgttttttttaaatgtaatttacgtgacttcttaatttattttagcataatgtaatgaaaattaaattaaaaattatttaaaataatcatcaataattattaacaactaagtcatccgtaaaattcaaaaactaattatctaatgtgtgaaccaatgtaactcagttagtttgattaatttgatttgtttaattctaacttcaaataaagcgaaatcaaccctcaatacgcttttatatgtgcctttattttcaattaatttatactactgatactataattttattgtgttggctttttaaaccacatcaatcgctttatgacttttatcttaatatttttttactgtgcatatttttatgcgttaaaattaatgtaaatacaactttccttgtcaattcaacactcttgtcattagtcatagtggcccacgtggtgtggctttaatttgccaatctacccaaccgtcaaagacttattaacactctgtcctccacccgtggaagagaaggaactgtgatggtcaatgtcaaatcatttccaatacttttacaatcttataggctagagtaacgtcattacaaaagtcatgagaataaagccatttttatacttcaaatttacgtatgtataatcatactttacgtattatatttacgtattatttatcgaagacatcatattttcctttgcgaaagttacctccttaagatgttgaaactatataatgtgaaatgaatatacttatatagttatatacgtagtttatatgtgtatatatagtgggaaaaatcaccacacacggacatgaataaactctggatggaacttgtacaactttgcgtctttggtgcaaacaaggaatgtgataaagtcaatataaggcatattctaatttttacatttatctttcaaccgccattgcctctatagcttctttttagttttgaaattttttctctggatcgcaagtcgcaactagggaaggacgctagaagtggaagagcttttgtttctgtgttgggccacaataagtccttatgttgaatcagaccatcaaatcctcacatctggaatacatatattagcaattactatgcaactaccccatgtatagaattagaaacaatattaaagggaagacaactacgtacgtctttgttcttcgaaactagcacgcattttagcctaatttaggtcatgccgcactagactcgtccacgatctaaactattttgaatcccttaattaaatgagaaaatacacttatgatgtgcatgtgttttataaaaatagattaccatatatttttaagaaaaatggataattaaatatcagacaaataattacgggcattacatgcaagttaaagtttgtttgttcaagtttaaaaataagtgataggaggaaaattaatgttaagaaaagagattgaaacaagggatttgataattgaatttttttaattaatgtctaactagggtttaatttttattttaaatataaattcataattaaagatattattttacttcaaaatgaatcggtctaatgaaagaaaattaatcaaatgtaaaataaaaaattccagaatcctatggttaaaaaagaagaagaaagaaataggaaatgatgatgaatgaaagacaaagaaagttgaacaaatgagatggaggtagaactttgtagtatgtggtggggaccatggttggatgggtaagggaaaaagacgtagatgagtaaatagagttgaatgcgtgggtccattgcaaaatagcacatagggggtgtcagaaactctaccattttaaggcgaacaacatctgcatcaacataatagcacgtggaccttattccaaatttggcacttccctttaaacaagtcacgtcgtaattagcaagtgggctcacattataacttgtgctgtgtttctatacgaaaccccgtctctttcgttttaaatataataaaaattgtaagagtaaatatataagttgttctacaatggattgctacctattgataaaggaggaggactagtaaaaattggactaaaactaaatcgaacaaactttcgttctgcttctttttcctttgcgattgaaattattattttcagttttaactatgatttgtttaaaaaaaagaaaagaaaagttaagatcagctcgatggcattcctgagtacacgcctgtgctaacgcaagatgacagtgtatgaatcaaaagggactttttcacaaaaataagaaacaaataagataaaaaattatttacataaaagttgtaatataaaaataatgtatatgggtgatcttatttcttacattggttgtaattataattaatataaaaaattctttttacatcgatcatatttatcacttttttggttttatatgtgttaattaacatgtggacaaacacacttaattttataaaaaaattagattctagtttaaagttttttattataattatttattagtcctaaatgttttcttttttcttatttattttacaatcattaatattagttttctagttatcgtaattaagacggtgatttaggcttttctcattaactcaattgtaggattaattatgatttatgatttatgatattctttttttacctatgtattccttgtctaccaataatgtactgatgtacatggactgatggacatgcgaatattagttcaaattatttattccgttcatattggtgtctaagttcacatccatgccaatgagtctgatgaacatcttatcatatgttgagtatgagtatctcgactaattcaagcaaccaagtaaattttagtaatctttgcataaactggtaattctgtgatttgtctctcttacttatcatatgtcatatcctaaatattgggattctgttgcttctaatcatattgatggtatagcaatctctcattttttttttctcaaaattattacaacccaaaatttctcatcatatagctaaggtcacaattcaagcacgggtcaagccataaatctgtaatatatttacattttgttgtcttagtacccaatcctcctttcaatttactctcaatcaatcaactcattcacactcttgattatttttaatctttactaataagtcttttttttgtatacaggatcagggtatgagataaacgatttgcccaggatatgaatcaaatgggctttactatatattttcaaacttcattgtctattgattgcactgctgtaaaatctccaagcctcatgcatcatcatctaagtcatccaaatttgaataggtgaagcatatggtaatttctagtcatttcctttttatagcccttgaagtgagtctatatctgatcacttatatatttccatcagacaagcaacacttgtctattaaaaataaagatttaatgatagtcattttagatacatttcttgtttgattatcgcgaaagacttattttttttatttgcaaacaaaaaacatgaatataatttgttaaactcaggtatagatcgataggaggaagagggccatctttgtttaaaaaaatattttcttaatttttctcttgttttaaaagtaataaaatttgttttgactaataaatattccttgtgttccaacaacatggtagttttagagattttttttccttttaaaaggtttttccaagattttcatatataaaataaacccatggtggctactccggcatgtttcttaacttaaaaatgatttttttggtttttcatctcatcacaaaccctaccatcacaataacgagaggggacatatcaagtgagaataaaactttcattaggagaaaatgaaatgagtaaaatcttatccaagtgataaaatcataacgagttgagattaaatcacatagtcatgtgattactttttaaaatggtcatgtcatgatcttttatataattaaccatcatatccatgcatgatctatattgaatccaaatcatcttgaatgaacttcctactgagttatcacaaaacccatctataaaaaaaataaagatcgaaaaacatgtacagccagattttattgttaattctttaaataattgtccaagttaaaattactgtaaattatctaagatgattgcgactcacattatctcttatatatacgttacggaaaaaaaaaagatgataatcttaattagcctaaataatttacaagtttttcattaaatattttaaagatatgctagtagtagtctcaaaataagctttatacaagtacaactgtacaagctacttaaacaaaaagcacgtacgtgtgtataaaaacaaatgggatatatatacaagttattataacttgaaaatttttaatatcaatacctcatcagtgattcctgtttggtcatgatcattgtacctcgttgttattcaaactaataaaaaggactttgtgaaaggaggaacacgactgatgctgtactaccagttcacgatggaaaaacaaagttatgggtacttgaaaagttccaaccaccacacacgagaaaagcagagtttgaaaagcgactgcatatagccccactcaatgagctccattattatgttgataacagcggaccccaacatatataaaagattaaattttaccaattttgtcttgaggtctttcatggttagaagctctgatttgtatataaatcctgcaccaaagtctgcccaatgcaaaatatcttgtacatcatgtttcatagtgcatgctagtgatgactgatgagagaggtacacatccaagtgcttcaattatcaaacttggatatggattcaaatcctttaattattgcaaattaattactctgttgttggcatgccacaaaagtaggtgaggctctagagcagattaaattcaagtacacttggtagagagatgagactttaattaaacttgagactaccttagttggagaatataaatatactgggccaatgatcatttttaggtgttcattgaggttaaagcgttaaacaaatttgttcaatttcagggatgaaattattaacaccataattaaagaaattattgaagagcaaggaatgtcattgacccatcagcaatgttacaaattaacatatatcagttaactggtttgaaagaattacagttttgttagcctatcacatgttacgtcagatacaatttcaatttgtctactttctactgcagccataaccgtaaagtgattccaattttcactaagctggttgaaagtgatgactaaaataaatgcgcttctattgccacatttctaaatggctacttccaaaaatatattgaaagagcagcagaaatttatcagtgttaattgatcaattgactaataaaatcccttactttttacttttaagtttttaatgtgagtaaataaaattagagaaaaagagttatatattgattcaatcacaattatcttatgtaaatttattaacttttacaacacattaattattttaaaagttatattaacaatgaatcatgattagatgacaatgtaaaaaatattttacattatcaatgcatgcatgatcattaaattcataaaattattcttgatttttcagaaactaatttctttaaattgtaaaataatgttttgaaacttaacttgataaagaaaatcctattgataattgaaagtaagttttatcaataacaaacgtttctcttcacataaaattcctttcataaatcatctaagttggtgttgatttttcattttttttaaaagatcgatgttaattatcaatatgttagttttgttaatagaagagattaaaatccatgattttttccttgatttttttaatcaccaaattaatcttataattttatttgggattaatatttaatacacaaagacaagaaggtgatttaattggtatggaaagcgaaggatgatatatgtgaggtgacaacatttatttatgtatggaggtttattacataacacatgcaagccgtatgtgtatgtcacatgcattatatgaaagtcactctcaacttgcctgtaactaagagaaaacaaagggttcaaaccccaacacataaagaaattggcgtgcaacggagaaaagtgccacaataatgctgtgtgaatccaaaactccattatggtcctcactctaccactaccaccaacaatacaatggatcttcgaatacaacaaggaaccctatttaactctagactatagattggaatatacaagcttttgtaatcctctctctctcactcactgtcgtaagtacgatgtttattcctaaagagtactcatgcgggaaaaaaaaattagggatggttaatatcataaacattaaaactactgttacatcagttttatttcatgattttataaaatagttattaattgagtgaatttaatagaataaaatatcaatttagttccttttttagtaaatattattatcagtcgttttgaatcatgatattttcttacgaaaaaacaaaatttagtcactaatttaaataatcgtcatttaatttagactctaaaattgacattacggcttgtcttattttaattgttcatgtaaatatttaaatggattttaatttataaatttacatgcacaatttaaacttgtattagttgtataaaattaatcaaacaaaagtcattctttttactttaatttatatagacatgccattgtaaaaaaaaatactgtgaattaattagaaataatccttaatatgactttataataaatatcataaaaatcaataaaattattgaaatttgaaccaaagagttcatatatcgaaaattccattagtgagttaaacaaaagccactttaaacgtcttaggtgacttttttttatgattttatgagtatataaaattaaattggcattctgtaaataaagtaataattaaaataatcttatcattacttgttacttttgtaattgatcctgatagacggttggattaattatttttgtttttttttcagttataattgtttattgattatgtgtaagaatgaggagttgagtttatacccactcaagaatttctcttcagatttgtcactgtccctataaacaaccatcttaagttggcagatagctgaatttttttaagtatattattaggagtttgatttttaattatgtgaatgaaaaatattttgttgaaaaagataaactttattttagtgatttatgtttaaaaataattagtaataataataataataataataatatatacctattaataaagacaattatctcattttatatacacatttgttatttttgatttactcttcaattaatttttaaaatcatccataattacaagtagtttttgtatactaacttttcaatagtacagttgttataattacatataagtaaaaaaaagataattaagacacggagtgtttgtttttcagtagtaataataatctatacctattaataaatacaattatctcattttgtgtacatatttattattcctaatttatcctttaactactcttaaaaaccatctaaaatgacaaatagttagtttttcaacacaacagttattacaactacatctaactaaaaaaagataattaaggtatgaagtgcctgtttttttaactaataataataataataataataataataataataataataataataaaggcttcatatgcttttgatgatggggttgttaatggatgctccatgcacatggaattttcatgaatattattctgttgcacttttctccatccatttatgaggtggtgaggtacttgacaaagacagcatctatggcatgcgccagatcaatggatggagataaattgcaaagttagagcgtgttgccaaaatttcttaattatgataaattttacctgcaatttatgcatggctgaaggaggatagtttgattgccagccacgaaaatagtagacatgacttccctctatatcctcgattcaccatattgaatcacatgcgttacatggttgcttgacttatcaacatgtgaaacctatcaatccttgttgcaatccacaaaatttttcacatgtcaaaattagaggatttttttttgtgtacttgtaaaaaaaaattctggggtacataattagagttgctaaagacttaaagtcactttaactcgtcaccacacattacacatgggttgatttacttttttatatatatatgagaggactctttttcatgtgaaaatgagaatgaaaagaataaataattgctattaaaatttgttatgaacagctaaaatttaaaaaaaaaaagtttttcaattttttaaaaagaactatattatgttttcgttcttttattttgaagagaattatttaatgcttattttgacctaagcaaaacttatccttttttttcttccttgaaacagaaaaagaattaattttttttatccataagaagttcaagttagatttgaaaagttatgggttggctcaataaaggggggatccggattgatttattgaattaaacagggtaaaacaattcattgtcatctaataccaattatcatatataataagtttatttattttacaataaatatcttaaaaatcatttcaacgataaattataattatgttaatataaaattagtttacaatgcttaatatataatcattaaactcattattctaagtcatataaaagatgtaataggcatatgaatctcagggaaaaagaatgaaccatttataattcataaccattttacggaaaaagattaaagaatgaacattttactgccagcacctgggctaaaaaaattaaatgattaaatcttctgggtattataagtacataacatccggaagttggaatatttgtggcatcatataacccatatcaaaagttaattgcacctatcttccttgaaaggttcccctgcctcatttgagttgggaaggcttaaatgattgccttaggatccgatactccaccatgattcatgagtgtcatttttatactgtacagtttcatcgcataattatgctacaatacttcccatttcacgcctacctgaattaacagggttacatgcaagtgtttggctaaaagatgaaaagtatactacaaagaatatctagttgtgccgtattttcaaccagactttcaggataatacatgactcgaattccaactcctgcctccaaactgctttggaagctacatttaagattttaccacattgtctctctctgcaaatccatgactagaggcaccaacgtgtgacacctatatgaaatttaaaatgtgcaaaatgttcgttagtttatcaacatatattttaatgaatgcaaacatatattatttcgatttacaaaaataagtagcatattttttcagcttcgaatacaaccagaaggaaacagaacaagaaaggtactgaaaacaatgtggaaaaagaagacagaaggctcaaaagtcaacctgagaaaggccccagcaccagtcttctgcaataactaaattacttaggttgaagaatccttctgcattaaaaaaataataatgatgaagaataaataattaaatatcacgttatgtgagtaagcagagagcagattacaaggtattcaggtcagcaaagtcagcatcagcaaaaaataaatatcacgttagtgatactatttactgtattataagggtccacctatatgttgcacgtactgtggtatgttggaattacatactccaaaaccgttagaaactttgactaaccaaggggtattgcagaactcttggggataataacaattgcatttatccaccgatattgactatctccctcttttaatagtggaaattgttataatttgatattaaacatatccttcagttcaggtttagtgtgttgaaaggcaagaataaaagagaaaagttgtcttccaaccaggacacgtgtctatctggattgctatatgcattgctacatctacttttgtgtatataatcttgccattcttcattaaacatcgaaaagattaggtgggggactttgcagtttgcaatttattatctatccaggatatgccagtagcttattatgattcttgtattatattttaatgcaagactgctttcactgtcgtcatgattaattgataacttgatgtatcgttttcagttttcacattcatactaataagaaatgtataatcacaatacaggcgacaagtagtaggcttatatcagattacacttgtcgactgtattatgaagagagagaaaaaaaaaatgtattcaacaaagacattgcatcatatcagctgtaattaacaagtatttggtttgaatcacaatttgtaaactgtaggctacctttggctttaatatcttttgactgtcactgaagtattgatttggatggttaatccctgcatcacacggcatgccatgaagagcttcaaatgtcaaggtgcaagccaactgctcaaacgttatccatataatcagatatcaaatccaaaggttgaaaattgattattgaagttcagcgggttgtgctaagacctacctgataatgtctatttctcactttgtccatcacatcttccatcgctcggctgtttacccccattctgctgagagcagctcttagattctcttcactattaaattcaaatagcgtcaattaaatgtcatatcccaatgtccgtacaaaataaataaaatactgtccagtaaggaatccgaacagaataagcatttccaacaataattaaaaattagtaaattataacccccttcaactttgtcagatgtgcagcttactccctgtggttcgatctacccctcacaactatgcatgcatatcaagatcaaagaacatgaccaagaatagagccaagctttatgctatgcccaaattacaactaaaatattcattacattaacagagtacagacatacgaaagtcattatttctaaaacagtgtagtacgttgaatttagagagggagagaaggatgaagaaagaacagagttttggagagaatacagaatatgaatgctttcttatttaagagagctgtagtgcataggttatgcaagtgatccacaaagacacacacagacacggacagagggagactcctaatagatgcagtggggattattactaagctgatattgatttagtgcaacgtcctagacactaatacccataaacaattagcattttaacatgagatacaagatattacatgaaaatactatttcttaagtgcattatcattttcaacataaaattactaaatatatcattcaagcacttgtttgctgcctacaaactacgaagtaaaaatttgtaagcataatacaggggtttaaattgctcttgaatcaattcactattaggttcgtcaatgacaaaaatttgttattacaatgattgagttattaataataataatcccgaaaatgtatttagcagaaacagaatgcaaataaggtgtagcatgcttacgtgctttagtttatagtaaaaccataacttactcatcagcaaagagagataaataaatattgtagtacagtcaagagaaacaaataatctgagagaaaatcaaatatagattaataaaatataatactatagttgcacttgcaacgccatagacaaaagtctcctacagaatactgtgtccacaaactgcaattaataacacacttgcctaattacagaccttaatatcagttatactcttaatatataactaattactagttattttctatgaataactgccattaggcagtttcctactaccactatgctcctaataaagaatttttactaattattttctatttacaactctcacgcagcagttactcctgccgtttcctattgctgtctgctagtgtacatcttccaaatgggtggcttgcctggtttgcgaaccgaggatttgcctggttcccatcacaatttcactacagatcatagtctttagaaagcaagacttgtgacaccaaaaggcagagttataattttattaaagcatttatcaagtaaaatatactcgacaataacttatctatttcacatctccaatacagaaagcaaaactatccatttgatagcacgagtattaagagtgacctgaaatgtcgataggggcaaccatgatgatctccagctccaggagttgatgaaataatcttttgacaagaatagggagtataatcctgtaacatccatcaaaacattacttgttgaaactcatcatcatatacatgcattatgcatacaaaaacattgaaagtttgtgtttcaaaaaggaaatcagcaacagaaatatatttgaaacatcccataaatcggtggggaaattcaaaacttacagttctcttcccttcctttccataattatggcgtatgttgtatgcatattgtttctcaaacttctccaaaccaacctacaacgagatcttacatttaattaattgatgtaattttttaaaagaaagaaaaaatctattcaaagaccatataaagatgtctagagagatatggaatacattgtctagaccaggtatacatcttcagaatgatttaaaagtattatgaaataatgtgcaaaaattatcagagtctaaaactgttgaaattctaattcactattcatgtagctgaaaatatataatttcgaatacttccatcgtagatcatgtgcaagaagtgtgcttacctttttagagaactctgacctccaaaatgcaagtgcatcatccagatttaagccaacaccctatttacattatcgagaaaagaacaaaagataagagaataaagaagacaaaaggaggaaaatagataaacagtaatcaagaagtaaacggatgaagaagacatctcatcgattttctcatcaatcacaaaaataaatcagaataaaagtgaaccaaaatgtattactttgacttatttctaacccagcataatcatacaaccataaacccgtgttctttaattgtgccagtttacccagacgaaatgagtcaaagtgtcgaaggctgacataaatttcagactcagggtatcataaatttatgggtataaaaaacacaaatttcaattttctccacttatatcttgttaattacttgaaactaaaaaaagtaacttgaatgtcacgataattccagacaatcattttcctttctccaaaccatgtgtaaataaaccacatgtgaagtgtcaagcctcatttaacacctcaaacttataagcatctagactctacagagtatttttatcatgcccagatggaagccaaacgcaaccttcagaaagaagcctagttgcatccgccctccatgctttaaatgattatcctctttcagctgcataaaaagtggtataaatcaagacgtcagacaaaactgaaatacaatataaggactcaatatgaaaaagataaaagataagtaaaaagaaagatattacagatgaatcaagcaggaagaaacacatgagcataatttttcccaatctctaaccttatcaaataggtgacgcatgcacaaaggaaatgagctcttggcaacttgatctatgtcctttaatgatatatcagcatattctcttgactgcagaggttttcaatcaaaatgaacattgtcaatcctcaaataaatacctaataacagaaataaaaatgaaagaatatactatttgaattacctgagaataatcaggacccagataacttgaggacagagcttccacaatctacatagaaagctagtcaacttttataacaaagaaaggatatattgatatacaagaccaaaacccacacgtacaggagtcaacctatgtttctcttgctctctaattgaagatgtccattttctgcaacaattagatgaatctctaagcatcttaaatcccaaattgcatttaaagaaagaaatcaattttgcatgtgagaaaatttattgagatccaaatgaccaataaaacctgtttgtaaggataagtgcctttgacagctgactgcggaatagtgtggctacaagtgaaacaatctatgaaggaggcaaagttgaaacacaaacaagatttactataaccaatactctgcgattcattgcaagaataaatagtaagtaattacactagtcaacctgattcattgcaacatatgcatatccttgatttataaacactttccgtccagcaacaagctctggaacttcttcaaacggtacctatatggaaataaaagaaaaaatatacaaatgttgcaacccaaaaactgagggagaatgttagagatgtcttctctcacaactagaggtcgtgagagaagacatctctgtttatcactccctctctcacacaaaaacaagcttttgaaaaaaaaataccaaaggataattaattactatttcctaacagttttttttatagattcaaatatttttaactagttaactgctttcttttccttttttgtgaacaaggaagaatcattagaattcaatatttaaaacagtcaccgagttaatatttaaagtagaactgcatgtcacccggtgcatggatctctcttgcaagacaataaataagtacgaaaaagaagattgaacacataccttgtagaagatagcatcagctgcaaaaaaaaaagtaaatgaagccaagcaaaacataggcacgttagatttggaaaagtaataaaaaccaggaaataaaacttgaagaaaaaaaatgaggcataaatttcaaaaactgtagattttttcttgtataatagtagtgcaaatataccacttgaaaaacttccctagatatctttcttcagaaattaacccatgcaactgctagctcactagtggatttacaattacatactaaacaaaatctaaaaaaagatgcgccttcgctcttaggtagcaacagctagttatattcctattcattcaacaacctccagcatggtgcatgcaaatcatttctgctgattcataccaatatgctaaataatcattgcaaaaagaaaaagcaatgtgctcctaccagtaggtgaaggctgacccatagaacgtgcaacttgtcccaatttctcttttatgctctgaaaatccaaaacatcatttctttaggtactaagaggtatttgtaactcagaacaaaattagttttgcacaaatcaacttcatggtaaaattcagattcaagagtccagagcaaaccaataaaacaaatgatgtgactacctcaaattccacattgctaacagccctgtaaggaaggtcaaattcttccatgactgccctctgtgcactcataaacaaagtatatgatgaataagtacttaacttcaaatgcaaaaacaatatagagtaaccagattttacctgagcttcagcattcagaagacgaaaacggtagcgaaagagtgcagattccatggaaagaaaccatttcctcaagtcctccctgggaatacaggcatatattatgtaattttagtatatatggaataatttagaaatatttcttacaacagttttcttattaatttgtctttttcctttctttgatctgggtaaagcatcattcaggattaatacacttacacaaccataaaatatgatcaatatacgtaattggtgccaatggtcttaaactctcatcattaccaatttattcaatttgtagtaatcttccatttattttgatcaggcattattagtcacacaaccgaggattcttttcaatggcatggaacaacagtaaaagagaatgcacaaaagagagagaagataagagctcttacgttctgcaatacaccagacgtagaacaaaatgagatataatatccttgttcagaacctgagttgcgtcttgatgtctcatattcactttccacaggtcctttacctgtacaaggggtgattcacatggaaaagtccaccacacagcattatttcttttttgtcaaccacaagacatgaactaataaattaatattgtcaaatcgagctttttaccaaattctccatttcttccgctttttttccccgcgacataccatcagaaatccccttgagaactgcaacaagcaataatatccatgaaaaacagaccacaaaacttgaaaaatgtccgatgtcaacggaagttaaagaaacacatgcaaacacacacgatttcatactaatttaatatatttaaaataaaataaaaaaacaaatcgcttgcagatttcaggctttcacttcaacatgacactagtttcttaaatctaggatatatgtgtggagcagcggacacagttaaaagcagagcagattatcgaaacactaggcacgaacagagaggaaatttgaaacagatctctggaattggaagaagcggaaaacagtgaaagtatagagatgaagaaaacagacctcggaggcgatcgatggcgaaggactcgaaatcctcgagcctgacttcaagtgggggagcagagcgatagaggagaatggtgggagcagaaacggcttcgttggaggaggacaacaagtttctgcgactctgaggacgaacgatctccatcgctttctttcttctctctgcaacactcccaatcgactgtagactagagtgagcgtgcgagttgcttccctcccaggttctgaatccgcgccaaattatttggccctggggcacaaaatggcgggaaactatttacttttatttgggtaaatgcaatttagttcatttagtttatattcgcttataatttccttctttttatgaaattacatatttagtctataaatgtcagtggtcacgataatttagttcattaaaatcattctttttatgtttacaattatagcctacatgataaagcaaatatataacatatgggactaaattgtcatgaaaattaaaaagtgtaaaacatcacaaaaaccatccctcattcctctcttcttgttgtcgcaatgcacaccattctaggcaccggttgcgcttcctctaatggccacttgcgagagtatagaggtttgccacgcgaccaaaacacgatgtcatccccaccacccaagacctagaatacaaacacgacgcacatccttcccaatgtcgattgcacttctatcgggtgttcacttgcgaatacaatgttgtagacatattttggaacattgcattgacatgtgtttagacatattttggatatatttttggaaaattctattatgtcagtgacactgtggcatgttttggtgtcttttgttttcttggtaatgtacaatcatggtagaaattttactactacttgggaacttgagtatgttatgtgtaatgaataacaattttatgttctatgaatgctcattttagctttgtggactatgtgcatgttatattatttcatggatgattctactactgagtgcatattattagttattttgtggactagtttgttagttaataatatttgttagagattaattttttagtaagtatatatgttttggtggaaattttttagaaggagagttcatttatatgtggtcattatgtttgttaatttgaaaatcaatacattaagaaaaaatgataatttaatccaaaatgaggtagaaagttactgtacacattgtacttgtcacgtggatgaatgtgagacatgtaggctatgtttgttagcagaaacacaaggattttaacggtttagccaaattgtcatggcctttgacatttgtggactaaatagataattttcataatacagagacaaaattgtgagcaagtgtaaagtatggggactaaattggtcgtatactttttttattattttttaggcgtgctggataatggagtgattaatgttgaaaatagaaaaaatcataagttggttatattatatttacggtaataaatagaaatttgttaaaaatattgtaattatttattaaattttatagttttaaaaaaataaaaattatatggatattttattaacatttgtttatacttaagtttatacttaaggattgaattttctctctctaaataataagaactgaattattctactttattgacttttgcttgaacttgcaatactgatgtgttttaacatttaaatttagtttttacaatgaagtatcttgattagtataattgtgtagagtaattgtatatactatttgaatagttttagttttaactttgaaactgttttcaaaagagaatcttacaataaaatatttttaaggcttaactattttttaatctctaataaatattcgatttttatatttgtttttaataattttttattttatgtaaagtctctaataaaataataattttatttttttttttatcacttgtttttagtctataataaattaatgaattttatttttaatcttgataattttttattattatttgtcattagtcgggattaaaacaaaatctattattctattagaaaatataaaatttgttaatttatcctagattaaaaaaattatcaaaaataaaaaataaaaatattattttattagagactcaacgcaaaataaaaaatcattaaaaataaataaatatatatatatttattagagataaaagtatatttaatttttttttaaacattccggaatagtattgaaaaaattcacatagccgcataacgaacacccgtccacgtaacgagacacccaactccgtcatccctaattgcaagagcagaaataacatcatactatcacctgcttaaattttagctatatcaatcagtcgtctttttctttttttagtgtaattagttgggtcaacaaagcaagaaacacacaattaagtatcttgcaatggtataattaagatcagttaggcgccgtttgtgcggtgtatctcccattgattaattttcttctccagggactccccccacaaaaagatagaacaaaaaacaacatccgacattgcgaataaagtgagtagaaatttgtgcatgccaagcattcctcagccacagtgacgacgccatatatattccaagtggaacctaatattcaaatcgtatcgtgtttactaaggtataaataactccacaaaatggtatgacgttatatattgcaagtggaacacctaataataggcaaaatggtataacattaaaatcattcatatatatattgcactttaatgtcagaccgttgtttcgggccaaaaacttggatagtgttttatgttgaaattttagaatcgaatatcaccgctattactgatttgaatctctcacagtggccatcatattttttcctgtaactaatgcaactcttttttgttacatttaactaatgtaattaactttgcatctagcaatttgataatccaattcagaatcaaatcaaaatctgggttggatggttaatggaaaaaggaagtgaaaaagagttatggattcgatcacctctactaacaaaactaacattgcaactaacatttttcgatataaaaaaaaaaaaaaattacattgcaaaaattaaaaaggtgaaagaatataagattctctccaatacttgaagccatctcgctgaccctttcagaatatttattcaactataaatacactcctttcatgccatttggttagcaagtctcagcaagcatcttagtgaaccttgcttgagttgctattgcttttcctaaactatgggaacttgatatcagtatatatgttgaccaacatgttgaaatctttgcggaaaagcctaagccttcaacagaaatgtctccagcacaagaaccaagttgataacgctgagtcagtgcatggtgcaaacctggcaaattgcattttttgcgtggaggaaactaaacaatggaagtgtgaccaaaacaaaattgaggatacaaagagtgcagaagggggcaccaatttagatacacagcatgactctgaagtcaattgttctttcactcatgctgtcatcaatgtggtcgggatggtaaagtttgcactgttgcttacgtaccatttgaacgaacatatatgaatgtgcccttttagtctttttagctagttactttcaattatatcatattattgaataaattagcatgttcaatctccatttggccattacatttgctaaggattgaaaaattgcatggaagtatgaaactgaaatcatattatatttttagaatcacaaataaagcctacatttatttcagtcaacctttgagcatcatataatataagtcttatttcaaatttcaaatataaccactaggtgaagataagtaacatgagattcccctacagactacttatatacacgagagaactctttcaatgatgctcatggcaagattatcatttttttttctttaatctaacagaaacttctataatcacccactaattgaaaattaagaataataaaggatctagtgacatcataattaattgtaatcgctcagtattgaaaagtcaaaaccgaatcgcagcatatataggaaaaacaccttaagtatactttagcacatataatctgacactgtaaataattagttggaagttttgtatgtttactccaatatactattcgatccctatatatacacacatgcattcgtacacacacatttatttatttaacatatggtataatatcttgcaggtctggggcaattatcaactccatatgctctagacaaggagggtggacatctgcttttttgcttataggactcggtgtgatatgtgcatatagttctcatttacttgggaaatgactagaaaagaacaccaagttaagaagttacgtggacattgagggtcatgcatttggtgcaaaaaggaagattcatagctacaactttcatctacatggagatcttcatggcccttgtttcctacaccatctcattgcatgacaacttgaattcaatcttctcagggatgcatctgaagctgcaattggcaaaactatctaaatcatagctcctgatcattggtgcagtgttgattgctctgcctagtttgtggctcagagatctctcttccatatctttcctttccaactggtggcattctcatgtcccttgtcaattttgtgtcagtagcatccactccaatttttggacgtgttcaagttaatcataagatacccctcctccacctccacaacattccttcaatttctggcctttacatcttcagatgatgacacattgtataaagccatgaaagacccctcaaagtttaccaaggtaaataatatatattatatgagtttaatgttgatgaatatttttacattattaactaatttaaaaataactttttttatatgacttttaaagtaaaagtttattaaaattcattgatttttttttaatgtatggtaaattttttaacatttatagtaattacctttaaaaaatcatgttaataataatttcttattgcaagaaaattaaattctttgaagtatttgttttttgttaaccctttaaagtaattagtacaaaagttaaaaaaaaaaaatcaattatattaccatctatgattgactaacaaaattaaattcatatgatgtatgcatagacagtatagttgttcatcaattgcttaagaataggatgagaaaaaaaatcaacgagtgagattatgcttaaaaaatgaaaagattaatgagatgtttttattaattattatttttctaatttttcaatttgggaattcaggtatctatagggagcttcacattagttacattactttacacgaccttgggtttcatgggtggcaatatgtttgggccggatgtcaattctgaggtaaccctcagcatgccaccaaagctttttgtaacaaagattgctctgtgggcaaccgtggtgacgcctataaccaaatatgccctggaatttgcacctttcgctattcagttggagaaaaggcttcccaagtttaacagtgacaggacaaaaatgataattaggggcagtgtgggttcatttttgctttggttatactatcccttgctctttcagttttgagcatgtattcagcctcactgtttctctactaagtgttgcaatttgtttgattttcccatgtgctttctacataaagatttgttggggtcaaatattttggcctctctttgtcctaaacctctctgtcatcacatgtgggtttcttcttgggtcatgggcaccatttcctcctcaaaattgctagtgaaacattttctacaagctcaatctgcttgaggcaattggaatgattcagcacatgtatactagtatactaggataaggatgtatgaaaaattgtcataaaaaaaggggaaatcactatacttgtttggtgggtactgcgtagtattacatactttgtacctttagacaggtaatatgtagccgttgttttttttttttttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgattcagcacatgtatactagtatactaggataaggatgtatgaaaaattgtcataaaaaaggggaaatcactatacttgtttggtgggtactgagtagtataacctactttgtacctttagacaggtaatatgtagccgttggtttcttttttttttttttatcattgtataatgtctttgatattgtcaataaaattcaattataaatagatatattagaagggttaaaataaaattattattttattaaaaaattgtcaaaaaaatatattagagactccaaacaaaatttactaatagaaatttaaatcatatttaagccaaaagttaatttcaaaagattaaaaaactaaaaggttgaaaatattataattcaacaaaggcataattgcaaaatcagaatattaataaaaaaaggaaatgttaaattagaaggatttaaaaatttaaaattttgaataagtgtcacgtgaattaccataaatgaaaatttataaaatatatagagataggtgaatttaatttttatgtatttttattgtaaatttttttgtactaataatcaataaaaaattatgatttactgatttttatgataactattnattaccataaatgaatttttataaaatatatagagataggtgaatttaatttttatgtattcttattgtaaatttttttgtactaataatcaataacaaattatgatttactgatttttatgataactattctaaaaatcaatacaaatataatatgttaatttataatcgtttgacaatataaaaattctttttagtttcatataccattgttgtccttatattgtttattttttttataagactccttttaaattatttattacattaattattttttgacaaaaatatccttaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgtagtcaataaacaataaatgttataagagtaattttgaaaaataatacaaattatttataaatttaatattattaactaaattaatcaactttcttaacaagttaaaagaggcattaatcgtagtaaatttttatttttacctttgtcaacgcgcaagtgaatttaaatcaactgaatgaacttattgtggacactaattattaattagtaattttgatttgttgacttataactttctttttctggtcaaagacttgtaacatttaaaagttaaaactgtcgtactaaacaatgtagatgatgtataaaaataatggagatctgagtttatttgttgtattgaccttctccacctttagttgtggttccctaccaactttattccaaccgtttttcgttaccttcgttttcaggcccacattcaccgtgtcacactgttcccttatcttaaattcaactactagtaattgcttacacataataaacctctgaattgtaacttgtaaggctcaatttcattggcaagaggcatatagaattatcctcaaagaatagccaagaggtcttattttggcaccacttggaagtgctaccaatagagtttgagacaccactgtgtctgtgattttgaggttgacaatgtctgctgctgtgtctgcaaccaaggattttcccttcaatgctcatttggaggaagatatcaaaaacaaaggaagcaacaaggttgttggggaagcagaccagcttccttacaatgatgatgctgaaggaactgattcagaggcagaggaagaccccaagttggaattggatcttggtcctcagttttccctcaaggaacagcttgagaaagataaagtaacattctttttttcaaatgtttcttcactgccctgccattctttgtatttgtttgttatgtttccaactgttctatgatgaaagggattcaacaatttaacaatttttcttttgtttctcaaaggatgatgagagtttgagaaaatggaaggagcaacttctgggaggtattgatatgtctgctgttggaggtacttgttttccttccattttgtttttcttctggaacaactctatcaaagtatcaatgattattaattaagtggagatgacgtgacataaatagtgcatcagtattgaaaactcttcttgaagattgtcctcttcatccaatttaatttctttgttcatataaagcagcattctcctggttttcgtttacaagatatccctttttttcactcacttgaatcacctttttttggagatgacaaattttgatgaaaaatgttggtctaggatgattttaatcctacctcttgttttaagcatatttgaatcattaagtttgatttcagctccttattatttttgagtcctaaataacctaaaggcaaaagcccttgtattgtacttcagaaaacaaggagccagaagtgaagatagtgagcctcaccataatatgtccagggaggcctgacctcattctgccaattccatttacttctgaatctaagaagagtatcttcacccttaaggaaggaagtcaataccgcttgaaattctccttcactgtctccaacaacattgtttctggcctcaaatacaccaatgttgtttggaaaactgggcttagaggtgagacataaaaccccttttatgttttagattagttaaacatccgtatcttgatcgaattgtcttagttacatgtggctttcatgaatttattgaaatagtagacaacacaaaaaagatgttgggaacttatagcccaagccaggaaccatatacatatgaattggaagaagaaactaccccttcggggttgtttgctaggggaacctattcagcaagaaccaaggtaagaatattaatttacatcatacaatatttattcactgtttgtaataccctccgttctaaaataattgttttctaggttattttatacagatccaaaaaaattaataaacaaataaaagagcataacaattttacaaaacttatcttaatataacattacattgaaaaactaatctgatacttattaggagtattaatggaaaaataattaatattacgttaaaaagtcaaacgtgatatttattttggaacggataaaatgttagtattgttgcattttttagtaggaagaactaactattttttttttgtttcagtttgtagatgatgatcgcaaatgctatttggatactagttaccactttgaaattcagaagaattggcctacacccatctaagattcaatattaactaatttattggtggattttcttcctttgtcatgtatctttctgggggagattgcaatccaactttttgtttattaatctagatagtcaattgttgacatgcatgctacatgatggtgttaatcctctccttctattctatggttccttttctccaatctaataactataattcacataaaaggaaacgctagctcgtgaaaatcgcactcattccacctatgatgcttcaaagagttaattgttattatctgttaagggtgtgaggtgtgaagggatgggggtggaaatggaccccatgtggataaaggaacagaaatcaacaaatatcctcaactactgtttgtgctttctcaagcaaatagccaaaaggtccatcaattctttgatggtccagaagcttttgtcatatgacgaccacatgctgtttgctaacggtggaaatccgaaaaatataaaagaagggaaaagcaaaatttccattaaaataatttattaagaagattgaggccatgaaccaaaattttaatatactgtaaaaggtatcatttataaacattttgaagctgcctttgggcttaaatttgatattctgagttcttcagtaatttgttaatctttgatttgtccaaattatatgtgtgatttcaatataactcttgtttaaaacatttattttaaaatttaagtaaaccaaaaaaaattgtcgactatcgtgtatctgttacttgagttgttttggtgtcaagtaatagttttaatagtattttattctccaccaactctaattctagaactaaacccgtaagttatttctaactaaaaaaaaaaaatattgacctnnnnnnnnnnnnnnnnnnnnnnnnnnnnnnnnnnnnnnnnnnnnnnnnnnnnnnnnnaaatattgacctctatattctgaaatcaaatattgtacgcattttgttagcattgtttacattgtgtttgctagttaggaaatcaaggagaaaattttattgtatttggttaaaaaaattgtagagaaagaaagaagaaatgaagaaactaaaacctcccttattttgtctcctctgttacattagagatttaaaggagaagaaaagtaatttataatttttaaacagtacatattaaattgtcctgtgatattattttatctctgatatcatttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggattgaacaatcaacttttcaattttcattctctattcttggtagttgatgttagtttgtttcacttttcacttttgttgtgtacaatttatatcatatatcaattctcagcctgatgagagttaagagctttttttgtttatctatttatttacagaaaaaaattaaccttaaatatcataatatttacaacaaattctcctcgtatatattatttagctaaccaagctaagcctcttaagagtttaattgataatataaaggagagagaaattttgaaactcaaaaattcaattttcaattcatattcttttttcttgtagtattattttctttcatccaaataaaatatcttaattttaagttataagtgaggtgcaaagaacaataaatttagatgagaagaaaaaattaggaaaaatatatagtaataatttattttcttttattaattgaaaagaaaagaacaaatattttaaaaatatatatcctttcatttatctttcaattgaatttttctctctgttttcattttctttctatgaaacatactgcagaaggttattctgaaaggatcatcgaaagtcaatttatttcagttttgccggcaccaagattttcactcttagcacatttgtcttaaattcttgaataataatttgacaaaattatatttttagtttccaaatttttgaatgtttatagttttggtccttaaattttttgattattagtcaaaattttgaagaaaaaaattacaatatcccaaattcgaatatatttttcaaaacctatcttcttctccatcaccgagaagaacaatccagcgaccctaacttaatttttctttttcttttttgcaacctttcctctttcatttcactgaacaacacgttgaatccaattttaatcaattttatttcagtgcccaaattaagcacaacagaatcccaaaacataaagaataatagaggttagggtccctgaagcttcgagtggttgtacgaggcaacaggtgcgcctatggtggcagcgacaccaagcgaaggagatccagggattcgatgggtttgacatattgcgaattgggtagctataggaagtgcaaaaattatatctttttggagtaagatttcgtgggtggttttcgcaattcaaagggaaaacagtgttgcaaatgtagggattggtgagaaggggtttacaagcaaatgttgtgaagatagagattcaccgtctagtttgtgggcgtggtgttggtgggagttgcggctgggttgagggggtagaggagggcacaaaggggtgaagcatatctggaaaatgaaacccagaaaaaatgaggacataaatttagtttgataagatttttactcctttgtatgcataatgtggttgcaattgatttgtttgaatgtggatcacaaattggaatgtaaaagaggcatgatgattcacggctacgttgttcaatcaatatttacatctttagttttataccaaaatcaattaatttgtagccactaaaaatctttaaaaattaaaaacataataaattgataataaaattaaacgtcccatcaaaatcattggatgtaaataaagtttgaagactttgattgattataaaaatttaaggattaaaatcataaatgttaaaaattgaaaaattaaaaatataatttatcctcaaaattttaatctcaggtgatagatggaaatcaaaatttacacttataatattaatatgcaagatggtaatattacttaccagtggtcacacccgagtttggtcaaaagacaaaaaaaaaaaatagtgaaaatactttaattcaggtgcaagtaactcgagtatattctcgctgaccaaacgagacatacgttaaggttagttagcacttgaagtgttacacgatgcgttgatacccctcttcgcatagcactcctattacagaaatgtttagtgtgaaaccgtgcatgcatcatgcctatataggcatgtttggattctctccaaacttgacttgaaaattatgtttagttgtagttaaattatgttctttaaaacatgtttggttaggagtaaaaaaaagtacaacttttcggagagaattttatattaatgtagacttcttattgagattaaattttcaaacatgtattaccttactttaaaacataattttaactaaaactaattttaacataatcaaaaccattcaaaatcaagtttaaaaactcgtcctaacaaacaccaatgtgtcctaccttctacatgtgccatttttttctatcctgcaaagtgtgaaagcctgcctctttattttttattccgtctccacttgctcctctcttgtagatcacaatttggtcaatggtcattatggtacaggtagccatttttagcgaaaaattatttaaaaaataataaaagcaatggttttgaccattttgttgtcaattgagtcctccaatggtgtttccgttgttaactttttctgctcatttgctgtacactagtcttgttggtcattaaagtttagacccaacgcaattagtggacaccccatcaaagattcctttctttccaagtaaagttgcataatttactattataattatcacaataggaaacaacccttgcaggaattacagttgctacttatcaatacacgaaatataggagattggaatacattttgaggttagtgatcgtttagataggtaaaacattgatcgttaatataatttttaaaataattatcataaaaattaataaatttatcatttatgataaaattattattgaatgacagtatcaatttataacttttttttcattgattttatctactaatatcacaatgatccgtaacattacacaattatctatccaaatttaattataataatcaattaggggcatgtaaaatgaagtataatnnnnnnnnnnnnnnnnnnnnnnnnnnnnnnnnnnnnnnnnnnnnnnnnnnnnntttttttttttttttacttgaaaaaaataacaatatgaagaaagctatacattagcaagagcatgtaatagatatggtcaccattttccatctttccactgtatcctttacctcctctttcttttccttaaaatgattgccaatgcattgattttcaggtggcaaatgtcaagttaaagacatacagaaactgtcctaaactcctaaccctacagatacactattcctgtgcacaaagaaagttggtttgataatattttatggtttaaacacaagtcagttatctgtgtcttttgatctagtgcaacccgcagccaatgcatgcaaacctgtcccaattgactaaacgtaaaatcaccgatataaatttactgctcaagtcacgtaatatactgtttagctccctttcatcgtaagtgataagcctgacagactatacacataggcattgtattaagagatgagagcacgaaagaaactaattttgatcatacaaccaaatatcatacaatcaaaatgaatgaccaagatcaaatttaggaaaataatcttcactattcatatatgtttggatatctaatattaactgctctcatctcttatgttagcatattacatgaaggatcagtgcctgagaagaactaacattgaccatataattaaaatggaaggtcaatttagtattttagttaactaaataattaagataatgtttggtttgatattttttttttttcattttcaaagaaaatagaaaacaaaagtggcaatacctttatttaaaagttaaaaaaaaattgaaaatattttaaaaaataagtccaaaattgaaacaacaaattagcattttttgaaaaagtgaaaacacagtggtaccttaaaatactttcttcaagttttctaaatctttaaaatttgaaaatgaaaattattttcaaaaaatattaaaaaaattatattcactcaaatcaagtgtcacctaaagtatcttaatatcaaaagacttaacatctcttattatcaacttatcaacgactctcataatataacgtttcacacggtgacacttcacttaacatttttgttcatcagactcttcagtaagtaaccattttccagacctcaacaaccagctctgacatcacttaactggtctcaagatagattacaaatacaagactttttagcgagttttatccttactcagacactttttgatttttttttaaaagatcattcatatcataactaattcaaatcaagtacacttagttatgacattcttaggtgataaattatcaaaaagtaaatacatcttgtttttatagataatatcaattaatatctttaaatcattttcaattgcacaatattatacctacacatcatctagatctcattcttgtgtgatttatctagagtattacactcctcactatgcaaaagtatgggaaatttagagaaatgagaaagtatcattatatgcaactttaatgcttgcatatgtacatcaaccgttttagaattcaaacctatcaattacctagacacaactttccagttgtcctaggacttggcatcacccatattaaatttaaaaaaagtataacataatcttgaccatatatatgtataattatacagtcaacgttaatttttctaagccactaaatatgttccctacacacatcctagtgtcttgatacaaaagatttgcaagcgccccatttatatatttgcaaatatatggtttaatttgtgttttcttttttccattttccccataacttattcacgatgatgatttaaatactcaacatttaaatgtatccagaattaacagaattgtcaaattttaattttctattgcccgatgtgaacagccactcattttgtatactgtcctgtacacagcctgtagaaagaatatatacaagtgatcaatggtttcgaaaccattttaagcaacacatgacaaccaatataccatgaatagaatgaacggtaacctgaaatcaccaataatctaacaatgcaaacttcacttgtaatccaatcttaccaccatcagtcactagcttagcagctgttaccaaccaatggccaggagcatcatgtgggcctcgcacaacctcagctgtctccacatatttaagtagtttaccggcacgaactggcacaggtggaccatctggataaactccagagttaagtgcagttggagtctgttttggaggaccagtgttaccgtgctgtgtgaatgaaaatgttgtgctcaaatttgtgagaaaagatgattttcttgaagcctctggtgcagcagtccactctgacttccggatactgcaattgggaatatgagcaaagagaagccgcagatgaagcacattccttggccagctccctttgctaaggagttgtgcacctgttacaatataaacacctccagaattattcaaccagttagggtcatgcttaaccactgctgtgcacacatttgagaatctcttccatctgattcgttccagaaattgatcactggattcattatcatcagatcctcgccacatcgatggtgtacttgaggttgaggttcctgaagagaggatcattttatttgggaggcttgaaacatgatttatatgtaaagcaagtctgtcacatttcctgccctccaagtacatgcgcatgccaaccacaggtttttgttcacttaccacctgacattttgtacaaaataccataattaacaagagaatattgtgtgaacttaagaataagggatcaataattcaagatcgttgagaggagaaaataaaatcagcgaaaatccctaaaaagctatgcagcacatagaatgaagaaaacagataaataactcataggtggccaggagctcgcataaggtcacatgagctcactgctcacattttatgacctgttcgaattgagtgtatttccgagttctgtccaaaagaatcacatcccaaaattattagaggtgagcagaagcttacacaaggtcctgaagctgctgatccactataagcattgttacatgtgttttctccttaactaaacaaaacgcgagaaaattttgaaattgtttcttaaagtcaatttttctcttttttctctccatttcctcttttaaccaaataaagaaaatgcatagttaactatgttatctcttaaccaaacatacactaaaaaatgatctcgtcttaatctttgtccaattaccctttgctacagtttcataataatgctcataagcttaatacctctatagctgggagaattctttctatgacccttgttcaattacccttatgtatggtttcatagtatgactcacaagcttaattgctctttagttagaaaaatttagtaatatctcgcttgttcttataaatagtaatactgttcctccttaaatgtagcatcttcttagacctcattatcttgctaaacaactttgtgaaccaggttataatccttttctcccccaaacagcaaccaaactattcatgtgccttccctagtagcttgagctttgagaatagtcagttgactcagttcataacagggaaattttttggtccaactactttacaattgtccatcctctttaatgtttcttttaccctaaactacagcttactaccaaaaaaaaaaccaataaaattgtaagtatagcataactgcagacaaaatgctatagatagttaaatccaacacaattggcatgcaaaaataacctaggggcttaaaacttcgtagtgttttcaagaatttccttacatatttctcacgacaatttgttcgaaaatatgtaagatatatttagattatcttagaatatctttcttgatatgttcctataggttctatagttctagtgttattatttgtaggcttgggctaatactagtaggactagtaccttacctaattagctattcagataggattattaagttaaagtaataccagattttgtttgagtttggtgtctatgattggaagaatgcaagtcttgtaggcttgggctaatactagtaggactagtacttgacctaattagctattcagataggattattaagttaaagtaatactagattttgtttgagtttggtgtctatgattggaagaatgccagtattttcaaggatacttttagatgtcacctatttcatttttgttttgtggtgcaattttagaagggtttctttattgtgcaattttagaagggtttctttattgcatataaagagattatatcttttctttgctcaatgtatttgggttttcttgttaattcctttcatttgttattattttgtgatttcttttaggaggatatcttatcctcgtctctagtatttctttcataatctataatgaaatttctcttgggggggggggacaataaaacagtgtttctcacaacgagttatctttcggtctgaaaacatcccacaccttgttcaacccctgaatcctaatcctaacttgatgccatttatttcagactccttcctattctctgacaatacatatgaaataaggtgtacaagaaaactcaagggtagcagactaacaggtaaagtaactgattaaagaattaggcaggttaaagaataacaaattttttaccccagctaaatttgtaacataacagaagtgagtaacgggaaaatcctgacactaattaagcaaaaactttctcaaggaaaatattaaactcaaatgtaagagtaaagtctaacacatacaatacttgctcaaacacaaagagtttggttaacagtacctgtgtagagattatatgaagctttggacccatgaaactaaattgcagggaaggggaagcagtctttctattctgatgcctgagaggcagctcacaaaacatgggtgcccattgccttggaatttgaaactccagaaagtattgtaaatctccgggagaaggcttatctgcagagagtaagtaaatcaatggagtgttgtgcacctcaacagtaaagaaattaaacagtggtctgtgcaagaagcgatggcttggaaacttcatgtaaagaaaagcaaaacatacaagaacaatctaagagnnnnnnnnnnnnnnnnnnnnnnnnnnnnnnnnnnnnnnnnnnnnnnnnnnnnnnnnnnnnnnncttcaacttcacactacatacggcttatgccttaaagttcaaaagacatacaagattccccaggtttcctaacacatgtgaaacatctttggtctggattttatggttgcatgacaggcatatgacatctttgttaaattttggatggatgcatccatcaagaggagcattcaattgaccatcttgcttgtttatgtttaaggaataaactgtggacataaagttgaagggtgtaacttgaactcttcctcttccctaatttttatttcggagtttatctacaccatggtgaaaatatataaatagtaatagacataaaatggattaggataaatgtagtagattatagtatcattgtttaatcagattagaacatacagcgtagatacagattgattgcatgactaagatatccacttccaggaattccagtcagaagtgaggaaataggaacaaacttgaagaggattgcttcagggttagacggcactgtctgaagccaatttgagtgactgtgcttgaacatatctcctcctctttttgagcaaataatagtgaggccctgttccaagataaagcaatatattcacaacctagaaaaattatttatttcaaatgaaaattatttccctttcagggcttacatccttgcttgatgtttctgaaatactagtgaattgcattgtgtttgattgcatcacacggttaaagacctcagggacctacatgaatagagccattgcatcagcagaaaaataataaataccttaaagttacaaaagatagcactataccttctgttttccatctactgtcttcctctgtagtaaagaagggcttctgacatctgagaataaaaaatctccaagatcctctaaatgtcttctgagatcaccaggaggaatctttgaagaatgtttttgtttgacacagattacatcttgacctcctacagccatacccactattatgtgtgtaccatatgtctggatgaacctgcctaacaaaattgattagcatcatatacttatcaacccaaaattatgcaccattcaaactgtcaaaataagttactgcatcaaacagttcacccacaaaacattcaaacatgaacacacaaactaacatcaactaataaaagttaattcaagcttcatgcgaaggtaagaagatattaaatcctttaatcaaccagttcatggctaccaaacatactagattttgcagggatggtcataaccataagtgcacaaaaagctagcaacaaattgaatctatcaaattcaatcccattataatctgtctatctaccaggaaacgaaactatttttacaccaacaaattgaagttataaagctaaaagaagctattttaacatgaggaaaacaaagataccataatctgtctatctaccagattgttgtatcagcttagtgtttacctagacaacgaagccggatcccactgagccggaacagacttcttaacctcctcttgcagtatgagtggagaagcagtgaggtgcaaatagtagagtgaaatgaaatacccatcaaaagcaaggtacttggtgtcagcagcatcacgaaaccaatccccactcaaatcaaagagcgcattaaaatagccagaaggaactttcccttgcactgctgatttctgattaagcaactcagacatctgcagcaaggagaaaaacgcagagtttaccaaaaatgcaacacaaacaaacagatcttaattcaaaaacgaaatcctcctaactcatctacagtaacagataaagaaggaggaggagaaaagggacctggttgaattcaagtacatcagacttgaagcgtattctatcccctttatcacaacgaatattctcagaaaccccttcaatggtaacacctccagttccaggaatcaaaatatccctcttgttctgttcatcaagcaccaccaacctctctccacgaattccctttgcgaaccgcaaccgaaaatcgctggccaaatcgaacccttttcctaaagactccaatgccaccatctcaacaaccttttccgccgccatcttcacaacgcaaattcagttcagggattccaaaaaagaaaccccagagagagaaagagagagggagaaagagaaaaggtgttggctttggttaaggttaggacggtgccaaccaaccccaattgaaatgggttagctatgtcatgtggggtgtgggccaaaacagaaaagaagttggctttggtggttttgcggaaatgggtattgttagatgtggattgaaggttcggggaagaagatgggatcagtgaacgttacgcagcttttaatgagggaagataaaaaagagtactttggtttggttgtttggaagagaagagaggcaatagctaaaatagctattgctcctatgtaatgcaagtgtaacgggttgaatgtaattgttggagtttgactgtgtcagtgatattattgtgaaaaaggtaattggatggggaaagaataatttttatatctatctgcgtgtgtggatcagtgttagaaaagaatgggcatcgctctgtcaattaagataatcttgtatttaagtatataatttcgggttaaaaaaaaaactgaagattatgatgttttttttttttattattttggccgttactttactctcttctctctcaatggactttacctactacatcagttgctctcccataacaacaagatgctgatgcaacgtaagggaaaaggggcccgtctcacatttttctagtttcttcgtctgtctggtcaaggacaccggacccttttttctgtgccaatccggaaaatgagttttatacaaatctatatgatgttcccaacgcaacagccacgttttcttaactatgatttacattacttatatgtttataactttatcagtactactaatatcttcctcccatcaaatataaatagtatcataaaattaacaaaattaagagagagaaaaatagaagacaagaagaaaaaaaagttacaaattcaatttttcctactaccaaaattgataaaaagaatagtactatctctgatgctaaatactataagaaacaattacgtagtttgtcaagataaataaaagtaatttaattaattaattttatcaagttttaattttatgataaaaataatcatgaaattttataaattagatggttatttttcaaattcaacaaataaatatgttttattttgtgatagcttttataaagagattcgttcatatcattaatagacctaacaaattaggagtaaaaagaaaatttagcaataaaatatatctatatttttataattagaaccaagaaaatatcttttattttttatatatataaccagagataataaatactagtaccatctaaattggaacaattttgcattaattaatttaagcattcaatggtattatataaatttataaatgaaactatagttttcttaaataatattctttcggttccaaaataattatcattttaatttttaatatagtatttgttctggttctttccagaacacaaatgtataacactgaagtgctatggagttgctgtttgatcactctaactctgcagcttcaaggatatcaatggaaggtgataccttggggcaggagatcacagagatacaccaattgacgtggggtgtgtgctctgtgtaattgaaagagagagatagaatgtgtgtgtgtacctttcaccaggaattactgtgtatttataaacagaatacctcgtaacgggcattagaactgcttcctggattcccggcctcatccagcatgttctcaaagttcagtatggaccaagtcagcctccacgttctatgggtaagttatttgcacgattattcataacaattggacccaggcccaaactataacgtctacgtaatctgaacacgacaaccataacagttgccccccaacccggttatcaagtatacttggtagccgggatgcatcaggtgattagctaccttcagggtaaccattaatccgactacaattagtcggcttcttccgggtagaatactattcggataatcctccgtccgcaatactccgagtaacttatccggctacgttcatccggatacaattcttcgatcgttttggagacgtattcccatgactatgctttgttctgtccactcttggaggcatatgactgtccggatagaaaaacatctccgactagacttttatggatacacgtatccggattctgctgaatgtaactgcatttgaccacatcccaataattgtggtcggatttgccctggacgagtaatgtacccagattgtttataacatatttgaaacggctattgaccttcctgattcgaatcagttacttttcctgcccttaatggcaataaatgtctttaaaggatctgtcacttcatttgcctggtaatgattaccattgtcgtaactttactcccttgccctcataattggacgtgcttttaccatgatacccctatgtgtcgtttcattgtggtgactgaaccgtttccctgcgcctggtggttactgcaagttatcatcacatttcaaattttattttcaaaaccccgtaatcgtgcctacttttttccgtgcttgccacttctgcttatttcctcatattacttcctctcttctcttccattaacctttcaagcatcctctcgtattttctgcaagttcccccttcgttcttctcccaatcatcctttaattcctcattaccgcaggtatcttctttctcctttctttctgtatcatttggtgtttttgcattaccgtgactctgtcagcatcaggatttttagggttgcatcatattttctttctgactttttcttggtttatgggttttccttcgcgttttgtaatcatatcattctccttttcttcgattctcctttgattttccttaacttgccctaagaatgacccctgaagaggaggcagagataaggaaaaagtttggccctagggccgcttggttattgtttggccttccattttcggcgggggaaaacgaaagtgacccccttcgccgtcatactggaggttcttcctcctccggaaaacaaaagaccgccgccgaccatggcggtttagcccctttatttcccccgcctcctccgattcctgtaaaccttaaaccaaggacattgggcccatccttaggtccagcctcttctagaactttatcttctttggactcttcgattcttgggcccaaaattgatactggtagtccacgaggtctctctctaggattcttttgccatcaccctatccctccagttggcctttctccatcttatgatgaggaatcatcttcatcctcggttgaagcaatggaggttgattatgatgcctgtatggattgtgtgtccgaggccattcattatgttcaaataggctccgacgatattgctgattcgattcttagttcatgtcgtcataaccctattttgcgtcctgctttcaagggtttgcaaccaggatcgcatactcattctgttgtcgacggggtttcggccttagtgtcttgtgaatttgatgcgttgtctccaggtatgtttactaacttttatttcccctcttcattttcgtaggtataatgggtgttacttcggaaaccgtggacgaatctgcctctgtagaatcctattcagatgtgcccccagcattagcgtctaagttcccttgggtcacttatgaaattcttcgaacttcttctgtcctcgaccttcctagtatagtgtcgacttcagtagggaagcaagatgggttcgcccttcaagctcccctgcccggtgagcccatttgcgctcaacgggagggtaataaccccaacttcttcttcttttttcaagatgtcataacacaaataggtattacctttcctttttcctcttttgaaatcgaagttttaaatcatctacgggtagctccttcccagctccatccaaatagctgggggtttattcgtacttttgaattattttgtacggatttagggatcccctgcaccgttcctctcttcttttattatttctctccacatacccctagaacgggcaaagaaccttctgaccgaaaagggtggatttcctttcgtagtcagagtaaacggaaactcttcgatcccttttcggactccttccgtggcttcaaggacaaatacttcaaagttgccaccgaacctcatcggcgaccctttttcttgtccggtcctgagtcgtccgatgtagaatgggtttttcccttgtactggtcggatgatcattacaagcaggatcattccaactatcgatttatcctagaggatctttccgactcggatgcctcttctgtcttcgtgatttctgagtttataagcgctcatggtcagcctaaaacttccgactacattggcgttggtcgtcgaaatggtctgctttggtgactacattatctcatggtttatcactgcatttgtattaattatgatgttttctgattgtagccggaatgggatcccgacctcctcctaaagccaaggccgacgtcgcccatatttccaaaccaactgaagtgaagggcaaaggcaagaggccgacgaccgacaaacttagcgctccgtccaaaaaacgtggtgcgcctccttacagggcgttttttgacgaaggtgctcaaaaggcggcgtcagctactccggttgctccactgccttcctcctcggcaaccttgaccccggtttcggtggtcgaaactgtggatcttaccgtggcggatggccgcccacgtactacccccgctgctggctccgagcaccttgaggtgcgggttcgtcggataatgtatggaaaaaaggggttactgaagagttggttcgtttgaccaaacccccttcatatatgctcaagccgggtgccccggtggatgaagaactggccgagctggtccggatcgaggagaatgtctttcgctgtgcttctcttgttcgagcacttaccactgttcgggagaagtatgcatcttccttgtgacatttttaactctacttatactttgtatatatttctaagtgttaatgtcgcaggtacgggtttgcggtggcggaaaaggacaaagctttggaggagaaggacaaagcctgtgaggaacttgtttcctttaaggctcaacttgctaccctccaaacgcagtcggcggcggagcttaagcttttgcgggaggaattacttaagtcccaagccgtttctgcctccctgcgggtagatttggcgcggtgtcaaggctcccttgaagctgccgaccagaaggtggccctcctgacttcttcccttgattctgccaaggccgacaaagaagcctgcgtccaggattacgaaggtcggctagctgctatgaaagcaacccttcgtgatgctgccgaggatggcttcaataacgcccttgagcagattactttcttgaacccccgggtagggatgactactgccgggatgcatttcttggcttatgtcgaggacggtcaactgtttcctcctcctgcagctgaagatccttcggtagtggcgtcagaacctttgacaaccgaagaaccaacctccgttgctcctgtcgtcacttctgttgccgaccccacatccattcccgatccatctcagccgactcccgattccgttccttcaaaggattagggaggcggacattattgttttatctttgtatttcttttctttgttgggcctggtgcccggaacaaatatttatttagtgattattcaagttttttacttgattcataaaatatcttgtgcgcgcatcttttggttccaacgaccatttatttattttatttattgcttgtcgtttgtctgaccgtgaacaactacgctaaaggaggcttccattatccggcctgatcggggccgtttagcgtatcattcacagtcatcgtactacaaaaccgcataaaatgattcaatatcgtggtaattcatagtacttgcatttatattcgttgttacaataacaatatgtgtgtccgaatatgatcagactaacacttagaaattacaacgatataatttatttgatacgatgacatgctcagaaggtaggcttccgagttcgtatttattaacaacgtcttcatcgtgaaagaggaccatatgggctcggatatgtgtattccggacccataccctcaataacgaggttgccttcttctactgcctcatgtaccttcgatgaacagggaccatacggactcggatgcaacattttccgaatccatacccctattaaaaggaaggtcgagactttaactgtagtatttcttcaatttgtcggcattccatgttcgcttgactggtttgccttgtagcgtttccaacatatatgcccctttgcctaattttttaatgacccggtatgggccctcccagttggctgctaactttccatcccgagcgtttttatttccgatgtcagcacgtcggagtaccaaatcggtctcttcaaactgtcgcgggaccaccttcttattgtaagcgtgcgccatctgttgtttcatttttaattcccgggcatgggccgttatccggacctcttcaataagttccgactccaatgccaaaacttcgttgtttgcttcctctccgtctcgtagcatttgactccgtcgccatgactgttgtccgacttcgactgggatcatagcttcatttccataagtcatccggaatggagtttccccggttgacgactggacagaggttcggatcccccataagacataatatagttgttccgtccaggtcgacccgacgtcgtacattcgcttccgtaaagcctttaggattgccttgtttgcggcctccgcttgaccgttggattgagggtgttctactgacgcaaaacggtgtcgtatctggaaactagccatcatctcttgaaattgtttgtccgtgaactgagtgccgttgtcagtaactacttctccggggattccaaatcgagagattatattcctctcgaaaaaattttgcactcgggccgaagtgattgtagccaaggggggctgcctcaatccatttggtataataatctatggcgactatcagccacttcatctgtccttccgccggcttgaatggacccaaaaggtccataccccatttataaaacggccatggagccgaaatggattgcaattcttccggcggggataatacccttgaagcgtgcatctgacaattttcacatgaccttacatgcttggcagcatccgtacccatcgtcggccagtaatatccagctcgaagtgctttccttgtcagtgctcttccccccatgtgttgcccgttaataccttcatgtatttcagacaggatatatcctactcgatccggggccacacataccaacaaagggttgtgcagtccttttctgtacagctccccgtcgatgatcgtgaacatggtcgatgttcgtatcaaacgccgagcttctagctcgtcgtctggtaatgtccccttgttgtgtacttacggcaagtgcaccgatcgttaacaagtaataaagtaggtaagtgagttatcgtctccacagggattagggtaatttttacaataatattaattctaaatgattggaaaataaaacagaaaataagagataattgttgaattgatttgttgtttgaatagaaatagaaaataaatgcagtaaaaatataaaagaagttaccaatggaagaaacaattgtggtcaggcacaatcccctttgttcctacctccttcacttgattggtttattatcgtaagtcacacacatgataaatctttcctaaattcgtaaatcctagaactactatagtcataaccagcgatttaaccctttaattcgatcgagaaacctaaacccttagtgaatctgtcaaactaagtattcaaagaatatatctcatgtgatcttgttaagattattcggagaataagcctttcctaagttagttaatccctaattccttagtgaattaaccctttaacccaattcaaaagaccaattccttggtgaattctattaagttaagcatgaaaaagaacatattataaaatccgtagccatgcatccctatgtctaggcgaagaacaactattattctaaacaggtcagaaattagaaccccaacgtgtccattgcgaatcctaaccctcaatacttaaatagaatagccaattccaaataagaataaaacattgaatagcacagagtagaataaaataatcaaaacagcattagaatcaatatcaattcaagttacagaggagttacatcagttcatggccttcccacaatacaagttcagcctgccataggcttcaagaaaccaaaggctgtcaaataatacattcttggtgaccttgccttgattcttgacttccaatggtgaaaatatgagaaagagagagtgatggaaggggttgatagatggtagagagattgtgatttggatgcttcctagaggcctttatttatagataaatctaattagggtaacaaggcctattttcttgttccaaatctgaatcaaatcttcttaattaaggaaactaaatatatttatagaatcctttaattaaggcaactaatcctaatatagtaccaaatctgaaaatatataatttaaataaggaaacaatttcaacctcacgcgacccgcgcgcgatctcgcgctagtcgtgtggaatggccgaaagaatggcgcttgtcgcgtgggacatggcgcttgtcgcgcggcttggcagaagagaatacccttaatccttgaggtactggcgcgactagcgtggaacaccgcgcgagtagcgtggaactccagattttgttttcttcttttgcttgcctttattctcctcttttaagccctgaaatgcataattggtattgacattagataaaatgaaataatattaataaactagctaaaattaatctaaatcctaattatttaatcaaaacataacctaaaactatcctaaaactaagatgtgtttgcaacacatcaaataattcccagatttattagttgctgtcctcagcaacagacagaactctaagataaaaacaaggatcaacaatcaaacctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattctcaacagatgcaagcataattagatcagaaggtctttgaggcttgtaacttggctgggctaacggtaggaaaatctttggatagtagctaatatgaggctagatccagtcctttaagtccaatcctgtagtcttccattttccttgttcatcttcttcacaatctggtactttattcaacatttattccttataataaataaaacaaaacaaacaataactttctttttgatttttcttttcttttcactatacagcaactttcaaacttttcagcttatagtttcaggcataatatttctgaactggcctgctgcttatttcttctttttccttcataccaattgaattcactttgttttccttgatgccttgatgaacacttccctgttctctgctgtcatgaacttaaattaccttctctagcctcagggaggttggttaatggacatagctctgatttaggtaacagaattgaaaggttaataaagctcaaaattaggtgcaaatggaataataattgaaggtaagtcaatttggccctggttttaagaagaagaaagtgtcttaatcatgtcaatttatacctgcatccagagaaacaattcaagttctagagtactaagaaaatggaatctctcaagaagaaaaataattactgtttggctcaaaagtctcacaggtatttcactcaagtcaatcactattgacttcatttcaagcaacatttcaacttcaacatgcatatcatataccaacaatcaaaatccaatcatgtatcatgcaattcatgctatatttcatttcacacaagcttttatcagagaattcctatccattactgtgttcattcactttttagtctgaaaatttttgatgtgctgcaacttttattgaaataattaactaagaatttaaaataatgactaaaataattaaaacacaaattttctgttgggcatcctttgtgatttaacaaataatgcatatacgaccattcccagatttagaaaattgttgtcctcagcaacaagtgaagtggattaaaacattcaaatcatgtatgcattatttgataaactcaactagcactgagtattagtccaaacataacttatttaaaaccgctaactaacaaaacagttaaactaaaagcatactgaaaattaaaattaaaatagttaaaacaaataagaggttccagtgttgtccttttgctgcagtatgtaacaataattccttactctcttcatcctacagtgcagaaaaattccaatttatacctggtgcagtgggtgaattcccagatttattccattatttgtagctcaaaataaccaccaaatcatgaaactgtgcattagtgaataataatcaaacaaatactagcacagttgttaaaaacaacaattatgtatgtaagtggttgggaatttaaactgctcagaatttcgcagtgctcacaattcccagatttatttcattccatagtttcacataatcagctgtttattattggggttacgatttgtaatggtaataatcagtttataacaaccccaaacaggtctcagacacctgaaattttaacatcaaacacataagccaagctacaaatatcagagaacaatttagcatatagcaaagcttacaaatgtggattcccatatttaaatgcaaacatattataattagaactaggaaccacacgagaattcacatataccatgaatatgcctagcaacaattcccagatttaagtccttgcatgtatcaaaattttcagaatttacttatttcatgcaagcatactccatttgattcaacaacttaagcacctataaaagatgaatctcccattcccagatttgagcttttgatatgttcaaggtatttggttcaaaacattatcaatgcatgccttaatagtatttcatcatcactcaattcatgcttaccctagccattcccatcatgcaattttaattaattgaagctttatgcatatcaaactaaccttgatcttattacaagctaatttttcatataggcattttagcaaacaggtggtatgcattaaaacaaatcaacatagtgtgtgcatttggagtatgtcaaaacccaaaattttatcaaaagaaaacagccaacacacaaccaattgatcatcattcattagtactattcatatttggttctctaccctaaggtttttccagaaatttcattagaattgaatgagaagatgagagtttgatatagtgcagtgcataatcatcccattattgagtttcaaaacatataaggttcagaattcttaccttatttctaacccttatggagttcaagctttgggtcctaagatttggggtgagggtaagtctgagaatgaaattgggagtaggaagaaatgaggtacaaactggagcatttaaaaataaaactaagtctgcgatctcgcgcgggtcgcgccagattccagtgcaagtcctttttggttctgccttaccgcgcgaccggcgcggatttcacgctaatagcgtgggtggacagtatctttggcgcgggtagagcggtgggcggcgcggggtcgcgccagatgccctgcacagtttttcactaagtcctatattttgatttttggattttatggacctactgctatctaatttaacttattctaaagcataaaaatgaaaattaatttatttacttctaaaacaaattaaaaatctaatattaatggaaatacttaattaaatataatgattatatagatagatgcatatgtataataataaagactaggctaacaacttcaaaacttaatcaatagttatgtacattaccaaagcttgtttaacgtcttagctagacgcatcatgctttttaatcattagtggaattaagtggattaggagttttagcattatccacttggttttcaatgtgaggtttcagccggcatttagcaactttaaaaggtttacctctgtctacaggcatgatttctatgaatccaaatgagcaaatcttttgaatgatgaagggaccagaccaacaaaatgatttcttacctggaaatatcatgcgatatgttgctagcattaccttttgtcccggctcaagttgcttctttctagtcttctttttcttggttgtagctttctcaattgcagccaaagaccttttaattgcagattgcaatgttccagctttggttgaacttatttccagcttacctttttgtgctccaattggatgattatcttgctttttaatttgcacatgttctgctggtttttctttatatgtagtgttgcattctgcagcaattcctagtgtttccattgctgtccttgctgcacttactgcagtgttatttactgcaagctctgaggttgatgatatagctgctgctgtccaattttcttcagcaatttctgctgcaccatttgcttcagctgcagtattttctgcatctaaggatgttactacacctgcacaactcatgtcatccagcacatttatcatagaacaattataacttttagatggattagtcttagaattaaaaacattaaaaatcacatattcatcatccaatctcaattctaatttaccttgttctacatcaatcaaagccctagtagttgctaaaaatgatcttcctaaaagtagagggatctcactttcaccctccatatctaaaaccacaaaatctgcagggaagatgaatttatccactttcactaacacgtcttcaattattcctgatggtttccttaatgatctatctgctaattgcaaggaaactccggtggattttaattcagttatgcctaaggacttacacatagataatggcattaaatttatactagcccctaagtcacaaagtgcccttcctatatttatatttcctattgatacaggaatattaaaacttccagggtcttttaatttcttgggaagcttccttaagataatggcactacactcctcagtgagtggtatggttcctccttttactagcttctctttcttagacagaatttctttcatgaattttgcataatgaggcatcttagccaatgcctcagcaaatggaatatttacatgcaactttttaaacatgtctaagaacctggcaaactgctgttgttgaatttgctgtttggttagcaccggatatgggggtttctcaaagcgagagaaatctcattgcttttgttgatgtgcagaatttggctcctcagaattttctgtagctttttcttcatttgtatcagctgctgcagatttttcagcttccttgttgcttgcctcatgctttgttggttcatttagcacttttccacttctagttgtgacagcattgacctgttcccttgggtttgtctctgtggcacttgggaattgtccttgtggcctctctgaaatttgctttgccaattgaccaatttgtatttcaagattcttgatggaggcatcttgatttctgtggtgggctctagtctcttggatgaagtcagatgttgtttgtgacagctgcattactatcttctcaagttcagaaatgctagtgttgggaatgggaggaggttgcaaataattattggacttgtagtccagtcctcctccttgaaagttcctttgataattatttccagcagtataattgtagttcttctgttgtggctgctgctgtctttggtcattccaaatgccattaacctgcacagggtcagctccaacaagaataggacaaacattagaataatgctcaccttggcagtattcacaactgacttgtggtttactggctgaaacttgggctgcagagacttgcattctatctatcttttcatttaatttagccaattgttgggctaaaattttctgttctgcaagcatggcatcactgctgtccaattgtattggttctctctttggcggaatggtgctgcttacgttttcagtgcaagccaaagatttaattagctcataagtttgagctgctgtctttgatctaattgtgcctcccgctgcaacattaacaatcattcgagtttcaggagttataccattaaagaatatccttacctgcttacctacaggcatatcatactgtggacatctccttatcaactcttgaaatctattccatgcagcgcataaggactctcttccgttttgtgtgaagttggtgatttcattcaccaagcggttgtatttttccatggaaaaatattcagcgaagaaccttgtaaccagatcttcccatgttgagatgctatttggtgtttgacagtttagccatctcaatgcatttcccttgacannnnnnnnnnnnnnnnnnnnnnnnnnnnnnnnnnnnnnnnnnnnnnnnnnnnnnnnnnnnnnnnnnnnnnnngggccgatgatttctttcttcttcagccatctctatttctgattccaactctaattcgagaattgaatcaaagtcaaaattctcagcttctcttcttcttctttgtatggctagtcttcttcggatggttctttctatttcgggatcgaactgcaagtccttagaattgactaaacctcgcataaaacttggagaagcaattaataacaaaaattccaatcactaaaattaaaaattactgtaaaaatccgttaaccaatccccggcaacggcgccaaaaacttgttgtgtacttacggcaagtgcaccgatcgttaacaagtaataaagtaggtaagtgagttatcgtctccacagggattggggtaatttttacaataatattaattctaaatgattggaaaataaaacagaaaataagagataattgttgaattgatttgttgtttgaatagaaatagaaaataaatgcagtaaaaatataaaagaagttaccaatggaagaaacaattgtggtcaggtacaatcccctttgttcctacctccttcacttgattggtttattattgtaagtcacacacatgataaatctttcctaaattcgtaaatcctagaactactagagtcataaccagcgatttaaccctttaattcgatcgagaaacctaaacccttagtgaatctgtcaaactaagtattcaaagaatatatctcatgtgatcttgttaagattattcggagaataagcctttcctaagttagttaatccctaattccttagtgaattaaccctttaacccaattcaaaaacccaattccttggtgaattctattaagttaagcatgaaaaagaacatattataaaatctgtagccatgcatccctatgtctaggcgaagaacaactattattctaaacannnnnnnnnngtcagaaattagaaccccaacgtgtccattgcgaatcctaaccctcaatacttaaatagaatagccaattccaaataagaataaaacattgaatagcacagagtagaataaaataatcaaaacagcattagaatcaatatcaattcaagttacagaggagttacatcagttcatggccttcccacaatacaagttcagcctgccataggcttcaagaaaccaaaggctgtcaaataatacattcttggtgaccttgccttgattcttgacttccaatgatgaaaatatgagaaagagagagtgatggaaggggttgatagatggtagagagattgtgatttggatgcttcctagaggcctttatttatagataaatctaattagggtaacaaggcctattttcttgttccaaatctgaatcgaatcttcttaattaaggaaactaaatatatttacagaatcctttaattaaggcaactaatcctaatatagtaccaaatctgaaaatatataatttaaataaggaaacaatttcaacctcacgcgacccgcgcgcgatctcgcgctagtcgcgtggaatggccgaaagaatggcgcttgtcgcgtaggacatggcgcttgtcgcgcggcttggcagaagagaatacccttaatccttgaggtactggcgcgactagcgtggaacaccgcgcgagtggcgtggaactccagattttgttttcttcttttgcttgcctttattctcctcttttaagccctgaaatgcataattggtattgacattagataaaatgaaataatattaataaactagctaaaattaatctaaatcctaattatttaatcaaaacataacctaaaactatcctaaaactaagatgtgtttgcaacacatcaccccttctccaaataacttactattggacgccgccaatcattgtcggtggtgatcatcattatgcacgacggctgtaacgtctgttgctgaattacggttcgattgttcccaggttttttagtgcttgccagttttgacaaaatatcggcccgggcattttcttctctagggatgtgattaaccacaacctcgccgaattcggacatcaattcttttattcggctcaagtattttgccagcaagggccctttcacttgatatcggccttcaatttgagatgcgactaactgcgagtctgtgtagactttcacgttcttagcttcttgctcctttgcctgtacaagcccggcaatcaatgccttgtattcggcttggttatttgacgttggaaaacctaattgcagtgaaatttccgttgccactccttccggattctcaattataattccggctccgctccctttcctgttggaggatccgtccacgtatagggtccaccattctccaattgttgaggcgtggggggtgagttctcggatgaaatctgccaacgcttgagatttaatcgcgtggcgagactcgaatttcaaatcaaatttccgacaactggactgcccaatcggtcaatcttcctgccaaatctggcttatgtaagatttgtcgaattggctggtctgtccgtatgactatggtatggctctgaaaatatggacgcaattttttggcggcgacaatcagggcgaagaccagcttttccaacttttgataccgcgactcggagtcgcgcaatgctcggcttacaaagtataccgacttctgtgtggactccacctctcttattagtactgcacttacggcttcttcgcctactgataagtacatgactaaaatttctcctgcttccggccttgacaatactgggggcgacgccagagatttcttcatgtcagtaaaggcggtctcacattccgagttccattctatgacagcttgtttcttcaacatcttgaagaacgacaatgccttctctgctgactttggcataaagcgcgtgagggcggctattctacccgttagttgttgaacttctttcttgctggtcgggaattgcatatccaggacagcgcggcacttatccggattagcttctattcctctgtgtgttaacatgaaacccaagaactttccggccccgaccccaaaggtacattttaatgggttgagccggatgttaaacttgcgtagtcggccaaaggtttcttcaagatcttcgacatgcttatccacctttgcagttttgactatcatgtcatctatatagacctcaatatttcgtccgagctgtgactcgaatactctattcatcatcctttggtatgtggcccccgcattcttgagcccaaatggcatgacgttatagcaatagttggctttgtcacctatgaacgtcgttttctcctgatcgtccgggtgcattgggtatctgattgtacccggaaaatgcatccatgaacgacaaaattctgtacccggatgaattgtccaccagctggtctatgtttggcataaggtatgcatccttggggcacattttgttcaaatccgtgtaatccgtgcacactctccatttcccattcggcttgcgaaccattacgacattcgacagccaagtggtgtattgaacttcgcgtatgaagccggcctgcagcaactcattaatgtggtcctgcaaagcttaggctctctctggtcccaattttcgtttcttctgttccaccggtttcgaccccgggtacattgccagtctgtggctgcagaattcgggatcgacgcctggtatttctgacgccttccatgcaaatacatcacgatttttctttaaacattggatcaattcctccctctgttcgggttctaatgttccaccaatattagtcacctgaccaacctggtctccaatcagaatctgctcaactttctccactggttccggcctccactcatccgtggcttctcgcatatccaattccaccacatttactgaacgtacacaattatgaatgtcgtcgttagcttctcgttcactttttcgaaccgtattataataacattgtcgagattctttctgatcgccacatatggttaccacctgcctgttgctgcccacaaacttgagtttttggtgctttgtggacattaagatgtcccacttatgtatggttggtcttcccaatatcatattatattgggatggaaaatctgccacgacgaattccacttcctcagacttgtaagcttctctcgttcccaaggttaaccgcaagcgaatagaccccattacattcgtgtttccgccgttgaagccgatcaacatcgttttgcacggtcttaattccttaacgtccaacttcatcttccgaaatgcgttcaatagaattatgtcggcggaacttccattgtctacatacatccttcttacccggcaattgcccaccgtcgctgagatcaccagtccgtcttcatgtctgggtactaccccctccatgtcttgctttgtgaaatacaagagtggaggttctggctctcctgtccgagctttgaatttaggttgtgcctggaccgatagcacttccttcagatattttttcctttgagtggcagtatccccaccaccgcccattcccccggaaatcacgttacattcaaactcgggttctgggaactcgtcattatcttcccgaggtctctttccttcgttgatatgttgattttcgtctcctttccgtttgttctttcttccttgtgtccgaataacatactgctttaatcttccttctcggatgaacttctcaattgcatcccgcagatcccaacattggtctgtggtgtgcccaggtccgttgtggaattcacaaaatcgtgatttatccaatccacccttgttgaaaactgggcggggtcgttcaaccttcttcatctctgtgagtgcgacctccttccagatttgtgaacgggatacgttcaatggagtgtatttctcatatttgttttcgtatcttcctggtcgagatttcggatcattattccgagctcgactctccgggtatcccctattttttgggggtgggcttctcctttcatgacgctcctttcctcgtcccgagttgttgacgacctccatctgttccaactccaagcatttctttgcgcgtgcacgaaattccatcaaagatttcaccgggtctttgtaaatggacttggcaaatcttgacgaaccattaagtccggccgatatcaagtatacgtggactctttcttctagcccatcaacctgcagagcggcttctttgaatctatccaaataactctgcagtgtttccccgggtgcctgtctgattttgtccagggtgaactcggacttcggctgctttttactagtcgcgaagttcaataaaaatttctgaccaaagtcttcgaaattctttattgatctaggcggcagagtatggaaccacgtctgcgccgggcccgtcaatgttgtaacgaaaatccttgatattatggctcctcaatgccccggacacacatctgcagatcgaattcgtcgatatgcacttgtgggtcttgtgttccgtcatactttgataggaatgacccatcaaagtcatccaaatatcgagcgtttacgatgtcgtccacgaatggactgttgttttgctgtcccctgctatatttccgacgatacactggtcctgccttctcgcgaaaattctgttctccagtcgggttcctctcgttgtttgccctaccagtgggattgtcgtcatgttttgctcgaatgtccagattttcgtcgcggctctggtttgtgtcgactccatcgcgtgcctccttctgtgcccggttttgaccccgatgcggctcgtctatcctcctttgatctccggggtcggtatctcttctttgatttaggtgtgtccttagatcttgcggctcctctatccacctttggtcttccgggtcggtacttcttctttggttcaagtgggtcctcaaatcctgcgtctccctctcaggatttgaaagttgtacccgatctgctatcatccgcagttgctgctccaattgtgccgttcgttgcatttcggcacgtctccactcctcattacgttcttctatttggcgtgtaatgccacggatgtcttcctgtctctgtagattttgtcttttctccatgttctcaattcgggttaggattgaattgagaacattgctgacaagctgtccttcgagctccccttcctggcccatccttcgcaccggtggggtcctccgttggtctgtctgagcgggagaggaagcttcgtcggaaacggcttccgtcacatgtacttcttccctccgtgccacattctgattctccggtaggcaaatctctctgttcggcatctctgaatgtggtacggagtggctgtttcttgtgtttaccattattgacaagcgtgggactcgaagtttatcgttccccacagacggcgccaatgttctggttctttccagaacacaaatgtataacaccgaagtgctatggagttgctgtttgatcactctaactctgcagcttcaaggatatcaatggaagttgataccttggggcaggagatcacagagatacaccaattgacgtggggtgtgtgctctgtgtaattgaaagagagagatagaatgtgtgtgtgtacctttcaccaggaattactgtgtatttataaacagaatacctcgtaacgggcattagaactgcttcctggattcccggcctcatccagcacgttctcaaagttcagtatggaccaagtcagcctccacgttctatgggtaagttatttgcacgattattcataacaattgggcccagacccaaactataacgtctacgtaatctgaacacgacaaccataacagtattaattattcttttcatttatacctctaataactatcgttgacttgcatcatttccaacaaagaagattaatagcatgttaatatagtaaaattgtaactctctcatatatttattagttttttttgtgtataaaaaaatttaggacggtaattttaatgggacatagagagtattaattattatatttactaaatacaatatatggtattgaattgaatttaataaatataatgctaatatatatcaagtataaatttttaaatgaaactatatatataaataacattattaaatagtgtaattattacaaaaattaatcttatatctcatacatatatttattaatttttttgtgtgtaaaaaaatttaggacgataattttaatgggacatagggagtattaattattatatttactaaatataatatatggtattgaattgaatttaataaatataatgctaatatacatcaagtataaattttttaaatgaaaccatatatataaataacactattaaatagtgtaattattacaaaatttaattcttatatctcatatataaataataaagtaaacattaaagtaataattttttaatgtgtactttattatatatatatgtatatacttaataaattaatttaaatttcactatatattttagaggatgttgattgagagtgtaaaaatcttaagaaaaatgatatttagtaggaatagtttttgtcaaatatgtaccaaagctgatttctattcaaacctgtttaacaattttgtaaatttttaagtaatatttattttaaaaaatagtgttaagcattaaagttttattcatgtattttgtatgagtaaatatagtcactttagtttctctaagtacttatcgtactgattcgtgaatagtattgctcaaattttaattctaaaacctctaaaataaaataagactagggagtggtaagattagaatttttataattgtcataaacagcttagcttctgatcgattgacattcaagtttcacgcaagtatgatatgcaattcttttactctcctcaatcaatggccgtcattggtgtttgtgagactgtccatacgtcattttcacttgtaaataagaatgtccaaacgaagaaagacgtgtttctttctgaagaaagaattgaccaaggggaaaatggaacgcagaggtatatgttacttctgacaaggtaagtttttgtctactaaatacttttcatacaaatatgatttcgggttaagatgggtttaaaaacatttttctatttaatcccttattatgaagttaagtactaactcttttgcataaaaatttcatcttaatatataagttcagagttgcgcttctccagctccatcacctcctttcttttgttgctccatcaaactataagagacttcaagcctgaacctaaacattatatattgtcaagatattgaatagtcaagaggttggaaacggatcattgtagcttagttttatactcttttgataagttttatatcatgaataccattagttccaacgccaacaaacgcatgcatgcacgtaagtaaaacgacctgaaaaaataatcacaggttgcaacttaatggaatctaaccaaccacatatgactaacaacaaagtcaacatccccaacacatgatgtcctgctgctgcagctgttgttgttctgttctctggtaccgtgtggtttcaccgttttcaattcgcaccagtcaccaggcttccaaactccttgcttaataagtgtttaggagtagggagcaaagtggactttcctaactaagatctaagaattgtaattaaattaagaaattttttataaatgcatgtaggatttaactggtaggaagaaaagaaatacaacggatagaattaataggaaaaacagaaataaagtaaattttaaagttgtttagtttaataaaaataaagaagaaataaaaaagataaaagaaaaagataaaaaaaatttgcttgatatatttcatgattactaatttataccatttctcctcacttctcccagtttcaaagctatttttccttacttcatggatgaaatttttgtacatgagacctacaattctttccttattatttcattggtgccaaaccaggatgagttttaagttttaactatccactctatttccttacttctacattttcatggtatttcaacccaaccaaaaagagtatataggtaaagaaatctcaatcctcatctttttaattagtatattacctataactaaatattacaaattaaaatatataatttagagattaaaattttcattctcttgttctttcaactagacattttgaattttttttaaaaatgcgtattttatacactatctttataattacttaaaaaaatctttacggataaaagttagaaaatttctttcaaacccatccttgctcaattattcattttctcctctggccaaacctaatagtaatagacatttccacacttgaagcagataaagaactgaaaatgtacaagttgcaatagagtagcccgtcctttggaattagtgttcgctcaactttttttttaaacacagtataaggttagaatctaaaactttgtggaagctatccaaattctccattactaggtctcttctaacctgtaacagctagactagattgcgtgtatgtgtggtaagattgattaacaagaatggtgaggaagggaagtgtcatataaagtgccatgaagaactttcattctggtcaagttagaattagcttctaatttatgtgcaattgtaatccatgataaatattaagtcctcaaagtgtagctgaagacacatcacagagaaataaacttcatcagaacaagaacatgaaatgggtcagaatctccaagcttacacacaatagacaaaacgttaatcagaagctccacattaatgtctcagcagctaagcgacgacgtattgatcagctagcatacagattttaagatagaaatacttcacacttaggacccatctggctgtataaaggggttggcgatctcatctgtaccatcagttggggacacaagcatgacagcagttcctctacaaacctgcattgcaataaaataagttcccaggataatgaaatattcattgctaagccaaaatagttcctgttgaaagataatgataaaataattcaaaaaagctagtggatgaagtgcttatagtcatgtgaattatcaactttttcttttcttgcaggaaatgcttttatgtagtgataggttgtagaaattaaaatatactgaatactatcaactgagaaatcagggagcaaagctccgtacaggctacagctgaggaaaaaatgaaaaatcctctggtaatagaatactcaagaaaaggaaagaaatatgactgacactgttgtagtgcaaccaaccctcaaagaccctcaccaacatttatcctctcacctctgtttccccttatttaatactgattcctgaatctcctcactcccacacactcatgccgccagtcaccattcagttataatttcccctctccctctccctctccctcctctctctctctctctctcctaactgaaatttcccctttcggttattattcttgttcctctcataaaccagcaggcctttgctaccattgggcaaatcatattttcctatgctcttgtacatgtgttaagggcctatcataagtacatttactagaggcactgcatattttaaattctataaaatttaaacaatcagcatacacatctataaaccaaaacaaaaaaactgataatagagttaaagtacaacttttcaccctcgatgaacaatttaacatggccagaatcagtcaattgctttattatataagaattcttaatagaaaattacagaaacatattttaaattccttttcttgtagctctcctaatgcacttagatgacatgttcttaatgttttttagaaggagatgacatgttcttaatgttttgcaagagtatataattgatctctcctatgtacttggactgtaattctaattaattaacttgatatttttcttacaaatacaaaataaatattaagcttggtggagggttaaatccattagtagttctatgttccagtcatttccttgtttagttcttttcctcttcttttctcctttcaccattcttttattttaactttgtttctctcttttgtcctattttcgatttatcattaggttcatctaccaccaaccccaattaacttgggttaaaggtgttgttgatgttgatgttgttgatttattaaacttccctagtatccaaagaagcaaagatgcaaaatttcaatgaagcacgacatcagcaaagcaagctttttatgagccagaaggtgcaattatgacactcatatgatgttgaagaggaggaaaaaccctgacacagtgataaagttgtgccttggtgacttgtcggtcatgggtttgaatccggaaatagcctctttgcatatgcaagggtaaggcggcgtacaatattcctcccccttactttcgcatagcgatgagcctctggacaatgggatatgtagtttttctgaaagcgagtcctgacacagcggtaaagttgtgtcttggtgacttattggtcatgggttcgaatacggaaacagtctctttgcatatgcaagggtaaggttgcgtacaatatctctccctcttaccttcgcatagcgaggaacctctgagcaatgaggtacgtaattatttttagtttttatatgatgttgaagaggagagcttacaattaagccaagattcctggtctgatcggtagttttgaggggatcatcaggatctgcagcacaagggacaaataaaatcttctttcaaacaacagaaatgaaatattagataatttttaagaataagctaatatgttaaattttgttggtggagtttataaacaagcataatgctgatagtaagtagagtcacacaaacatttgaactatgaaattaaatccgttcttttgacacatagaaggtacaataatatgcatagttgtattgacatgccaagttcatctaagagtgttcaataattcggttctgcactatactgaacaaattctgaatggaaattccattttgaattcggtgctgaaacaaaaataagtaaaatgatgctgaattcattcagaaaattaagaaaatgagtaaatcaagggcttaatcaaagtgagaaaaaaatttaaatatcataggatcttccactccaatgcttatgttatttggaactaaaagttcagtgctaaatctgcacttggggcatattagggtaaacaacttgattaagcatttattcactaaactcttataaaatgagaattcccatataggcttggttacagagcttaatgaaataagctaaaaagtgcttattttgataaggatcatagttaagcttattgaataaactacaaatacaaaaaacatatagatagataaataagctactttcataagcttaaacaagcccttcagaacgctcccttaattatagaagcagtggaaatgatgataaaaatggcattatttagctccttagttgttattcattcaatatttcactctcagtcggtataagtccctttatgtagttttcactaatttgctaaatacccaaatagtgatttaattctgtaaagttaaagtataatcaagcagcttcatggcgtaaatcatcacaccaaaaaaacttcacccataatgagcaaataatccaaggaatcaaccaaaagtatagatgaaaactcaaatattttgccccctagccctgaaagaaattttttgcattttagcagattgtagcaaaattcgctgaaaaggctggaaaagcagtatcatgaagtcacgaacataataagaaagtaacaaatagagctactgcagtacatataccattaaaatgataaacagaaaaactagatctctgcgttgtttagttacctcttaaaaactctacagcttcatctaggacaaggttaagcaactgatcataccctttcagagtccctgtcactgcaatcaaacaaaacaaaacataacaaaaaatatacatgtagaagagtttatttgcattttaattatgaaagctaactctcaattgagttcttgcaattcaaaacgaaacgaatttcatacttccgccatcattttaaaaaatcaatacataaatcattaaccattttaaaaaataaaaaatcacaagagaagggaattgggtaacctaaccttgtctgcctccagtaagcttaacttgaacgcctttgtctacaaactttgcaaggtccaaaaccgtttcttttctgcccgactgtgtcaattataaaatgcacaaaaaaaaaaaaagatttacatatcataaagagcattcagaacaaaacgtaaatgaaaaagggaggaaaaccctaaaagaagacagagagatgaaatagttttgaaaattgaagatgtgattgggttttgctgaatcttaccatgcttaattcacgtagtgtcgggcttcgtttggtgctgatttgtgtctgtgcgacaatgaaaagagaagtaccgaagcgaaagtgatagtatggatttgaatatacagagacagaacttggaagagaggagtgaacaacggcaaaatggggaaccaatatatattattagagaaaagtgacggcggaaataactttgaaacaaaacagaatataaatgtttttttttacagaagaatataaatgtatttaaaaaatatactatattagaaaacttttaaaatttcaaaatgttaattactttaaattaaaattttaatggaaataaattttaaccctctttttttaggaaagcaaattttaaccttctctttatttcatgaaaaaaaaaatgaaaggaaataaataaaagttcatttattacacgtcattaatggacaaaaaaaatttaaaataaaaattttaatatatcataaatttaatataaaaagtttaaggatctaaaacaaaaatcaatttgttttaataatcacaaacaaaagagataataagacacaccaacacataaaaaaacttatctttatattcaaataacttctttgcttatgttatacctagagagaattaagaaattactccattattctctaaattaatgatacacttcattgtgagaatgaaaatcatattaagaaatttaattgtatccaaaaagggatttattataatacccttttgcattaaatctttgtaaggatgataaccagtatgagattatagtatgataaatgttaatgtttttctctaatactttttttctaagactttctatgttttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaatttttgtcacggttaaaaaacattatcaagtcaataaaaaaatacattagtaacataattaattaaaattattacaactgaattaaaaatttattcttaagtcatcttaacataaccacacattaatcacataatcatttagtacaatcattcttaaatgtattttttaaatggttaaagtttataactatttatataataaaatttaataatttaaaaaacaatttgtaacgactaaaaataaaataaatataaggacaataaaatactatctgaaatgttataaggatgaaaaataaaataaatataatttataataacaaaaaaccaaaaaagttaaattgtaagaaattaaaaatatatttaaacatattaaatccaatttgcttattaatttttttaaaacacttattttaagtttaaaattgacccaaatataatatggataaataattaataaatgtttgtttatgggtcaattttttacttttggaaatatagaaggggaaaaattatcttgtatttgttatgaagtaataacacaattaatcttgaatatattttatattttggtagaaaatatatcaaaatataaatgatacatggattaatgttcaaaaaaggtggtaacattgatgaacatgtaaattatagaattagagcatgatggatgaaatggtggaatgcatcggagtttttgtatgactgcaaaattctccttaagctgaaaggaaaattctataaaacaattgtaagatcggcaatgttgtatggagcataatgccggtcaacacataggcaacatgagcaaaaaatagggatagcaaaaatgaggatgttaaggtggatgtgtggatatatgaaggtggataaaataagaaatgagaatattcgaaaaaaggtatcagtggtactggtatgtgaaaagatgagagaacatatattgaagtggtttgagtacgttatgagaccggcaatgctgtatggagcataatgctgaccaacacataggcaacatgaacaaaaatagggatagcaaaaatgaggatgttaaggtggatgtgtggatatatgaagatggataaaataataaatgaaaatattcaaaaaaatgtatcagtgtaccgatatgtgaaaagatgagagaacatatattgaagtggtttgagtacgttatgagactggcactgaatgctcccgtaagaacaaaagtttgttaccaagagtttgatacaaagaaaggtagagatcaaccgaaacttacctaaggaaaggtagttaaataaaacctaatagagtgagatatagattggtggacggtatgtcttaggacggagtgaaaaaaaattataagtttagtagagggttaaaccattagtagttttatattccagttattcccttattttagttattttccttctttttttcacctcttttttctcttttttcttattttaactttttttcccctctctctttctctttttgtctcttttattatttattattgggttcatctatcaccgatctcaattaacttagatttaaggtgttgttgatgttgatattttatattttgataaacaataatctcacttttaattaatatttaattccaacgaaaggaataaatattatttttcttattatccacaatccaactattctcttaatgctacattcatgtatatatgtgcttcaatttcatttatattattcacaataatttttaaaaaggtattctaaatttttatattattaacactgtaacctctgaattggctattttcttgaagttacttttggttttttggttgactatttgatttgcatcaagtatacatgtagttttgcggcaacaataagactggagttttaaagcatgaggcagcaaattaaagggaccatgatgagttttggtgatgttttttttggcataatttgtattatgataagagtaactatattttaagaattaactacgttttttatttttaaatttttatttgatttggttaaggttctttaatcttttttattaagattttaatctctaaaatttagtttgattggtgaagatttttcaacttttttctattttttttagtcccataacttttaaaaattcagtctttactccttaaaatcccaataaataaataaaaataatgaatttaaacttttgttgagaaactataaactgaaatttctaaaattttagagatcttaactagtcaaacaaaagtttagaaagtaaaaatctttattttttttttgtgtttgtctaaactacttcttcttaaaaaaataatttttctacttattttaaaaaataaatctaatttgtttattgaaaaatatttattaaaatacttatttaaacttaaaactggcccaaatataatatggataagcacttagggtatgtttgtttcatggctaaattttttagtcgtgagaatattggagtggaaaaaattatctcccctttgttacgaaataataaaataattaatcttagatatattttaggttaaattaacctataagtcgctatatttttaccaattttttaattaggttcctaatttttttcttttaattgggttattagtttttcaattggatccctcatttcactgttgttatgaaaaattaaccgcaaagactcaattagaactccagacaggaaaacaattcttcttgggtgtgttatattcacaattgagtctatgagacttttttgcaaagtttctatcttttaatgtcaattcaacctagatatttctttatatttatttggttttgcaaaaggttgaaactttataaaaaaaactcacacaattgacttaattgtacttacaacacattctaaaagcattagtccactatcagtacctataattaagtatttgtggttagtttttcataacgataattagatgaaacaattcaattgaaaaataaataaaagtttagggatccagttgaaaaaaaatgttgaaggaccaaattaaaagaaatataagttgagggacctaattaaaaattttgtataagtataaggtaccacaaagtaattaaacctatattttgtatatgagtaaataaaaatctcacattccatcaatatttaatcctaatgataaaaaatatttattcccataaaacataaatccccattagtgaataaaaatatacatatattctccttagtatccactactcaactccatttatatatgtgttttaatttttctgatttccacccattttttcctgtgtcaatttcatgtgtgttattcacaataatttttaaaaaggtattctaaatttttatattattnaaaaataaataaaagtttagggatccagttgaaaaaaaaatgttgaaggaccaaattaaaagaaaaataagttgagggacctaattaaaaattttgtataaggtaccacaaagtaattaaacctatattttgtatatgggtaaataataatctcacattccatcaatatttaatcctaatgataaaaaatatttattcccataaaacataaaatccccattagtgaataaaaatatacatatattctctttagtatccactactcaactccatttatatatgtgttttaatttttctcattttcacccattttttcctgtgtcaatttcatgcgtgttattcacaataatttttaaaaaggtattctaactttttatattattaacaccgtaactctaaattgactattctcttgaagttacgttttttttttttactatttgatttgcatcaagtgtacatgtacttttgtggcaacaacgaggctggagttttaaagcgtgaggatgcaaattaaagggaccgtgatgagttgtagtgacgtttttttggcattatttgttggaactttcctgtgcgttgtttatatttatacctatttggacacaattatatattttttaaacaaactttaacacaataaagatatttttagtaattattatacattcctaggataagaaaatgttaaacaaacacatgttttaattattcctatacgtataaaaatattttcaacccatttttaatcactaaaaaataatttcttataagttagttttataaaattgaatatgactcaaacttgcattataacaatatagttttttcataccatattaaaataaaataatatatttattaatattttaaatgttaaaatgttaatatacataaaaagtcattcgtatagatttattgaaagataattttgtatcttattttcatatcttattgtaaatagaaatttaaataagttttatgaaggttgtatcaaaccttcaatataaatttatatgaatgaaaatgacaaaattttgtgaaattatataaattcttactgttttttcaatcactataataattctcttaatnatatattaactaacctcttctaattgtttaaaaaatagggaagaatgatgtatatgttttaaaaaaagaatttgaataattttacaaaaactcaaaagtaattagtataatttaatcataaatatatttgaagaaggttaattgaatataaactttcgtgaacaaaatttaaaaaattatatgctcatatatttaaacaattcaatttcaatgtttaaaactatttttttttcatactttaatttttactttcatctttatatttctctttttctctctttttttttttagagattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttctcttctttttggtcacatttttctttttctctttctcgtatatacttttaaggaatctaagagaccatttttccttattaaaccgagccttgatagcacttcaggattttgatttattttatttcatggtaaaagcataatacaagtccaaaaatccccactgcaatgaactcagatagctaaatagacacacttcgaatcttattgccacattatagttttttgtcagagtttctgatagaaggacatgacaatacttaaatttattcttagatggatataactcataactagtctcggccatcattaaacaaacacttaattggctattcaattccatcataattctgacaatttttttttttaacggttaaacctttaactttagaagtggtgggggcttcctgatcaaagtagcttgctcaaaggaataagcaatttcgatgagctttggttctgagcctttcaaacctccaaagataattccaaatggcgcacccttttcatatcccgctggaacagttattccaggataacctccccttgcaagtatactaacaaagaatgaaaagggtactaccaccgcgtcaagtttatttgttatcattaatttctcaaatccaatatgtgacaatcttgccatgtttaacactgcttccttcagttccctaactccatttgtcttttgagctatcaacatgagatcttggccatactccttaagtttctcctgcaatttccataccaatgttattatatctattccagtgaaattgttggaaatcgacaatcacacacaaatctaaaaaacagaaaagagaatagggaagagaaatatgacacagtattttaccctggtttatccaatgtaggctacgtccagtttgtctgtattataatctcctcaccgtcactcgttacaagtcactcagtttacaaggggaatataaataggattaaaagaccagttggctttctgctgaccccgccaacaagaagggttgtcatctgactgcgaaagatgagccatatccaacagaaatgagatttaagtgatcaattttcagttaaaattagtcttagtctgataaaattcggataatagtagagaacgtgttaaaaagaacataatgttggtatttctatttgataattgatgaatttcgccttcctttatagaatttaatatatttgaatgatggacgaaattcatcaacaagatgtattttgagcaaatttttttaccatatctattttaatcatcaacaagtaaataggaggggctttgttacatactaaccaattttgggtgtttcttgttgaaggctatcacatcggccaagcttctcactggggaagtaactaagtctctgaggtatgcgttcaaggataatttgaattcatatgccagagcaatgccttcactttgatcattaaagatttcctgaatgttgtttatctccaaattgtcaaccaacactgctcctttttgcctgagtttgaaaaatataagtatgatactgaataatgcaatcaataattaatacttgacacaaatagtaattttcattaccttaatgttttcaggtgcagttcgaaagtatcatgcataaaagtgtcatttccaaaaccgtagaatattcttacgacacctaatctctttcctctcagtccatctttctttagaaattgagcatagccacctcttgggagatactttgatgctttgattgttgccttatcattgatgtcgattcctgcaatggtttcaagaacaagagcagcatctgatacagtcctgcaaatcggtctgtaccagcccacaagaagtcacacatttaatgcaacaaaatgtattttgacgggaaaagtaataatgcttgcaaagtgcatatagttttgatataaagaaatagcaaattacattaatacttcttaagaatttttcgaattacacaaaatactattctttgtttaatgtttataacaactttcattataggagtgttgttttcaaatttaaatcattaagggagttggtgtaatatataaggagaatatgagtataatgcttttaaacattaaaggagttagtttaataagagaaaaaaaaatgatattgtatgtatttcggaaaaagctcaaaagattccagtgtaatttgttcaaaagaaaatggtgaaattaccatagtccatagacttacccaactgtgtcctgtaatggggagattggaactacccctgctctactagtgaggccaactgttggtttaatgcccactactgaattagaacctgaagggcataaaatagacccatcagtctcactaccaagtgacactgccaccaaatttgcggccactgatattgctgatccgctactagatccacagggatcacccattgtgtatggattctgcacaacacaaataataatataatagattactttactatggacttttgcaaatcatcaagaatagacagatagatttgagttgaaaagcaagaacaaggtcagattaaagtcagaaaaagcaagtaaatcaatcacctttccttgtccacctctgccattccaaccactgggtgcatcattcgacctataatgtgaccattcactcagggtggccttgcctaaaatgatagccccagcttctcttaacctggtaactacacctgcatctctaggcaccacagagccaagaagtgcaaaagagcctgcggtggtgttcatcttatccttggttgcaataatgtccttaaccaaaatgggtattccatgcagtgctggaagagtccctggtgcattagcctttctctcatggtcagctttgtcagcttgttctagtgcatctgggtttaactccaacacccctctcagaactgggttttgggtttgtatttgtttgtggtagaactcaacgagttgcctagaggttaattggtttctacggaaagcaagttggagatcatatacagttgcctcttcaattgagaatcccaaagtgactagagggattaaaagaatgagttggaaaaacaaagagaaacatcctactgtgttgcacgccatgaaagcaccaagatataatatttagttaactgcatttttctgtatctatatgtgcttcttaatcattatggccgtgaaaaataaaatatctagaaatactccaacgtgattcacaggctgtccacagtatctgaataaataattgagtaggggcagtgacacatttttattcctgtcatatcgctttgttcgatgattctctttttctctctctccttttataagatttattcgataattttgaagtgaataaaaattgaggagatttctcaatttcaaaatgtgacgaggaagttttgtggactcaagtgtgaaagaaaatgatgatattgtgaagataattattacaggtgagaaaagtattcagcatcatgggaataatgataatcattgtggataaatttcttgtctcaagcaagaaatgtgacgtgtaactaaataaatataggtaaatattaacaaatgtttttagagtattgattaaaaaattaaaagaaaaaaaatatttgaatgtgtgaaattgtgtttttcataatttttttatattttacataatgaatatttttaaaaatttcttaatcaatattttaaagatactcgtaagtataaacccataaatatatgattaaaaagaattgtataatgaaagactaggggaaaaaaagaacctgaaaatcaaaataaaggataaaaacttcgggagttcgtacggtttaagactaatataaactaaactaagagttccattatggttaactgtgaataaaatgttcttaatcaaaagcacaaagtatgctaatagtaaatcaaacaactaaacaataataaaccttcactcttctcttctctctccttaaagctgctgcatagttacttgattaacccttcctcatatgccttaatttgaccttctcaactcgataaatgagacacatagttggcttacaatatttgagtctttctccttttagaaaaggaaaccgcacccaacaagaaagctatgatgaagagcatgggaaactcaggaaattttggagggagacgttcactcacatatctttggaattccacttataaagttggtgtacgtggtccaaccaatggctacacagggtctgtaacatcactctattagtaactccctgcatattccactgttgattcttaaaaataagagagttcttggcatactagagagaagccaccgtaataccaaacattaatctccatctgtgaagcccctttgccgtgttccccaacaaccagtcgacaagagacatagagaagaagctgtgcatagaagggaaaaaaatccctgccaagctcttcccaaataggtttgacatcagaacaatctctcagaatgtgcaattcagtctcaacaatagatttgcataaagggcacagaggatcatcaatataccacaatgttgccttctgacattagtctttaaggcctttattagcaatcaaccaaatgagagtccaaattctatgaggatctttccactgccaaatcgtctgcaacctgttagagccatgaatactgtgataattggttgagattgaataagttgatttcacagtaaaacttccattagtagtagctcccccaaaccttccatgagcagggagaggggtaggataagcaagaatctcctggataggccagtaaggaaggaagtcctacaactccaaaactttccacccaccagagctattaacatactcgatggaaaccaattgtctagccagaaattgacccgggaaccattacccacaatccacgtaatagctttccaagtttaggaatcatgcatcccacaattaacaaccgagataatggttgatcagcacttatatttggcccttaatacctacacccacaactcctccggctgggcaataagctcccaagccatcttcatgataaaagtcttattgtaaagatgcaacttcttgaaccccataccaccgtccacctcccatgtagtggtatgccaaccacgagcatctccatcattccaaaagtaactattgaggtgtgaatagtaaagctcatactccggacctgccgaggcccaacaatgttagtgctgggctcatttcacttgtcagcaacgggtaaaactaattacattaggaaatataatggtatgggaagtgcagtaaggaacactgggaatgcaggaagcaacaaccgtcagtaacatatggccttcttgttcaaaccttggcaaatgagattgagaatgagaactagattggattggtgatggtgatggtaatggtgatgggtactaattggtgattggggagaacaagggtttgttattgttaccacagtgagcagcaagagggtccaagacagaaggagcaagaagaagagggttcaagacctcgaagtcacaaccgagaaatggtaaatagcctccaaaatcatctacctaatggagcttctcaagcaagatcccgaaatggtgattcccgttcgctccctcgaccaccaccgccgccagatcaacctccccaagccccatcatgtctccgatttcctccgcaaaactcccaacctcttcgaactctacaaggaccagaagggggtgctctggtgcggcatgaccccaaaagccgagaacttgatggaacaacaaagggtcatcgaagaacacgccgacaaagccgccgaacacgtcacgaggtttctcatgatgtcgctggacaaaaggcttcccttggagaagattgcgcatttcagaagagattttgggttgccgtggattatagagtccattgggcgcataagtatcctcagctttttaaggggttgagtttttggagcttgtatcttggaaccctgattgggcaatcactgagttagagaaaaaggtggtgacagaaacaactgaaactaccgaaagtgaaactaccaataccccaggaatgctttcaattccatttcctttgaagttccctgcgaactcttagagggtgtatcgttactatggtgaaaagattcagaattttcaggagatgtcttatttgtctccctatgctgatgctcgtggacttaaggctggatcattggagtttgatataaaagggctgttgctgttatgcatgaactgcttagtttcactattgagaagaggttggtcaccgatcacctcagacactttcgttgggagcttgtgatgcctcagaagccgatgaggcttctgctcaagcactgtgggatcttctatgtgtccgagagggggaagaggttatgactgaggcttatgagggttctgagctcattgagaaatgccccttgctgctgtggaaggagaaggttttggggcttgtgggttatagagggaggaagaagagaagcttgaggtatgcagtgatgatgagtctgatgtggaggatcatgatggtttggttttggatcagagggattctgaagtgggggacttgcatgtgcagattgagcctcggggtactttggattacgaggatcttttagttggggatgattctgagatggatgatggagagatttcatgaagatctggaaattttgaaagttgtcaaggtcggagttgtatttcagttttaccatatatatggttgattcactttatacttcaaagttctcgggaacacgcaattgtataacttaatgtaaatcaaattttgaggattggcattttactttcatagattagcaaatctcggttgcgttttaaatgtggggaaatgtggtttcttgacaaatgaaaggttaaaagaaaatgaattaacaataaaatcataataaaattgagctacaatgagtcaaaacaaatgttcgtaaacataaccaagatatatcgtgggcgttagctcaaattattgaaatttctgacaatatttgacatttctactaaaattgttatcatcttagttcatttgtgtacctctttataacccgaagtcctaaatggtattgatacctcacatagttcattttagaacccaagctcttaaaatgattcgttaatgtcaacaacccaaagtctgaaggatattgattccccgcaacagataaatgcaaaagttccccggtaggctaaatcaaaataggctttgatgtaaagaagagacaattgtgacgcaaatcatcatatgaacacctagtggaataaggcttttcttcttgaacaaatcatatgaacaatgaacacaaactggaagattaatctatatgttgcatgtgtcataagaagagaaccatgattggtctgccaaatttgcaagttcactatcctcttcgttacaaaataactcaaattgaccattaacattgttcggcaccttggtgtcatcacaagtaggcatgacaaggtcatccaaagtaggtcgtatttcttcattaggcaaatgtgttttggcaagtagcttattaagtgtgctaatctccttgtcatatttcttcttcaatttatcaatttgtttgtaggcctttgcagcttcatgctctgcatccatggcccgcttctgcaagttaatacatcttatagaattagctcaagtagaactgagctgacccagctctttcaaaaacatctccactaccaggttaaactatatgtatgcatcagctgtagcaaaataaaattgacctgcttctcttacataaaatttgctagaaattcatttgtgagagtgaaagacttcagcataaaagaataaaggtttattcatttggtccctatagttgtacaaactttaccttttaatctctatacttaaaaatcatctcttttagtccttatagataccttttaatctcttctagttcctatggagtttagatgatagagactaaaagagattaaaaatgttatgtatagggactaaaaggattaaaatggtatgtgtaaatacacatttgaatatacatactttttttaatctgttttagtccttatgagtttagacgatagagactcaaagagattaaaaatgttatgtatagggattaaaatggtatgtgtaaatacacattgattcttgctcagttgaaatttgaatatacacattgattctttatatacctgtgcggtaatgacaccttcttctgcttcattaagtcgcacaagaagttcacctgcagcttgcactgcttcagcagtatccttcagttgagctcgaagtcctctattttcatctcttaggatttccaattctttttctttttctgcttttaatgctgaaatttctgcagcaagggcatttatgaatttagagtctgcacctcttactcctcctctggaagctgcttccttgacatcatcaatgctatcctggatctttctatgcctttcaagcaattggatatgtttctcttctaaatcagcatactgttctaaaattcgtgcatggccttctatagccatttgcattgtttcattcagttcctcagcacacttcctctcagtatctagttcctgcttcctcttttcagctagtgacctgctagcttcaagttcagctctcagtttttcagttagagaaatccacctgctttctgcctcagtccattgacttttttcctgttcaagttttactttggcactgtcttcagttgattctggatttgcatttgccttagtgctagcctctgttaaatcaggaatggcagttaggtttgctgccaaactaggttcagatgaataagtcaattgcaatggagtatattgctttattgcggatgtggatgaagagtcaacataaaagtgaagctgatttcttaaactacatatctcttccatcaacacttccctctccccaaattggtaaaaattctgatactcttgtaactcatcttgtactctttttaactctatcttcatcttcagaacttctaaatgatgctcatggttctcctttaaatgctgttgaattttgatagcaggcaagtcctaaatataagcatcaaagatagtaatcataaaaataaaaccttaaaataatttatttctaccttgttttcatgtgtgagggacaccagctcttcatccatgaactccttggtggataaaacaccatcaataaggctctgaaggtgtaggattttatcttctcttgtatgtgttattgtggcattgcattccctctcttgcctgtacttttgcaactacaaatatgattgaaaatagtcacaatacaagacaaaacaatgaccacagatgattgtcagtaaacagaatcttaccaagcaattgagctgcattatatgagaagtctgcttcgcacagaactcttctaatgccatttctctccttattgatcctgccaaaaccttctctactgcctacattataatagaaagaaatgaaaagtaatagattgaatttaagctataccagaaaatgaagctgagatccttgcacttactttcagaatttgcttctttggtttatcagttgactccgggcaatcaatgggtaccagctgcacatttgagctattgtcaatctcattgacatcaagctgcattcggcttttacagttattacaggtaagcatagcataatcttccttttcggcattatcatcaagaatagtctggactccgacatcaactttttccacaggaataatgagcctggaatctttgggtctcaatgagagactcgataacgatgcaccatgatggtggctatcaataatttcaagaccatggtggatgcttactgctaaattttcagttttagttaggaaatttggagctgtctggctggagagagcagtagacaagcatttctggttaacggtgtttgtgcctaaatcactttcaccatgaaaattattctcagaaggagactgctttaatgaggtcctcaaacttttcctgctgctgctgattgttggtgaaaggctgggaggagggggtttgaggatgggggatgttttgcatttaaccatgccgccagcagggctgtcaccattcattgcagcactaggagaaccaatagatccagtaggggctgaaaaaccagcaaaacctccatttgagttgtggagaactacagcatgatcctcaacaccttcctcatcaatctccatctcctcatcaccatcctcatcaacatgaggtagtgataatgggtgattgagggtaggcttcagcaaattcaaacttcttctgatcaacgctgctgaatgacctcgacttccatcacttggactgtaaccatttgctttaattcgatgaagttcatcctgtttgattgcttacagttataagttatttgaaaaaaaaatgtactggccaggtataaagaaatgattgatcatggtcgaagagatattaccctgagttggcatatcacgtctcgtaattgattcacatcaccgtgcattacttcattgacaactgctttattcttgatagcctttacacattgtgcaaatctcaatgtactaaaagtttctctcttacaactgcaatgttaagccatgagaaataatccagcatacattaagagccagaagttcaaatcactaatggttgatatctacctttgtgctggggaaatagcacaaaccaaagctaattttgcatttccgccaagagactcctgcaataaaaatgtcaacctggagtctctatatggtatatgtcgcagctttcctgtctgagaaacttcagctagaatttttatcaaattcctgcagtacaattcaacctcagtaagtaattggatcatggatgattagaatttggcagtcaggaattttcagaccatggaataaatgccacctaacaacttccctttttccctttccttcacatctaggttttatgcccatttcatatttcatctatcatgggggaatgactagtatctattcaccagcttgagggggaatgttgaatgggaatcacaaatctatgggagattgtttggattgaagatgcaaagagagagaattttttagaacgagtaaacttcagtaatattttattctgatttaaaatggctagattacaggtacttatatgattacaatgcaattgcaactaatgtgatagcgaacattcatttaccgaatccaaaccgctgcgcgtagcttccagctgggttaactacctaaaggaaaactggtccctgtccattcccaatgagctagattgacctaacacactgtatcccaccaactaacatcccccccccccctctctctctctcctaagctcaaggttacattacataaacttgtcaaacactctgatcttgcctctgaaaacatgaaaatgcagtgaagagagaggcacgttgaaagcatccacccccanctgatcttgcctctgaaaacatgaaaatgcagtgaagagagaggcacgttgaaagcatccacccccagtaatcatgagttgggacatgatggagtagtaggctcttgcttagaacctttcccaaacaaaaaaggtatctaactccatttgtttaatgcaagagtgaagcagcagattgtgagagaaccactgaactcaaattgtcacaggatttttaggagtctgaaaaatgcaatgcaatttggtgagcaatgaccgaatccatagaatctcagctgaagtttgggccaagcttctataatcagctttggaatttgccaccaaatttttcttctttgatcaccacaaaatgggccatgtttggataaaattctccataggtatttataggaaaaaaataagaaagtaaaatgcattgagcttctttataagctaaaatcaacttgtatttgtatttaagctatttttcgtttgtgattgctagtaatttgtatttcaattccaatatcaaacatcaatgtatacacacattttaaaccatacccaagctgtgaaagggatctattaatattgccagcttcctttaaacggtctcctgctgcacccgttaatttttgtcgttctgacccagctagatcaacaagatttattttacttgttctaaatctgcttacaccatctgcagtactctgcaaagtgaaaatatggactcgcttcaatacctcttttctctttttacaattctattgtgaagctgaaaaatatcttgccaacagaagttcttttgaaaaacagaagaactgaaaagcaaaagttcattgctaggttccacatttcaatattgcatatgtagtttctcctaaaatttatctagttaaagattgtaaaatgtctgcccttcctatctaatattattaaaaactatctccaagccacaagagaagagtgcatcaccttgcatcgagattcaaccacacaagtaaaaacagtatgagaacgtgaactttcagaatttatactggttgcaccaattcttctgtttaacaaaccctgtataatgaaaggtatataatagtaaaaacacaagagaaaaggacaaaggaaaaccatggcaattatgaaatttggagatctttagaatgtgttaggctcttgagatctttagaaacaaaattataaagaatggagatagagaataggaaacaaaatatagctcttctgtattgaaaaattgaaatcaggggatgactctcctcaaaggaaatcctcttcctccacagagcaacactgcctcaggtgcaactcgacaaatatataatttatttctcaattacagctctctgtttatttcttctaactgactaacagaccaaataatacccactaactacctactcttcttcgtctagaatagatagttacattgggctgtattcatttacagaagagatggccctaacagaatggaaaggaaaaacttgataattacaagcatataagaatggtcaattgtctaaaaaacgaaaagagagagagctattcaagtcagactgagagaaattcagcatttcatttctcctactactgattaaatcaactggttctaccttaatggaaatttttgtttttatgtaatgagtcatatatgctcaaaatgaagctctgccacatttgttacaaaaatacttgttaaaaaaagtaatgaagtactcattcagtgtaatttcaaagatgacaaatttagtttaaacatggggtactcaagtgaggcatgtacaacatatgacccttaaatgttgtttttacttttcattctatggtgaaagaacattaaaaaataaatgtttcaacctgttgattgatggatgtttgacaactgacacgtgaaactctaaatgttaagaaaacaacacatgctaggtgttcatgaagcattgttgctgatgttatatgctgccataacctcttcaacttccacatatttaagaacctgattctctaatgcagtagtaatatataattctaatctttttctaatacttttgttgccatttagcgtgagggaagaaataaagacaaactagtccttgataaatagtttttggatcttattttaatcctttaagaaaatctattttatatttttattgacttctatagtttactcataatgaaatggttgaatagctaaataggcaataggcaacactgcaacagccaacagtgatagaagagggaaatggaaaccacaactgtttatacaagtgtgatgaagcacacctttatcaaaagctgagtcacatctttcttcgtacacacttgctcctctgtaagattttcaacatagacaccagatttgacatcttctctaatctgaataagcatcaaaagaccagttctagtataacctggttaagcatgatcgagggaaaactataatggaatagattttacctgtaggtttctttgatttggatctaatagatctgctatttgctcgttgtatatctgcaaaacaagttcacacatcaaaaggactagataacaaggtcaagcaggacagggacatagaaagaaattatcaacagtcattcaattcaacctcgagaaaagagcagtggcactgatacttgagttgcttgtcagaatgcctaatttgctcctgtgcatgaaacacaacaatgaaaatcacaacaaagttcatataaccatcaaaggattcaatcacaaatagaatagaactcaacactacctcatttatgcaagcaaagagtctttcaaaaacacgaggtgcaaggccttgttcatcacttgctgaattgtcatctgacaaagcattggcaggaccccacatggtataagttttcccactcccagtctatccaaaattttcaaaaataaacataatcaatcacgagtaacaagagaacataacggcacaatgcaacgcaaaatgggaagaaagtagaaacctgcccatatgcgaatacagaactattaaatccagccaagcaattctctacaagaggcgccccaacaagctcaaaaatatccaactggaggataaaacagcaacccagttactatcacaaaatcacgagagagacatggagaacgagttaaatgtaataataaagtaattataaacttgtatcatgcctgagtagcattagtgtgagcaacggaatcaaatgtgaagctctgaccgttgatggacaaggaatcactggaaatcctctgaactatggaatctccctggtccccgtcatcgcatgcaggcctcattctcacaataacctagaaattagaatataaaattataaattaactagttaaaaaagaagaagaagaaagtagaatttggaatggttgttgaccttgacggcggaaccagaggtggggggaacggaatggtcggaaagcttgcgcttaagagggttagggttgggaggttttgggggcaagggggaattgaaaggaggaggatggttctctttgttcttggatttttgctttcgcgtgggtctgggttttctgaaagcgtgtgcggaaggagtgtcccgacaccgaaagattggattttttggaagcatggttgcaattgcagagaacagaacggagaagagaagagaaagtagggtttgggttgagaagggaacggagaatgaagaaagtagccgttaggggggttgggaaatgggagggatttgaatgtcagcgcctgtacggttcttgtgtgtccctgagaaaataaatttattttctagtttctatattgagaaaaaaagttattgtcactgtaaaataatataaaattggatgagaccaaaattggttcttaaaaaataaaaaatttaaatttagtgaatgtataaaaagtataacacattgttattattgaatttgtgaaattattttatcttgtaatatttaaagaataatttaaaaataaattatatttttaaaaattaatttaatattaaattattattaaattatttataagattaatctatcataaaatattaaatttaaattttttattttttaatgaccaatttattgtgatctcacattttcaataaccaaaatgatatttattcaaaataattcttattttttctaatattattttgtttttagtgtttattattcttatttctattgggagaaaaaagaagacgcaacgtgtctctctcttagttttaaatttttaaataaaattaaaatataattaataaattattgtagatctcttattttgaattttttttagataaaaaaaaaagtatggctacttggctagaggacgatttgatttgaagaagaggaaaagttgacgaaatactttttatactcaaatgtgaaatgctatttgcactattgtaagaggtccttattatatctttcattaaaagttttatttcttaaaaaaagtttttactcaatgactaaataataaaatatcttcttatatctttcattaaaagtattataccttgtacaattttttgatcccctgtagttttttaccaaaagatattgtatatatcttctcagcaattcaataatgacagatggagaagcggtcttactcaataaaaatcttaatgcaatacaaccaaaatttagttgtcataaaaaataatcctaagctaagaaaacatttgttttacggataatttttgtaatcccacaaatatagggtaaaannnnnnnnnnnnnnnnnnnnnnnnnnnnnnnnnnnnnnnnnnnnnnnnnnnnnnnnnnnnnnnnnnnnnnnnnnnnnnnnnnnnntttttttatctcatatttgttatttattatgaagtgataaaataattaatttcaaacatatttcatttcaatgttaagttataattcacatgtaactaatatttaatttcggacttgataagatccaatattctaaagctattttcatataatccaattgagacattttggaatagatcaaatttttcttaatatcttgttgagcaataactaaaacagttcctaataataccataatccaattgagacattgtcttaccaaatttttctttgttgagcaataactaaaacagctcctaataataccattattatatctataaaagttattccgttcattgttgaatgtaaaactatgaaaattcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttgtgataggaatctctttatgaataaaaatccaagcaaattctccttcctaccctctcaatgctcctttatgttacatactataattttctctttccacaaatttcattctttactacagtctttcattcctatgtgcccaattacattcacgcaaaataggcatatattggaatctctctctttatatatactcgtgaaagatactcaattacatactgaaaggtgttatgtgtatgtaatgggctgaaatgaaataacatattaatatacttttaataaaataaatattcatagtatacattgatatgtttctatttcagcatttctctgaatctgaacgaataaactatccataaatatccttattatacttatatctattttattttattctgtttttgagaggaaagaaaagtctgtgatgtattcagcacagaaattaatgaaaataagttactgacacgaaaaatgtgtcagtaatgacccacaagtatatttctgaccgatataaccgtaaaaaattttcatggtatcctttactgatccacaagtgtattttccgttgaaatttttttactgaaaatttcccaagactttaccgacagatatatttgtcaaaaatttccgaccgattaacttttcaagaaattgaaaattaccgacttcggaaattccagttttttttattggttgttagataggaaacttaattaacatttatgcaaagttagaaattgtgagatttattttaataattataatataattctcaagaaaaaataactcaatcaaacagacgtgttttatttatgagaatataaaaaacatttacagtcaattttaataattaactaaaaaaaattttgaccacatatataaggaacccaaaaataacattgtcattgtcacgttatattatgaggaaaaattaaataaattcccgagacaaaaagattgtccataaaataaacgtcttaattgaatacacgcctaagattctcaaacattctaatttcttgagacaaatgcattttcttactattacttcatgttaatgttgtttaacgtttataaatgataataaaagttagagaaatgatatttgtaaaagtatcacttcactaaaataaaatatgtccatagtaaattaaaaaaaaaaaatagagaaactctatattcaaaacaatggaaatatgtcaaactagtttattcatatctgaaacagaaactacaaacatatatttgtctcttcacaagatgtattggtattactacgattagaaggattaaagcataataaacaaattaagcatgttattatgagttaaataatagtagttgaaagggaaccgaaattgatcatatttcactgagtggaaggagcgaagttgagaagctgcttggaaccaagccacggcttcaccaccacaacggattcgaatattctggaatctccaacgtcgccaccctgcgtggtcaatatcttcatgtagtacttgatcccagacaccacttgttgttgcgcctccaccacttccacgaacgtgacttcctcctcctccttctgcgcctgcctcagcatccggttatgctcctccaccgagaaccgccctaaatcctgcacctccttgttcgccttcacgtcagggatcttcgaccttcccccgaccaatcccccgtacgacgccgtacacgcgatgcatgccgagatcgtcaggatcgccagtgtcaccgccggtgaccttatcaacgccgtcatcgatcgctcaattatgccgaacctgttagaattaatttagaacgatgatggagttgcatatacggtgtcgtttatataaagggagaaataggtgtttggatacgcatgaaaaactaaccgagagaaggtgaatggcatggggaaacggaaaccgcgtgcgtgtcgcgattcggatgcgagttttggacggaaatgagattgcttttttctttttagtttgttcaatgttattgccgtattcgagttgttggtgtggtgtgtgtgtgtgtgcgcttttgttgttaggttaggtttgggagcagatcacatcgtaatcgagttgtgttggtgatatgattgatatagggcaatgcgagagagagagtcagcacagtgcacaggagcaataacgaatctagtcatgatcgagtgtgccaagcgtaaaatagttggcttggtgtggtttcgacaaactgacacataggctcgcactaatctgagaggcttccacgtatactccacatgcagtttgcatacaattgagatcaaagttttaaaaattgatatgagctcatactttcacaacaataaatacatttgagagaaaagcatgcattagatttgttgttgagagataaatattaataatgtataatacttatttcatgtttaattttattccaatataaatcgttcgtagaactagaattgaacgaactagttagaacatttaagtgtacatgtgtaacctactttcgtctgagttcaattccacattatatcccttatcgtgtctagggtcattaattctgatattcccatgcgtgactatccacacattatcatctagtcgttaccttagatctcgacggctaccacctaagtaggtttgtaccagtaccataaacatgactttgagataagactaaagcgttgaccgttgctgtccttattaggtcaatcggtgattaggatggtacagattttaaaaataattatgagatagagtaaataataaaataagtagatgacttttttcgtgtatatatagactccgctcaagctttttgttgtggtggtatttttcgtgtcttttctcgtatcttttgtgtttcatccaatggttgacctataaactatcaaatataaagttagagtaaaattttgcatgtcatttgtattctgcctcactcttgtgatgaatgattactttataacaaagttcgtattaatacgaaagaaataaattaggtgaattttaatacgaaagagataaatcaggtggaaaaaggagtaatatttgtagtttttgctacttgtaacttgtaattctagcctaattattaatactttctgtaaaaacaaaccaatcattaatactactaatgattaatttattatcacgattgttaattctaactgaaaaaggctatagagacgtgcatggctatgttcaacaatactcagccaattccaaggggtacacgagccccattcctgagccagtaaaggggatgactgatgaggaagaatgacaaaaggcaattactaccataattttctaattaggtaaaattacctcaattgcttttattacaaagatgtattttcttctttcttggtacataagttttatataaattaaatgtatcacaaagatatgtgaaagtgtatgaacataagtgattacatttggtaaatgtttatatctcgtggagataaaaaagaaagtaaaaatcatgcaataaaatgtattaatatatagatatggattacaagatttaaaataggtttttaatcattaaaaatttgattttagttcgtgtcatttaaatcaatcaatttgatttctatatttttaaaaaataggtgaatttaacttttgtttaattcctcaacaaatcgatgcataaggattaaatttattataagattaaattgattgattttaaaattatcgggactaaaattaagtttgattaaaattagaatgaattgaatttgcaaaacgtcatatactcatattatagagcttcattgcaaacaagttgttgactcctatttatccttatcacccgataattcaaagctaagacgtgcagattattcacagatgcagacaaaagcttcttgagtttcataaccttgaggtgcgtttaatccgaacacaagcaaatcgggttcctcattctctcgcaaggctatcacgactgtattttaaccaccaccatgtttttgaatttattcctatttgtattaacacttttatcatggatgaaatgacataattaccttttgcgtaaaaaaatatgttacaggttaaatatttttttttgtatattctttatttaaattattcaatttaattttttattttcaaaatactcattttgatatttaaaaaaaaaattaatgttacctttacatctgttgagatttttgataaacatgtatttcctttaaagaaaaatagtttttcatttaaccaaagtcctataatatcatgatcaatgtatatgctaatgctggagttcttcatcaaatggagaaacttttccaggccatgcagaggcaaggttatttgcctcattctttcacatatctctcccttctccaagcatatacaaggagcctgaattattctaaagccgaggaaaccatacatgctatgcaaagcaaaggcattccactgtcttgtgtccattttaatattttactccacgccttcataaaagctggattgattgattaagccaagagggtttatgaggatctatatataaacttttggtttagttcctgatcttgtatgttaccgaacaatgccgaatggttacctgaaatgtggatatgtggaagaaggaatcaactttttttaaagtatttgtgaatcaacaaaaggcgacaggttcatcatgagtgcagctgtgcatttttacaaatccgttgggaaggaaaacaaagctaaatattaagttcaatgaacaacatggggatcccgttcctcaagaaatttgaagttggataagcagagagtagaaactccatgagatctaacctgcttcagaaatactagggtatttgaatggcattataataatggacaaaggaatttgtgactagagaacatataaatctaatcaacctggtaatggcgacagtggatactacatgtatatttgcttgcgattatgattgggctcttagttcagaaggactttgcctgttataaggaggacctgatccacgtttcatatgcagcttttgccttttggctgcttttaacttttgtccgaccttcctttaaagatgaggttgaagaaagaaatgcattatatattccatccagcaaacctttgctataaatgatgagaagacagttctcgaagctcatcggaataaggtggcccctacttccaaaatttcagcggcagagcattttatggatgaagctcaacagtagaaagcagtttcgaaggaacgggttgaggttgaagaaagaaatgcattgcagagactatcgggtacaagaaaggagcttgaaaatgtgaggaaaatcaaatcccatggtggaagatcatagaaatgttccgcaagaatttgagcacaacagcattgtcgctagaaatccaggagaacttgtttattgctttgctaaacggccaaatttattatgtttgggaggctacgtgttattaaattgtttactcaaattctacgtagattaacacttgactcaaaatggaagacttgaagctaataaattgttcagtctttttctattataataaaaaaatactgtttagtcttttatcaatttgattttgagattttaataatctttttttggatcttatggtgtcatcttttaaattttttactttaatggtaactattattttaagatcttaaacttttttgaaaatctaaaaaaaactcatcttttaatatttatttataattattttaaaataattaaaaacaattaattatataattttttatttttaaaaatttataactaaaatacaaaatttatttttaattaaaatatttatttatcaatataatttctttttctttttttatttctattttctttcccacacacttcgctatgtccccttcaatccacatttctcgcggtgctctggaacttccgatcaggccatggaatcgtcttcggccatcacgaatcaaccaccatgtctctatgcactgttgaattattttattatgtattttgttttaaaattatattattatgtactttcttctggactattcaatattccttgtggttgttgatccacaccaacccaatgtccttttttcttccgaagttgtcacggttgtgattattttattgttatgtgttttattttaaaattaaattattatgtactcaacttttttctggactgttcatggttgttgttgatctattcccttcttcctttttgttgatctatttcttcccatctttttgccagaattatttagggaaagagaataataataattgattttcttaaaaagcatagagattttcgaagttatcttataagaatcaaacctctaatatatgaagattttgagaatgtttgaaagaacaaaatcttccccttaaaattctctccaaaatcacccattgaagatgacctaaatttcctcacaccttggtcttcgaaaagtttcacataaaaccacttcgtctcgtgatgtgatcgcaaaagccctgtatatgacttctgtggtagacaagacggttgcattctgattttgtagcggtagaagaagaaggagctaataatttgtttacaaactaggcttagagtagcgaaaagagcctatagtatgttactcaagctgcctcctaaatttttgaatacctattatcaagtcctggagaaaaatatatgatacgtagctacgagggcttgccgtgtcagcgtagttgattgcattgcaattttagaaaattcttgacaccgaatcctttgtttaataaacaataacataaactaaactataattgaaaatctcagtgattcagggaacaaggagacatttagaattgccaaaacttgcttcacttcatttcttattagccatcagtatacatagcttgaatacgtacttcatatgaaaatatgcttatgagccatcagtagacaactgacaacctagaccatatgcatttcttcatatgaaaatcacacaagatatgagaaagctatttatgtgaccaagacttcagacgacacaacaattggaatacgtactattatggtacttgtatgcagagacgaccgcagacagaggtatcttccaaatttaagctttgctgtcaatagtcattggcacaggctcctgctttgctgttgctgttcttgcttgttctagtttattcatttttgcaaatatgctgccgtaaaactgcgcgtccttcttgttatgttctctcaccttctgcttcaaaattttgtactccatcttgacatccctgataatatccatcgaacagtggttaatacaaaaagaaattccatgtatcagtgttacctatttagaactaaagtatatgaactgtatatattcaagttgataacacttgagaacaaaagcatacctattgtctggctcaatctcaagggctttcttaatatccatctcagctagatccaaatccacaagatgaagatacgcttgtgccctccgatacagtgcttttacatttctactatcaagctctaaaacctgcttgataaagcaaaagtcagatgtcaactattttcactctattccctttttgaatcccgctaaggctaaggctaaaatatgtttccaatcattacaaattatataaaaaataaaaaatacaataacataatttgtgatatttttaattgctataaattataaattaataataaaaaaaaaaacaagtcaccacctgaaccatcaccaccacacctaaaccaccattagcaccacacctgaaccaaatacgtaccacctccaagccaaatccctcccaaatcagaaatccccacccccaatttgaaatcctagcccccaaatcagaaatctccaatcatgacaacaccaggactttgccgcactcgtcggtggtgttggtggtccggcgaggctatggtttaggaagagggtaagtgaggtggcgggagggagaagaagaggctttaggagagagaaacgggtagaagagtttttaacacgtgtctatatttcattgtctaataagtcagcttacttgcaaagtcagttcacatgtaggcttggagttaatcgaatccaacttcaagcaaaaaataaaaaaaaggcattcataaaatacgaggacaaaaaacacaacataaatatcgtaggaaagaaagtaaatctcttaggacggagtatagggtgcgtaaatgaaaagtttcgtctgatgcaaaaataatttagaccgttggatttaaatatctcatcaatatcaagatgagatgatgaagtggttatcggatatgttgggaaaggtagtaatttttattcagttgtcaaatgcgcataactggacatcgcctacaggctacaatttttcgggaaaggtagaaattttatttgaatcaccggacaaagcaaaatcaacaaaaaaatgtgaaaaatactgaaaatttaagtaacttgattataaaaacacaaacagttttattttgtcaaatttgtatacttttttttttcaaatttaaatattcacacaaattaattgttactacaagtttgaaagttattttactttttcaaaaagttaattagtagaattttgattatgatcatcatattattatcttttcttattctattgataagtctaacttacattgacactgtcatatcatataacaaaataaaatcaaggagacaaataaaaactaaatatgaagacatgagttaggaggaaggaaaaaccaagcacacaatgttccactttggctcactctctcattatgtacaaattttactaattatttcatctctttttatgttaattagacttaaaataggaatttgggtcaattaaattaaacgcagggtcatatatattctaaacttttgacataatcgaaaacctataaacttttgacataatcgaaaacctatatgaccctacgttcaactcaattgacccaaattcctattttaagcttaacaaacaagaaagtataccatcaacataagagactgagcaattagtaaaaatagaataatatgtacttgacttttccttcatcagaactcatgttttcatatctaacttttatttgtctcctttatttattttagtatataatctcaacgtatcttagacttaccaataaaataaaaaaataataaaatgatcatcataatcaaaattctatttattaaactaattaactttttggaaaagcaaaagaactttcaattttttagtaataattaatttgtgtgaatattcaaattcaaaaaaaaatataaaatttgacaaaataaaactatttgtgtttatataattaatctatttaaattttcagtgtttttcacatttttttttttgcttttgctttatcaggtgattcaaataatttctacctttcccgaaaaaaatgcagtccttgactctgttactgtagcatgtaggcgatacgcatttgacaactgacaaaaaaattattacctcacatcacactaaacttgtttcgctcacgcaccctagactcagtcatcttttaggttctgaaaatatatttagccttcagccaaggaaaaagaacaaatttaggctgaatcagacaaagaacctttgtgcacatcttctctgcctgcttgtagtcctttagcttcaccttacaggctgcattgttgaggttgcatgtgattttcaatgtcttagtctgcagtttctcctcatcactgaaggaggaatcatactcgacaaacttcatggcctgtcaacaagagaaaaagaacacctattgttagttcatttttaccacaacataaccgtcagtaaccaagttacataaataagatcttttggaatttataggtataccttttcatatctctttgaagctctttcatatttgccaaccttaaacaaaacattcccttcttcctttttcttcccagctgcctcaatcttctcttgtgtattcagatcccacgattccttttcctgcacccccattttcagtaaatggttttacatttcaaattagttcaaagtttaagacgaagaagacatgataattctctcacttctcacctttacaaaggaaagcagctcaacttcatagtacacagtggaactaggaggaacattagccaattcctgagaggacccagatgggccaaaagcataatcaggctgtatgatcagcaatgcaatttcccctttcttcatgttcttcacagcttggtcaagtccatcaattacttgctctacatggtcgatcaaacatacaacttagtaactagtaatagaaaaagcaagacttatgaagtttaaatgattgttagaggtaccttcatcaattttgaactcaaatggctgttcatcatcgtagcccttcttaacgaaaacagttccatcttgcagcttgccaatcagtttcactgaaacaaaagaaataatgaaactcttcagcatcccatccagtatatacaaaacctttaaatgaagaaaggaagagaagggattgaaaatattgtaataaaactgtaccttgaactacagctccatcatttggtcgttcatatccctccccttccttcaaagtcttcttgagaacctttctatccttggtaatgtcagacacggtcttccacgagaccaactcaagatccacttgaagagaagcatttggaggtaccgcaccttcatctcctgaggctggccttccactctcaccaaatgcatctgcaaaaactttgaatgtcaataaacttgcacaagcaaaacgtgtagacataagtattgctgataacaacagtcttactcacattgtggtttcacattcaagagaactttttctcccttcttcattgtttttacagccttggccatagcaggacaaaaataccctgcatgataaaagaaaagaaaaaagtcatattattgttacttgcaacgagaatcaagttacacggtaaggacaaaattcaaacttttgaagcatgagactgaccctcttccacagtgaactccaccccatcagattttgaaatgactgtcccatcttcaagcctagcttcaaacttaactgcagaaaagagagaaagaaggaaactttaaacaatactgaaagtgttgctaaacagatgaatctcaaagacaatacaggatagagtttcgtaccaaacacttcatccaggtccttaggattgtcccatttctccccttcagtaataatgttcttcaagattcctccatccttgcatatgtccttcacacttgtccaagatagcaactccacatcaaactgcagagttgcatttgggggaatagtaggaggagacccagactctccataagccaattctgggggtattgtaaaaagggcattctcacctttcttcatggttttgatgccttcatcccatccctttatcacttgccctgcattaatcaagtcacaaaacattaaatactatagttattcattcattcatcattaatcactttagtttaattttcatgtccagcataaggataaattaaaagactttcatcctgattacatttgtgatttattatgtatgtaaatataacattaacaactatttttttaatcaatgaatgattattcatctacatacagagtacagacaataccagtaacaaaatttcaacttaatacttcatcaattactcaaacctcccataactaaattgatcctaatcaatttttcacttttaagcaaagaataatatcactcagcaaagaattttatatagtcgatcaattgaaatcctctctatataaaatcaataatccgcctctacaaaacaaaagaaagaaaaaagaatgcgtaccttggcccagcttgaacttgaagggggtgcccctatcgcggctggaatcaaatttggttccatcaagcaaggttccagtataatgcacttcaacttggtctccactgtcaggggtgtcccaaccttcaccttcctggagcaatttcttcttcagccccattttcccaatctccttctcctccccgacgttcaggatcggactctcaaactcttcctcctcaggcatttccatgttgccagcacttgggaactcgaagtcttcgtccatggcttcccacaacaagcgaataaatgagtacgaaagaggtgagttcttagaactcagaaaaccacacgatcacagaaaataatttttttatatttctcacacgatcacaagaaatggtttacggttatcatgtttatataggtaggagtggaagaggagagtgtgtctagagagttctataatccaaggttgtcaagatggttccagaattatcgtgttcgttccatttattttttactattattgtggttatgatgaccaggggtgcctctttatatattttaaataaataaaaaaagggttaaaagctaaataaaataagaaaaaaaattaattaactaaaaataatggattaatcattaaaaaataattattgaaaaatagaattactaaaaatatgtatattaaataaaataatttttattattaatatagttataaattataaaaaatataatttatgttctaacatttataaacaaattttttcatcttttttatcttatttacattttttttctctttctttatcctatttttatctataattggattcatttattactaattttagttaacttcgaattaaaaatactgttgacgttgaatctaactaaaagttgagcaagttttttctttattttatttttattaatttgatttggatatcagaatctatttatatttaaattctatttttcaccgggaagttgtaagtcacacgatattattttagtttgataaatatttttgtgttaaatctttattatatagttgtcttaaataactatttttgacatgcctctttccccctccttgctgatacttgaatatattgatcatgttgtattgcagttaccagagcccaaacggtcaatcagtgcttcgagtcaccatagtaactagaagatgggtagatgttgctgtttgctctgaggtagtttcagttgtttgtttttatatttgtggctaaatgttagtttatttctcattgtcaaaagtatagttgtagcttctacatttatcataatattctcttgactctttccttgctgtcacttctgattctaaactttggcatagttatctaatgatttacctctacatgcatctataatataaactgaatttttatgtctaataccttatattatatggaatttgggaccatttttttgtgacaatttaattgttaaattgattaataaataatgaccaattttttatatccatttaatagaaacagacctgtttcagttactgcattttgtaagtattggataaaaattcgtgtataacaaaattggcatagaaataactatagttggcaaggtcatattgtaatgtgatagaactggagcagaaatagctgaatagtgctgcattgtcactgaaattctactgctgatgtcagaggactacggttgcagagaaacttgtagaaactcttttcctcacttcctcttcagagaacagaaaagaaaatacaatatatctaggcaatttgagaggcctggttctcccatactgtccttactcctttctcaccactttttgttttccctcttagctgaagcccaccataactttccatgtttgccacctgttcagtgggtagttacatgaggtcatacctgtcacactacctaggtgtgggattaaattaaagttgcctctctttcctttctcaaatacagcttaaacttaggatgcctggcataatatataactaaaatggtgtctccaagcaagtgtgcgtgcattgcacacaatgtctgcattgcccacaacaaacaaggaaggacaagccgaaaattgatgaatatatatatatatatatatatatatatatatatatatatatatatatataaaaaaaactaatgtatcctgatgccagaggctcctcacatcgtggatgtatggtggagggtaattgtatgcagccttctccttccacaaaaattgttgaatatatgtgaaaaaataatagttttagggttatgcttttctatattgtcatttagcatgctgctgtatttcagtccattaatgcattttcatcatttaagaagaatgcagttattagaaaagagaatatatattttatctttaggaattggtccaaggatatgaccaagagactgctgcagtagtaatggccagacttgcatctcttaaaatggagacaggggtatatctcaaatcatatttggagagcgtttccctgttcctagattggtagtatgtgatcaacatggttctcaagtaagtacatgtattacattgtttccttttcctgaaatttactagtattgtgagtgttgctgatgtatgaaataccactttcataatgtatgagcagaaaattgtttcattaatccattttgcttggtaggtttagatttttcttgatgagaaccttagttgggtttcactgaagttgaaaaggctagattttttttattagcaaagctgaatccctcagcaacatacaataacgcacatgagatggctgctggttcagatgtaatcttcactgacaacgtgagccttcaagttgtctttgaggctcgagcatctgcagagactggctgtccaatcctgatagtagtgactgacagttacgggttttggactttggtttggacaatgcaccaatgacgtattctacgttttgctgttccattcagttattttcttttctttgttcttaaaggagagctggtcgtagcccatgcctattgaggaataaagaaagttgtgaaatgttattctttagggctatggtcggattttgttcgtggagaaataaaggcatcgaaagtataccctatgtttggttaggaaggaaaaaaatggaaggaaggaaaatggaaggaaaattttaaaatttgaatcggaaggaaaatggaaggaaggaaaaatttaaatttttgtaattaaaaaataatttttctttccattttctctccaaacaaacagaagaaaatgtttcgttaattgtgttttctttcctttcgatttctttccttttattttctctccgaccaaacggactcatagagtttggccctatgtttggttaggaaggaaaaaaatagaaggaaagaaaatggaaggaaaattttaaaatttgaatcgaaagaaaaatgaaatgaaggaaaaattaaaatttttgtaactaaaaaataacttttcttcccattttctcttcaaacaaacagaagaaaatgtttcgataatcgtattttattttcttctgatttctttccttctattttctctccaaccaaacggacctcgggtgttgcagaaagaaaggataatgaaatgtaagttgagagctacgtctgtgacagcaacaaagcaaatgagggtagtttgatcacactaggttgcagagtaattaaagtcattttgtgatgttgtggaatttgatagaattacaacaatatttgcaattctgtatatgaagttagcgttacaggacacatcctggtgaagtaaatactttttttttcccacagtgaacagccggtctcaaaatgtgatctcctttatatgaaggattgcttactgattgctgtgcaataagtcatttttggattaaatcattcaatggtgaaaaaccaaaagtttttaagtggtttaggggatctttaagctgacaaaacccccttcgattagcgtattactcttttataaaacattcttttttagtttttggttgtcaaatgcatgtggtgaaattcaatgttgttctataacaacacgttataattaattcaattttttaacttttaagagttgtcttattcacaataatttataacttatttttctctatcaatttctattaaattattattagttacatctcattttttcataatttcattccctattttaaattttgttgtcaaattgtacagataacatttaatggcctttggatttaccatgatgacattgtagaacctatttggtaaggaaagtgataaacttttactaaaagtatggacaccagtttctgtaccaattaagaagtaatgcattataagtcaagtgcaaaactttagtgaagcaaccttgagtgtggagtttttctcagattcatattatatttggccatttaatgattatgctgtgttccgggcattcaatcccggcctcaggtttctacatgaaaaaattactggcataactttcatattacttgcagtggagcattccagaatcatgttcctggtcacaaaggcacatcacataatgatgacatccctatgcaattgcaggggcattcagcatataagcaaactacgataaaattcaggtcctcacaagtgatgagcataaattgatcaatcaatgatctatcatccacaagttaaattataacatgaaatgaatagttcagatagtcaaagaagcaattcaactacaatcgcggtcaaatttcatcaaaatccttgttgccaatattctcacagggaaaattgttaggtcttcaaatacaatctagagaacctaagaaagaacagattgatgtaaataattgcagaaattaaaatatccgcaaaattattttttgtccaaaaatacaaaaggaaaaagaatcacttctttttcttaagttgtttaacatttttggcattggcttgttctctggtcttgcgtttcctggtgagagcaaactctccaaacttatgacccactttcccctcagtgatcctacaacgaatagtggttttcccattgtaaatcttgacagttgtatcaacaaattctggcaagacagtggatctccgtgaccaaatggtcttgttcgacaaaagatttgggttcttcttcatcttgtacaagaatgcatcaatgaatgctggtttgcgtgacagcagaggaggagacgggggtggcttcttagcgacagtgtttgctgcatcgcctacaattccaagaaactgcttggttagagccctaagcatcattgtaggcctcattcttcctggtcaaaccaaaaaatgcaaaccataatattaaactacagaaaatcaaaccatcgtgaggtcatttacagatatactaaaggaaacggaatgcaatttttgcttcaattttgttttatccattcaaacataatggccatttggagaggcttggggtttttttttttttgtgccaaaatctatttttcttttccatataaagaattaagtaaatagtcaaattagtccttcaatgatatagcgtaggtcatatcagttcctgaatgatagaaattatgcttaaaggttcttgaatgtgtatttcttgggtcaaatcagtcctcatatcacaaatctcagagactaatttgactctgacagaacacatatcgagagatcaattcaacaacgaatagtagcatgtttggttccctgctggtgcactttccaaagcaattaagcaagaaagcaataacagagttgctttgaggccaatgtaagttaaacaaaaagctttaaatacatatttggggaccgtgaatgtaaatttcacaattctatattactgatgtatcattttggcactaatttgattatttactctttcaaaataaaaaatacttcaaaataaaagcaatatattacgttacttgtttatttcaacagaaaacaaattgagtaacaaatttgacctaacaaagaagcattgaaattaaaactcaccccgattcggtctccaatgctgaaatccttctgctcgctctgaagaaacacgagaattaactgaggaaaacgaaaagaaaaataaacgcggttaggttaaatgaaaatgaaagcaaaatagcgtcagaaaagagaaacgcaaaaatgaagaagtgtgtgaatggcgagagaaatgagatgataaaacgcgattcccaaacacaactccgttgaatttcccgttcgagagtagtacaaaacccgggaacgggaaattgggaagacagactcacagtcgcagtaggaactagaaagcaaaggcgagacagtgtatagagaataccgcagataacgaaatagaagaaatcgaaagaataaggacctgatcagaaaatggaggaatggcaatgagcggcgacggcggaagaagccactgaaatggttgccggcgggaagaaccaacggcgttagggtttgggttatgaagggaaaggaaaggcacattttgacgtgctttgtgtattatataaggttcgtgttcctgactttcttctctctcctttttttagtggtttggtgtgtggcttaccggaagccactaaagtatcctcctattatttatttacttttaaataggttggtgcatataatttttatttttattttatactgatgcatgtaactttctagaaaccgcgtaagaatattttattaattttcattttattatattctttaacctacttatacaaaaaataacacatatcctctttccattccaaaattatagtcttttaagattacgacatactctttccattccaaaattatagtcttttaaggttacgacatactgattaaaaaatattgaattgatagaaatttagataaaatacgcttaatttttcaactattttttatcataaatcatctcattatccaccaataaaaaatacattctactacttattacttatttttatgatatatatctctttttaatgcaaatattaatggatcttcttaattacactatccaggcatatttttagaaaattaattttaagaaactattattttggaataagaacaaaaagctataaagaaattattattttggaacggaagagtatattaacagagaccgtgtcttcttgttttgttacgcaattaatttaggttcttgttctattttagagtcacagctatggaatatttgacatgggttaaagctggcttagagtgtaaaatttcaaaagctagttgcttactttgactacaatgccattaatttctttctaaaggttgcggtgatttctattcttgctataatttggtgatgtctattcataatattcatcaatatgtcaagttgtgaaatcatgtttatagaaaagcaaatcaaattgctgatatttttgccaagcgtggtgatgttgttcataactttcctgttaacgccttatggcagaatcagcttgtatttcttcattttcttttttaggttttcagttcttatttttttttcttctttttataacatattttgtggcttatgctaatatatttacttcacaaaaaatatatataatcatagtattatgtttttgaataaaaaatcatatgcacttatcaaaatttagagttgattgaaatcaaaatcgacataataaagatagattttataatcttttgcattggattacatctaccctttacgaaaagaatataaggagggacatgcaaaataaaaaacaaaaatttcggatacttgattgtaaatattattataatgacataataactcttctacataattcattacttataaataatttatttctaatagataaataagtatatacaatttgataaatagcttggataaaatttgtgctcttatattagagttgacgaaaaagactaacatccatattttaacataagttcttgtcatgttaattttatggactccaaataatacaccactaaagaaaaccttttcttttttatatttttccacacatattacattatatactaataataacaaataaacacgtaaatttatagtactctttcattaaaagtcaagctaattaactgacttcgttcattttttattttattttatgattgtagtccttttttatgattagttagttcataatttcgtattcaattcttaattaaatattagaagcaatactatataaggttgtatattacattagatatatnnnnnnnnnncacaatatccatattattgataaaacaatttatttgatacgtgaaaaattcttttgaattagattaactagttatattaatttctaaactcaataggtcagaagacacgtgcgtttaggaaaaaaaaattcaaatactatttttaatttagaaggaattataaaactattaaataagcatttaaattagaattcagattgaccaaattttcaaaaaagtcgtgctaaacgttaaaaaatcttcaagatgacctatagagtaacagattatatttaaccatttttattttcaaaattaagtcagctgcttggcggtgacccaatctattttttcaatttctccccccttaattacgataaaacaaagcaataaaaaaaattaaaaagtatacaatgttttaaaagaaaagaaaaatcaaaagacaaataattagtcaaatataggatgcacaaacatatgcatgatgtgaaacgcggttctgaccgaacaagtcgacaataatattaaaaaaagaaaatactaagaaacggcactgcctcagaaaggcagaaagtggaaatggcaaggcaccagctatatatacgtcaatccactctggtttttcccataacacaacaatcaacaatcaagaatctctctttttccattttcatgtctcttgtcttcatgtaacacaccctttctcttttctcccctctaagaaattctgagagaagaatagaaaagagggtgaatggttttttgagttttgaagaatagctgcatggggaagctggttgagattcttgaccaaggggtccggattgctgcaaggtttcactctaattgcccccaaacaggccgtaagtactaccaccctccatccttctccgacaagcacgaccaccactaccatggtggtgccaccacaagcagagtccaagaggttgtggcggcgaggagcgttgacgtaattctttattctgtttgacagatccatatttgtttatttttttggttgttcgattcaatcattgtaaggcgattcatacatgtattttcgagctcaagttgatgcctagttaaaatattacaaacacttttctatgttatacttatacatgttgattttaattccgtatcaaaaacattaatcgaactttcctataaaatctctatatagatctggtgattttacgcgtatgacaaaaatcacttagaaatttgttgactaaatgtcttcaaaggcttacaaatcctcatataggtcgtattgattaggcaaaaaaattcccataaactcatcaagatttgaaccccagtaaaggtttcttattaaaattgaaacattttcgtactgaattgaaatataagctcagtttgcaaaggtcaacgtttgattgcaatggttaaaatatgctgaaaattcagacaacttccctgttgataatgataggactaaagccgtctgcaaaaatattcataagtcataactatcattgtttgacctgaaaagaagttcggctcttacaactccatgtctccatccaacataatagaagtagtaaaatgttctccccaaggaaaaaaagaagagggagagagagaagtaacaaatggtgcagggaagactatatcgaaccgacttaaaaaatgattaaaatcaaaatggaggaaacatcaacagggtaaaatgtctgttggtgaaagccatcactactaccctgctgtagcctctgactagattgaagttttaaatacaggttgtgatttcatcacgtttcttgatattgctggaaattgtggagaaatacagtcattgcaatagcaattacagtcacagacacccccgaaaactttgaagttgtgactgaaattgtggtcatggactgttttttaaaaccttgactacgagcatatatgaaaaaggtacaaattaacagaacgacacattatgagtaattctcataaatatttattgtagcgttttgtgaaaatgagcaattacaaaatggtaatgtaagtaaacactttttgttgctaaaacaggtacacttctatttaaatattaaatgcatatttgccaccattttgtcactgtgataattgacaatggattgcagactcagaagtgtagagcaaattggagaaacagaagaaaactagggagaagaatctgttgccatcagaacatatatctcattgcaattggaagggtgaggggataactgaaggaggtgaaaaccataagcaccaacatggtttgtggtcccgaaattgcccaaggcttcctgtaaagaatattcagaaacagaatttgaagatatgactatgcttccagataatgaaccttgtatgctactaataattcctctgccttttctctggactgtgatatatacttgtccaagaacacctcctcactcctcagacaagcacaacaaataaatatacctgggaaccttcctgcaaagttttttttttttttttttatcgagagctggaagactctatatcggggaagcacgcgatccttcatgctatacattaaaacccttggctgatgaaccaggactgacttgggcatcataagtgtatgcaagaagaattccattccaaccttcaacttcttccctgatgttctaagcaaagttgggggatcttctaaacattgcaggccttcctcattggaaaaatcgaaacaaataattagctccagctttctcctaaatgttttatagctcaaactacttattgaatggattacatggacaagcattcttgaattttcatggaaacccatgcctacagtgcgcgaaacatagtttcctatagtagactgctgtgtgatgagaatacttggctgttgtttgagtagcattgcaagatgagacccaacaatgccacagctctccaagaagacaacattggccataatttttttgtactttgggagtatatatatatatatatatatatctttctcatgtacaaagattattattgatcaataatattttctcttcattcttttctttcatccttgtatacttgcgtcttccttgctgcttttctatgtgagcctgatacctttcatgttatcagagcacatctacgatccatggactccatccttgattctcctcggtctgagacaagcaacatgagcacaccagcaacaaaaatcatcatgaaatctttttcaatcccaattgcagacaaactggatgaagagagctttctgccatggcagcaacttgccttagcctccattcatggtcacaatcttcaagaccatcttgataaagacaaagtccctgcacagacattagaaaaccaagaaagcataatggaaaatacagcatacacccactggcatcaacaagataaccttcttgttcttggctcctctcatcaatgaacatggcattcaaaaacagaatggtaggatgcaattttgctcatgaaatctggacaaagctctagacttatttttcttcacacacacaggcaaaggtcaagcaactcaaaaatcaactaaagtctatcaaaaagaaaggctcagcttcagaatatcttctccaaatcaagaaaatagttgactccttaggagctgttggagctcctctcactgatgcagaacactctgaggctatccttgatggattaagtgaagagtatgctcctctaatcacatctgccatgtccagatctcctcctttctctataattgaattggaagcattcctattggctcaagaaaatatgcttgaccgtttcaagaaaacagagattacccctgttcaagccaacttcagccaacgaaacactgcacaagattatcctggaggtcgtttctcaggtggacgcagaggtagaggggatcgtaccttcagaggtaatagaaacaaaggttctttttggaatcaaactcgattacaatgtcaaatttgtggtaaacatggtcatcctgcattaagatgcttctaccgctatgacaccacatatctaaacacccctcaaggacctcagcaacagtatcctcaaaatcagaatcagagaactccacctccacctccacctccttcttttcaccatcccacatcctatctagcaggtcccgcatctctcattgacacagcttggtatcctgactctggaactactcatcatctcacgcatgactttggtaatctctcatctggttctgaatacaatggttttgatcaggttcatgttggcaatggtgcatgtatgcctatacaacatgttggtcattcttctttcacaacttctcactcacccactatttttaaacttgctaatcttttacatgtgccttccattaccaagaatttaataagtgtctcccaatttgccaaggataacaatgttttctttgaatttcatcctaatcattgttttgtaaaatctcaggtcagcaagaaaattgttctcaagggcactcttaaagatgacctctatcagttcaccaatgtccatctaaattcacaatcttcagttcaaaactcacccattgccctgttttctgcatgtaattcctttgatctatggcacaaaagattaggccatgctggccctaatgttgttagaaatgtattaaacaaatgtaatcttccttctatagttcaaaaacaatcttcagcttcctctgtttgtgaagcttgttgtttaggcaaaatacaccaattacctcattttcactcatctaccatgtataattctccacttataatattttctcttcattcttttctttcatccttgtatacttgcgtcttccttgctgcttttctatctgagcctgatacctttcatgccacatctgagcaaaacatgaataaaatctttctcactgcagagaattttcctaatagcttccacagaagggaccaatgttttcttcaaactaaaagtcaaaatggaggaattcttggaaatgaacttgcacaactccgaaggctcacacccaacagctgaaagagctcaattttgggcctcaagatttgtcaacatcaatgaacaatatctggggtttgtgacggatcaaaaacagaatctgggcttcagaaaatccaatttgtttgaaaaaaaaaaaaactgagcacaaacaatggattttgtgggaatctgctgattgaaacatgtctagagatgtagaaggattgagttctcgagaattcgaacttggcatttagataatcaacaatggaagtgctttccttgagtgttgacattgggttgacaaagaagagagaaaggatctgacagagtaagaagagaagtgattggaaagggaaaataaaagagcagggtgtgacttgagggattgcattaagttaacaaacaagacatcaaacactaaagaaggggttcttgggttgtctattatggttttgcagcttctaaagttgtctactttggttttgcagctaccattgttgagttgaggagactcactcacttcgctgctggtggaagtggttcggtcaatggttgcggagttgggtgatagggtttgggtttctagactttgactcagccctacgccccacggctgggcctggcccgctgggtacctactacctattcaaaaagggccaacttaatgaagggaaaaactttatacaccgctttattacaggcttcaaatataaggatttgctaatccttaaggttttaaggtttttttttgaagttaaaaaatattttttcaaataatttaaaataagagcacacgtaagtttcaaacctgctatcttcacgttattaacatgctccaaccaattaaggtaataggtcaattatgctaaaagtcaattaatgttgatacatataatattaaattttttaatgtatatttaatacacgtataagtttacataataaattttgtaataattaattttgatctaatgattaaagtattttttttacatataaaaatcacaattttaaataaaaatcataattttaataaaatttgcaggtctaataaaaattatatttgtatttacatgttaaattaaaaattatatttgtatttacagtttattaaacctgtaaattttttattaaacttatgatttttatttaaatctatgatttttatatgtaaaaaatactttaattattagatcaaaattaattgttacaaaatttattatataaacttatatatgtattaaatatatattaaaaaattaatgttatgtttatcaatattaattgaattttagcataattgacctattagtttagttggttggagtgtcacgttgataacgtgaaagtcgcagtacatgtgtcattattttaaattatttagaaaaatattttttaacttacgacaaaaacttacttacagatcagcccattggtactaatataattgggtctattagattaggctgaacttaagaaatataagttacatattttaattggacttattttaactttatacttttaaaatttttattttagatttttataaatttaggtaaaaaaataaataaatgcaccaatatgggctagtctaataggtcattgggccttattggactataaaaaaaggaataccatataaaatatgggtaagtttcatccaacctatttttcacgtttggtccaatggattggatagaactaactcgttcattttgtcagctctactataaaattgatactatattatcattattttagagggggaaaacattgttgattgttagtatgcctccaacctactaacattcataaaaatgtttgtaatatacattttctttatgatgcattgtttcttattaaatgaaatttatagagctcaattaatacataggtttcatttttctcgttaagtctcatttttaaattaatgagacatggatttcaattaatagaagaaaatgtgttacaaagagtgttaaaaaatatgacagtactcttctaacatttgtgttgttaatgtattgactaagaatattcattagtttgttatctttgacaaggtcattacttccatgtgactttaaaataagtcacataatgtgtattttgtatagtctaatcatgtaatgtcatgtggaatatatagtcacatcaaccaataaagtttattttatttttttgcaattcaaatctaaggacataataacaaattttatattttggtttttaatttaataatttattaaatgttaattaatctctaacttcctaaatatgaatgtcttcataccttgagcttccccacacaaacccacaaagaagctacttttctgataactcacttgggaggagcaagtcaaagtcaaccatgcggagaaggagttaacaacattttgatgtttttcccaatgttgtgaaaatcaaattagtcatcggtctgatcgaaaatctagattaatggatcaatggtcaaaccagtaatcaccaattggtttggtttgatcttatatatattaaaaatttatagttaacattctttgattaatccatattctaaatttaaaattattattaggataaattatctaatatatcaaataacaatagagtttttaacaacacaagtctatattccaaatttaaaagcattatcatgataaacattagttgaacccaataaatcaatgtatattaaaaacataaattttatgtgttgatactctataaaagttaaatttgttatataattattgactaaagactttagctcagtggttatagtaatgtttatgcaattgagaaaaatgtgtttgaaccatgtctttgccaaaagttgtctttttttattcaaattttaatactaaagaaatgcatgttttaaaatgttagtctattatctgtattttttttgtgtatcactttttatttatgagaattggacttaattagaaattaaattatacaacaagcttcagaattgttttatttatttgtgtaccttttgaaatattttgaattttttttcaaaatatttcaacttttataaataaggcattatttgatttcgaaattggattattatattcctaacccaaaatcttcgttgctgtattcataaaaagtaatagttctctcttcgaatcgtagcgattaatatcctttcaaaacaaatttattttcttcatttgaattgacagtgaattcttttgatttcttattggaaaatgagtgtttacattgagccacatgacccttgtcggaaagcatggttggagaatatgagaaacaaaactgtttcaagaaaggaaaaaaaaaaaggtgagctcaacccaggtcaacgcgagcgatactggacagcatacataagcgatccaaataccagcccggactgacctagacaacaattctcatctagaccattttaataacattggtttttcctaccactctcccaggaagtggaggagaaagtaaaccgtagcagcaacaacgcgattcgaaattcgaagaaaatatattgcttctaggcgtgcacccactaatgttttcaccatggacaccacaaattagttattgaattagaaagattaaagataaagtgattttttttaataaaatactaaattaaaaacaaaatataaaatataaaattttctattaggtcttcaaatttaaattgcaaaaagaaaatgattaattgatatgattatataatccacatagtgttacatgattagattatacaaaatccaagtcaatgttacttattttaaaatcacatcatcgaagtaatgatattatgacaaaatctaattaatcatcattaataagatttttatttacaaatattttttcagcctacactcacatatgtaaaataaaaaaatgaataaatttaattataaatatattgcatatttagtgactaacataaattaaattttaatgtgcaaacaacgtatccttattcattagcataatagatactttaaaaaactagaataattacaatatactgagagcgcatgttcgatttcttgcaatgcactttgctccttttctactccttaatccgtatctcttcttctcttttcaaaaggtatactacttcccgtgacagaaataaaatacacaatctacttgacttaaaatcaaagacttaaaatatgatatatcaattgaatgtcttccttaagtctaacttattaaagctcgggtaataccacaatgcgacgagattcctccctactgaattttaacatatctacgttctaaaaatttgagaccaccgattaactaaaaataaatcaaatcgtccactaattgatccacatgtttatggtcattgaacttttttgagagtcaatttatactcccgcctttaacaactatttctgaaagtaaattccttcttcatacacacatgcatgattgagtctacttatacaggcattaatgagatatccttaaagcagaatctctcaaacccatttctctccttagggcttctattatcaaaggatttaacaagaatgaatccaatgtaaaaggcagaaaccgcaagttagttattatgagacataatctcagacaaagaccatatttccccacccttgggacaaaaaaaattcaagaactaagtccggactaaaatatgggtccaggccaaaataatgatacgttactatatatagtaaaaatgtatgattgcagggataaaataataactgaagatggtcaacatatacaacaaaactcctaggaggctaccaaaatgaacagaagacacatgatcaaaatatgcacctaaagacaaactaaaaacagaaaaatactgtaaatagcatgtcaatgaccagaatccatcagagtggaagcattatcagaacctagtaattttctaccttcgctgaggaccgacagatgtgcagcataccaattgtatccagtatggtctgctcttaactttccttttttctctcttgatgtcagcaggatatcttgctggagagttccattcttttgcagcctctccttttaccacttgagccacaggggattcaggacccagaatggaattaacagttgtcaacccagaaccattcttttccagaactttaccactcttctgactcactgagttttcttccatttttggagatcttgggttgctgctatgggcagcctcacctaagtggctcttaagaggagtgtgctccttactagtgctccagtttgtcaccttggctattatttcttcattcttctttctcccttgagactcattgacaacttgtgtaagagtgggaaaccaagcagcctgtgaagtggaatctggctgtcgtgttttctgtcccttctggacttcagaagcagtggcttttgggctaacctgactaggatcaaccaatgtcattaaagatggtgcttcaaacatttctgattttccagattgctgtgtgtcaggtgtagcttttgagttgttgaagtttgatttccctgcttctgttgatgccagcaagccagttgatggcaaggtttcagcatcaataacagctgttgcatcggattgcattgacagaactgtttcacggatcatgaaacaaaaagtaaaacaaatttttcttccaaaaaaccattaaaatattttagtttaatttctttatacaaataatgcaaggcaaggacacaacaaaagagatggatcctctttcgactttcctctccacctttatacaaagaaaaacaatcctagaaaggatgagagagaaaactatatggatcacgccaaagcaacaggtgaatataattggtgaaaaacattaagagacaagatctaggcatgcatcttcgcaagcatgcaaaaatcattaccaacgaaactcatttggaaatttcagccccaggcaagattcagggatgcacaattgcacacaggtataatagccagtatgtatgtgtctttggtgagaataagtttatgcaaaaagatctcacccattctaatcaactatgaaaagtgggtaatattgcagtatagcacctggatctacagataacttctctttaacaagcactgcatcacattacctggtttcattgactaaccctagcatattacaatagccctactatagaatgtatcaagacagtacaaatgttttctattaaaaacaacaaatgtatatatacctgaaaaagagccccagttgccttccaaactgtcacaccggctacctgagtcaactgaagcatcaactctggatgaaccaagtttacccaagttattaccagcttgatcttgaacaggcactgcagtaagtccagacacttccctgtcaggctgagcagaaggttcagtagttaaaggagatgtatactccctagcaaggtcttctgcagccttcactaatagtccagcatcttgtgcttgatgtgacttggtagaagtatcaacagacttgttatattcttcatttagtttgatattaatatagacttcatcttcttttatgtctttctgggcacctggtagtggatttatatttctgcactctgtaccatttgacttgttcacaggcccatcatccacaatgtctaaagactctgaaatagctgggctttcaaaatgactggtagcagatttgggcaatgaagtatcgctcacaatggacctttccatgcattgagcatcaggaatatcatgttcatttttacccatttcaccagcagcatcactcttaccagtgctgtcactcttaaataaggcatttgattgtttgacttcagattgcaagatgtcactgggttgaagatctttcaatataatttcaatatcattttctacattagatcctacaaccttgccatctgaagctacatcatttatttcagttatttttacctcatgatgacttgtgctgtctatgttaattgccctagttgtttcactaaaggattcatccctctgactctcgttagaagaggccattaaactaccttctggtaaacttatctgctgggaatttttacacacatcatcagatccatgctcttcagaaaggtgaaccatacgaatttcatttgtctcagttttggtagcattcattgaggcatcaatgtcatctgatctttgatgacattcaactgtgagcttggctggagaaactttggtacactcttcggcatgcatttctttaggcgtaggctccctgttgaccagctccatcttcatgctattatctataacatccatatctggagagaggatgtcacttttttcactcaattggtttgcgttgaaatgaaatttattttcctcagtaattttgtccttcaagtcatctccctcatatttcaatgactcagatgattgtaggaaaggattttggtataccactccttcaagatctttaaagtctccatactcactctgaggatgcacttcatcagatctatcatcacatgtaggaagaggattaacattaacatttccttctcccttttcctgcaaatttttgttatcactggaagtagcaaactgtatcatacatgcagagtctccctgagcatcatttgtcattacaactgagtttaactcaagaggaaggttatctgggggcaacaaagaaaggaactcagcaccattcttttccttcagatgaacagctccatcacccacttgatgatccaaggaaactacaccactaactgctattttagacacttcttcactcgtttcacctacaactttatcagatgattccacaatttcaaccacatctctgtaggaattaagctcagcaccattattttccttcagatgaacagctccatcacccacttgatgatccaaggaaactgcatcactaactgctattttagacactccttcacatgcttcgccgacaacattatcagatgattccacaatttcaaccacatctacagcagaattaatctcatccttttctttaaaattagtttcctttgcaacagatatcaaactgcaatctgtcacattctcagcagcatggattttcttttctggcaatatatcaggcatggcttcagtttcaccaagaagtgagtcacttgacaaaccaaaaaaaacatcactatccacaatagttgattcctcagtcctcaagtctgcaatggaacttgacaatgggtccacagtagggcctgacaattgaccttgaaactccaccgcggttcccacttcaacactttcattttgaaaaatattagaattttgaatttggctgtcatcagttgacttgtcagttaactgacgtgcatctgcagctgtgaaacagataatcagacatgaaagaaccacagagaagaaacaaagaacacagtaaaagggagatattgtcataaaaaatgcctattcaataatttcttagaaaataattatgtaggttatgtcatgtgtgcgcatcaatatacttgtgctatcctggatatttgcatcaataaaaatcaaaacaacatatctgattttccccccttttaatataattttacaacagaagttaacttaaaaaggtatagtttataacatatctgatttttcaaaagtttctaacaagcaaataatactcaagttaaatttcattgaacaaaacaaagcaagacgaatagtgcacgtttagtttattgatgttcatcatgtagcagtcatgtgaaaagatgcaaattttgctttcatcagttgagcaatccaatcaacgtatacaaattaagtcaataaactgctttagagatttttttgcaatcatcaagcttaatacctgtaaatcatgcaaaaacataattatcattatttttaattaaccaggccaaaatgttttaccgcacacaagtccatactcgttgaaaaaactaacaaggcaatttaataaaaggaaatatgatgtaaaacactaaaacctatcttcgcaccattgaaatctttgtcctcagtagaccctgaaaattttgtttcttttatgtcaaccctttccacattagcacctgagtccaaattatcttgcaaccgttccttaatttctggattcgatccactttccaaaaagtctgcaactgcatccgaaaacacctcatcttctgatctaattaatttttctccatttccttcattgcccttctcattgttgcctgtctccaaggattttggacctgacacaaccaaacctaataaaatagcaacgaatcagaaaaaccttttgttttggaatgtagtactaatttcaaagtctatacatgaagaaaagtaattaaaattaatctcactaagtcaagatcagttagatttacttcattttctagtatttctcagcatcaaagttagtaagatttacttcatctcctagtatttctcagtattaaagttaacacactacatataagaaggaaatccacctggtgttttgtgatcatcatcagaaacatgttcatcatctgagccattcaaatggggttgtccctcggaggcagacagtttgtaaccttcaatggttccacagatcttcttgtgagcacgcctgtgcttggcactcggatgtggatttggaaatggccatccacatttgtgacacaaatgaactccatgactctcgtgtccttcaacatcaaatttttcaacaaaaaaaaaaataataagaccataaaaatcttcacctggagaaacttaaaacacttcaaaaagaacacagacacaatttccaaaaccagacaccccagaaagacaaagacttttcataagaaaaacaccgaaccaacaaaacccagaaagagaaataatataataatgaaacatggaaaggaaaagagagagaagaagaagaaaagggagaaaaaaggggatgaggatgagggcagtgaccctttaaagagaaaatgcaaaagaaaaagcacctgcagtgtgagttcttctttgatcctggttatccatcgaaaatgaaagacagtaagaaaatccaacaagtgaaaacccagaggaagaagaagaatggggaggctagaaaaatcaaaactttactggaatggaagcagaacagaagaaggcttggggcgtgtgtgtgtgtgtgtgttagattaagataaacagagaagctgcagagaaagaagagggtaattacagtggaagtggaggagtagtacactactggtttggagcaacagcataaaaaaacaaaaggacccgcacccatgtggacaacgtaagtcactcactgttcatggaaacacgaaacttccgtttccatctccattctccgcttcaaacacttgtacatttgtacgtccaaaagggtatttcggtcttctcacgttcttctcaggggtatacatgtcgttaacgtacaacacttcttagtgtgcacatgcgctgcacgtgcctctccccgtgacgacctttccaccgctgcggatagtggaagggttacatggctgtgacggtggggagaatgacggccaatgaggttggtggttggagtaaaatctttgtgatgtgtagtgtagtgtgtacggtctatccatgtaagcgtccaaagccaaatgagaaagtatgtcccctgcgtacgttgcaactacttctaacagttctattactatttttttgtttgtatctgagaaacgatggttacgctgcaattaggtttcggtctttggtgcatttcatttactatttctcacttatttgtatttattaaaaatttatattcttaattaggcgatgggaggcttttattgtgagctcgtgcaaaattatactaacatggaagactatatatggtacgattatattcacgaaaatagtaaaatttatgttgttatttaggttgtccaaattgagatgtaatttaataaaacatggtataaagtataaactaatgtgtttcatttatttcatttctcttttttttaggatgatttctcttctaagtatataggattaatctaagtgactgtctgacaatttatttatttaatctttcttaattttatttcattttaccagttattaagtatcaaacataacctcctcaaaaaagaagtatcaaatataaccacttaaaaaaaaaaagtaccaattataaccaaagttgtcaccacaatcaatgtaatttctgttttaaattggaataacactattcggcaagagagcacattgatcttaaatggaaaaaacagtaaaaaacagttattcaaaagtcaacgaacatatcagattattataatatttttcagtttactttgtagcagtttgttaaaatcatcgaagataggactagtacttcttaaccaattttctttaagtttcaatgctttttaaacgtacaaaaataattataacagattaaaaataaaaacttctgggacgttgggccatctccaacatatatatgattgttgatgtacgctgggtttggtttcgtctcgctttcgaaccaacagtatatgtatggagtagttcagtttggattcatacacattacacagttcacaaatcattatcatgccactttatctgcagaacttttttaaaatatataaaaaaaacaatattaaataataaatcacgtaataaactgtcattgcaagtttaagatgaattaaattaattttaaaggtcagttcaatatatcttaaaacacattaaaaacaaacaaacttaggtgtactgatcctaaatagaaaatgttagtaataaatagtttattctctttaaggaggcaaaatattggtgcaccaaaagtagtgtaaacttgaagagattccaagttattagaaatggagaaggagatggtcacaataatttggtgagttaagtggcacaatggtggggcccttagcaagtgctgtgttgttggagatcttgtggataaaatcatctttgcccaactggcagatctaagaaattttagttaaggtggttagtgtcggaggagcgtgccttagaagacaataaagaagtattataatcacataacaacaaatattggtattttaattgcgttaaatgatcaaatgataaggagagagaaacctttcacctttgtcctattactaacgagttaaatgagcattgaaaatttaaagaacacactagtgttgttattattattaagtatgatgaaattatgtgttttaaaaaataaaatactctataatgggatgtttttattattaatacttggtgtctctctgtaaattttaaaaaataaaaaatataaataataaaagttaaataatcgtgggtggattacaatatataactatcggtatgggttatttgaaaaatgtaataaaatagatttatgaaggcagttatgataataaaaaaggataaaaaatgtgtataccaaaactttgcattttttatatgtaattataggttatagatgaatatttcaaaataaaaaacaagaaataaattcaaaagaaaacttttaattcataagagatggtagtacacgaaattaagtaagatactgtatcaactttttttgaagtgatattttagttcgtccattgaatacaaaataaatatttatttatataattaaaatttataataatattttttaaaatattgttcatactactactagagaacatatgtaactagaagtgttaaacttaattaatttgcttatccaatccaaaaattgttagggttagtttcttgaacatgccccaacccgattaagaccatataaatctgaaacaagatcattgaccttacctgttattgtaatatatcaaccttattattgtgtataattaaattgtataatgaaaaaataataaaacttaaatatgttatcacgatctcactttcctttaccttcacttcctctctattcaatgcacgcataataactactttatctttcaaccacatttggtgtcgacacatacccaactaattcatctaaaactcatttgacttgttatccgacataatcgacaatataaatggatggattttatgttaaatagtaaatatttaattcactatggttttagatttttaagtttaatccgactctaaccgagtgacgctcaagcttggtctagaatatagaattcttattggcaattgatatatttaccttccctatttagtaattgcactttttttaacatcttatcgttttttttttcttttcaaaagtattccttttctgaaaattaactttttggagagtatttgattattcccacataagccatctacagtctaagacccacgctaacacacacacacacacactcactttgatgtcacgattcacacacattacaacaacgcaaaacttgaaccatatattaggtatcactcttaccgagcacatatggtcatgttaattatggccatgcctagtttgggctgtctggatgctttatggttcgtggtatcggtagagatcatatggtcacacacatggcatttgtgcataacaagaaaagtggaaattgccaattggagttgcaaatcggggttcccatcaagctttcatctcgagttcctcatgggtttcatcactttcatggcacatttattcataacaaggatttgaggaagcatacttgatttattggtgttggattgcgtgtgcattcgtgcgctgcttgcaaatacacctccagaatctactccctcctatattgtttaaggatgctaatttatttttctgtattttttttcctttggggagagtgaaaatttaatttcaatatgtgtagcactggaatttgatggatccccaattcacactttctttttttgggcaaaatggtgttcatatctttcttcctcttgcccctaattttgcttctggaaagtaaattatagaatacgtttttttatggaaagaaatgcttactgattgaaaaaaaggggtgaggggagaaaataagttttaagttcaaagaacaataaaaaatagaggtgcaaaaccagagtttatgattttatataaaagagtatctgtgcaataaaaatataaaaaaagaaggaaatatatttagcaattgtggagatataatagcaattgccattcctatttttcgttttggtctataggaatatagttatagaatccctatacccacacatattatggctgttgttgggttatcaatatagccttagcctgctgctgttctagcccaaaaacattcacaacatacaacaataggggattataaaatccttttttttttttcttctttttaaagcgcacccaatattctttttgttatttttcatttcaataatgtgttcatacatagatttgatttcattatttcgaaatctaaatctcaaagcagtgttaaaaaaattggttcccgtattttaaatttcgaaattgtataaaaaatttaaaaaattcagaatttaatttctagaaatatttattttcgtagttaatttcagaacttaatttttttctacgtttggaaaataagtttatcaaagattttttgttatagaaattaaaatcatactttgagatatttcaagggacagaaaaaaaaaaaaaaaaaaaaaantaattaatattttttgttatagaaattaaaatcatactttgagatatttcaagggacagaaaaaaaaagaaaaaacacgatactttccttgcgaacgaacaaagcgtttgaagattcactagtgactcactcatcatcttctttctctgcaatctacaaagaaaagaaacatgatgaactttgacggcttccagaaggctctggcggagcttcagggtcgctgctccacgctgctgggcaacctgacccgtctccagcccaaccgcgcgaggccgccatgggctcggatagcccagccctggggaggcaggcccatggccatgacggtggaggcaatcgaggagcgcttagagggaattcccgtttacgccctcagcaacgcttccgaggagtttctcttggtctcgggctcttcctccgggaaaaaccttggcctcttctgcttcaacaaggacgacgctgaggctctcctcaaccaggttacgcttatcgacccccacgcgcgccagggctctaaagttgtccccgttgctttgaacaaggtgtttcagctcaaggtgaacggcgttgcgtttagattgatacctgagttctctcaagtaaagaatgccctgcaagtgagtcgtttctttattattactattatcgtatgccaaatgtatagttggatacgctcaaacgatgctctgcgactctgcgtactgttataccgaaatttaaaaccttgcacactcctaaacccttcaaaaatcctaaggggacgtttggtagggaaaaagttttttcatgtccgggaatcatgaatcctgggaatcatgtttactgggaatgaataaaattagtttggttgacattggaaatctttagataagttttggaggaatcgaagagttatctatattttaattatttattatattatataatttaataaagaataatacgatgtttttactgttgtaaaagaaaaattaaacttgggagagtaagattactacctccccatgggaaattttcgattgagaaacattttcaggaaacatcctttcaggaatgttatttttttaaaatacataccaaacatggaaaaccaaaaacttctctcctaccaaacactccctaaatgctaccattagttcctaatatcttaatcaaacctgattattgagattcttttatgattttaatgtgtcatttgaaattaccttggggagaagattgaacagaacatgtgccactgttaatggttgatgtacgatatgattgttagaattggagtaatgaggattcaaatatggaccacttctgtagtgtctcggatatatggcaaagaagcaattgaatgaataatttatgctactggcttttcaaacatggcaacttgaatcatttcactgttcttctttgctttccacctttaacagataaataggccttattcttcactcttcagtgtttgtattaattcgtttagcccaggccccttggtactctcggaattatgattggttctgatatgtgatgttgtctaatggaggaaggtagaagtttctctttgagctagattattttttagtactttgtgtgcaatttatgttgacaaagctttcttgggggaaaaattactgtgtggatagaaagcttcttcacaaatttactatgattttggattggttctcaccaattaccagaattagagcttgactgctctggtgttgtactagtcatttttctattatgttggtctaattagctaatttgataccattttcttaaaattcgtcatgcatagttgatgtgaagtttgaaaatttgcttgtaatccctgtattatctatttaccttgctattggtcattgagctgtacagtaatgataatgtacgctcatgctatacaggagagggaaaaatctggctttgcttccagtggcttttctggtgttcccgttttccaggttcttctcccagctttttaagtctggacattccatttgtgtcttaattcctatgttgcgagctatttgaaaataggggattcaatgaatgtttcacaacattttaatactacataaattttaaggaaaagaagggtgagccaatgtttgaggctcccacccagtgtggtctcagggaggtagatgcatgcaaccttatccccacccaggggagtctgtttttatgctgattatctgtttatagagagaagcagaaaccttgcaaaattggatgaacaatcaaggacatgcatacaaacatatatgtataaataaatatatacaattttagaacaaaaaaaaaaaaagaaaaataaagtgatcttatgtcttagaagtacatcattataataatgaaagtccttgaatttcatagctgtgtaggtaacatagtcttcacttgtgaaacatcattaaacaagtggcactgagtggttgagtgtgaagttctattagcaacgtgcatgctttttgtgtatatagattgtatgtttgattttataattttatttaagagaaaaggggaaagaaccagctcaataaaaagaatgagagtgagagatacactccatagtcttttattctgatgcagttatcaatttaatattagttcataaatgggaattttggtttgtgaatatgatattgataatactccccaatgttgtcaatggcagatggtcattgtggcctatggcactgccataatgggcctcccttcacaaattgcctatggtggttggcaacaaatcctccccaccatggcggccatgaccatttaacaacatggttactccctctgtcccattttgtgtgatgtttaaggttttggcacaagaactaaaaaataccattaatattttaatttcataaaaaatagtgttatttcctaatagattgtcttttatatgaattgcattctctctccttcatacatctcttttattttctcactccataataagtggttaaggatataataggaaacaaatatttaaggattcatagatatattaaaatgccaatcaaaatgggactatttttttttcttaattttgctaaagtgtcaaagaaaatggaaaggagggagtactttggtagcaagaggcccacaattaggaaaatatattgctagttaaagtatttagagagttgttgttagttgggactctgatgctgtaagaggtaggatataaatagtgggagagaatgtaagtggaaggagttagttggttagttagtagtgggtgggagagaccaagctttcgattctttggagattactttaaatttaaaaagccattatcctcattctgggttccattgatccagagtaggaggctgcaggatgctgctcaataaatttgcctttctttcattctgttaatttctacattcagaaccagtatctataatactcatatgataggaacccaaaccccaagcccctcaagttccgaaaacctctacaggtttacagcctaaaccactattctatccatgaattcctaactatagaccatctaaaattcttgtactttactgctactcataaattgctgctagcacatgcctggagtcctgtatctttcaaacctcggattagccactccccattaacaaattcattcctttcttcaaagttcaaacctttgacggaagcattggcgaaggcagagtgggccgacgatggagatgacagcgagggggagcaaatggaatttttccgagaggggtcttggaggatcattttgcttctgaaaatagggtcttctatttcatttttgaactgggtcagcaaacctggcccgaatagcccatcatatttgggtttttttaaacgtgttcaaactgggccacaaaaagccaccttcgggaacggaacagttaacattccaccgttctcgtgagtaaacccgctcttgatgaccgttccgcagtgtctccgatctttcctccaagtttgctcgatggagggtgcaaaacttgtaactcgtacgagtcaacgagtaaactcatgttttttacaacattggacacgaggcacctatacaatacaacatgaaatgagtatcaaactttaaaaattatgggcatataacacaaattaagtatcaagtataaaattaaaacgaaatacacaaatcttgaatcaaaagagagaattggtgttttacagttagcacgagtcattgtaggcataataaaaggctatcatgtttctagtttttgtggcatttccatatgtattggtaaacaatttaaatataaagtaaaaaaaaaaagaagctatttgacacgaatatgtgtctaacacacaggtaaaacttatattttgaagtacctgtgcttccttgtttgccagtttttttaacggatttgttatgtttatgttatgaagaaacttgattgagttgatactgtattagagacactatgaactggacctgttctactgttctacaagtatatttggagcactaattcttataatcttgttatcatttgtgattgcactcatttctattgatgctatgataccttaatttttttcatgtgtgaatcccttaactagtattttgagttgttatattggtaagtttcagtccagaagtctgatattgaagagccaaaataagagatttcgtccacttttcttcagaaaggtattgttgatttgctcgcattgagttacctgagattagatagtcagaaatcaagctgaatttttttaattctcaccttacgaatttttcacaggaggacttggaaaatacacttaaatcggcagcccttgagcagaacaaattaaatcctactatgagaaaaggcgatatccaggtacagaccacaatgattcccttcaatgtatgacctgttgtttcagaggaatcaccatgatttattttccaggttgccactctagaggatgtaataaaagaaatgaaggtgagtgtcaaagttacagtagaagatggaattcacttaaccctttgtgtttgttactcccctttttgagggaagggattttttgcaattatctatattccttaatctaatttgtaaattgagactaaataaaataattttgcaggaaaattctacatcgaactgggatgatgttatttttatacctcctggatttgatgtttcagacgactccaatgagcagtagggcaggatgatgatcaaattcatgacaccttttatgcttatggtattagcttttaatccatagcacatgtcaaacaattatttaggttttgtgcataggacaaacttctgactgcaaactcttctatccttacattgatcatctcacttccaccagcgatgggcataacaaaccatcacatcacgttgacaacaatgaggtaatacagtggaaatggaaaagaactttgattctgaatggattttggttgtcttcaatatgaaacgttattggaaagtttgggttttgcattttctaatttggttttcattatcaagtagattttagcagacttcataatctttattactaatgtacactaactgaattctgaaatatcgtgtaccacttggaggtgcttcacttgatcgtgagattgctattgattgatttggagcggtggtaagatctcaaatggtagttatctctgaccttgtttacgtcacgaaattgttcatcactaacatgtagtttaaatgtggtctcattcatttttctgttcaatttggctatttcgttaacctttcgagtggtctcattttaacttcgaacttatctagagtaacttatgcacaaagcacctttagcacacgataattttttaaccaacatatcatcaactatcaaggaagttcctctatctagtacagttgtcttggctgcaggaaaaagatagcacaccctacaatttcagcaaattataatcttccttgatagcatggacaactttaaattgacaattgccttacaaaatggggtatagtgccgtagtgaggggtacaagtcaaagaaaaacaggctgatatccaatccaaaaggcatagattggttggtcctccatttatggatgataaatattaatttttttcttttttggtttcctgatgaatgatgattgctgttgctcacagaaaaatcaatttcaagacacgttgtattcataaagagatggcacaaatttgttccctttctcgtttactcgttgctttactggagtttgggaggaaaagaaatggaaaagagaaatagacaacagatatcaaattctcacttattgtttaagaaggggcgtatgaataaggagattttttttgtcgtaggatctaaaaaaaaaattcaccccctccccccaaattggcatgaaggaaggatctcactttcctgtcgtattttcttaaaaaactaaatatttttttataacaaaagattaaaaaatatcaatatataattttatgttaagaaaaaataatagttaaaaattaatttttagattaaatttagtttttaattacaaattatttttatataattatttatttttctctttcactcttccaaacaagtgaagagaaatttctttacttctttctttactatttttatttattcaaaaaacatttttattctatttctcttttatttttattcttttctatttctttctttcttgtctatttcatttctaattgaaacaaagtattaggctgatagttacctccatttattcactaatcatctaatatattcatgtacaaatttatccgcccaattataagaataaaacatgatggtttggatgatggataaaccatctatcgtattttataaaccaataatttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttactatttttatttattcaaaaaacatttttattctatttctcttttatttttattcttttatattatttctttcttgtctatttcatttctaattgaaacaaagtattagggcgatagttacctccatttattcactaatcatctaatatattcatgtacaaatttatcctcccaattataagaataaaacatgatggtttggatgagttataccaacatattggatggataaaccatctatcgtattttataaaccaataatttaaactattggatcaatgatgatcacaataagagcatatgctcatagtaggttctcaaatagtactcacaaggagagaagttttgttgacaaataaaaaaataattttaaatggataattagatatccatctgtgaaaattattggcaaataaattagatgttttcttttaaatgattaatgtatttttaatgaattaactattaatttgaatttattttccacacgttattcatgtaatattttttaacactgttaatcaacaagaaataatctcaaatatgactatttaaataactagtataaagcttaacaaaactatcaaacaacgatttataattaaatgacacattatactattaatacattttaaattttaaataattttttaaatctattaattttaatccaactcaaaattatccaaaccattcattttacccgaaatcattgaaatcacgcgtttgatatgataagagttggtgagtccccatcccaaaggaatatctcaattctcaaaccccaaaaatatgaatccttatatttagaaagcattttttcatatataggacccacctcaacaatgcacaatgtgacgttgcgcttccttaattgatggattttcatttggttttcggtgcactctcctgtgttgtgtagaggtctctttctattcaattgcccatcgattcagacttggaaaccaaacaaaaatttgttcatcaattactaatataattataacatgcatgcatgtacccagaaataataataacaattaacatgcatgcatggatcatggattttgattttttatttgagcattcaacttcttatttcgtactttccaatattactgtatgcgctgtacataccagcattttttaaaaatgtttttacgtctgtcgaaattattttgctttatatttctgtcttttagtttgtgcttgattttgattcactataaaataaattaatttcaacacctattcagtgtacacttatgttaatttattttaaagatttttccccctacaatttcttaagttaaaaaaaatgtcaattatttcttcaaacatgcacttatagtgtgtttgtacatctcttagaagttagaatcgattttaacctctaaaatcatgatgaaaaatttaaaaagttgaagtaattgtttgttgctttggacttcaacttaactttagtagaattgaaacttaatctaaacacattgagctagaatcttaatattcagattaattcattttacaaagaaaaaaaagcttgtaatagaagttttttttttttttgtttccttttacaagaccacgggtcaacaagagaaaattttactcgacatagagtatttaacatagttatgtgctctaaaattaaattagaaaaaagtttataccaattgattcatgcattcggtaattataatttttcctaatattagtaaaaaaacatacacgttaaactttgtttatgctaaataagacggtgttgcaaaggtcttagattctactaacttctacttgagaaaagaagagtttgtgttgaaataaaagatccaataaacatttctcttgatgagttgttgtttttttttttacgggagttgttttaattcttctaaattaaaaaaaaatgagttttattaatcaccaaatcaaagagacaaaagaaaagaaacaaagtttgagcctcctgcaacccaatatatatctaaacaagtatcacatagcctcgcatagcaaaatccgctgcattgaaaccaaaacataaacttatcaaaccaagatttgctagattcacgagaacagaagctgaattctagatttgttttctttttcatcttttaaccagaatagaagctgaatttcaaaatatctccttttcttttttacatgcacggtttatttaaatgaatatgggtatgcctcgttattgatttttagaatttttttttttaaactaaaatataaaaaaatatgtttgcatgtttatttnnnnnnnnnnnnnnnnnnnnnnnnnnnnnnnnnnnnnnnnnnnnnnnnnnnnnnnnnnnnnnnnnnnnttattattttaaaatttattctccataacttaattttagattaaaaattaaaatactttttacttgttttttgttctcttgttttcatgaatggtctcatctcatctcaatttttagctttttccttggaccttcaagttatatctcatttagtatatatttggtttaatttattatgaaaaaataatcatttacttttataaatttcttgagagagatgttaagaaatgattatttattaaattcaattactaagtatgcatttactatctaaaaattgttccactttacaaactaaacaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttacttctgttgacactagttagtttatatattattaatcattaaaaaaaaaagaaatgaaatataaaattgttaaaaatattattataaataacaaaaacatactattatagcttctaaaatcaaagttggaaaacgaatcacgtttattctatatcttatattataaatttaaatcttcttcgtggaacaacttatatatctatgccctttctcgttttgttacacacatcttataagctttggttttaaatcaaatcaatatttgtctccttaaattattatctatttaaaagagaccttttaattttcacagttattttttccaatacttaatttttttacaagaatacttaaatttattcaattaacattaagcataatatatataattcttataaatgatcatttaagtactattttattaattgattaatttttaatattttaactataaattttttaatgtgtatattttatatcttaatatatatttttaattatcatttaaataatttttctttaatttttctaaatctgtagttttcttttcgtatttttgtgtatcatgcaatacgagaaatatttgttagttttctccaaaatttatttatttgaaacaaatttgatatatatcccattcttgtatgcaaatacttgattagtataatatgaatgcgggttaatttgacgagccaacttaactaaggggagaaaaacgggacatagctagatacagatactcggtcattaattagatatactcatggataactcaggaatgtgtgtaaaaaagttctaaattaagtaattcgtgcataaagaatatgcaagtttttatatcttcaatttttgtacgtatacttgtttagtaccatttttctaaattaactgatgcttcatttggtataaaacaatgaatatagaacctgcttccagagattccaaattccatttccacccatttctggtttttaaacaatcaactgaccctgtctgccagcgcaacctgcagtcatatgggaaactaccattcaaaccatttttcattatggtgagactgttagctcaaatttcaaatacagcaacagtagttgcttttggtttggtttgtagatcacggattcacggataaaagttgaaactatggctcaatttgtttatctggaatcaatgtccccccttcttcaaagagaatattgtggttactaattaaatattattatgatacgtccatgatatttaattccacaattattgtcactaattagtggcgtataccaaatttaatcttcaccaaaagcatatgctataaaagattgttagaaggaacctcatcattgagctatggggatgaaatcacactttttttatgatctttcctttgcttttcatgaaggctgccatttgatgaggaataagtagttttaattaattaatggacctatatatcatatatgtgacaatatctcaaccatcaatatcatcgtgaccaaccaatttagttgaattcagcaatttcactgtctataaattctatagtcacattcatctcgttgttttactcttttgtttcatttgaactttccaagtaacttgcagcacctatgattccatgtattggctttcccaaatctactttatatgtagactcatattcaaccaaacaaaggttttatttaaaaggacgcaaaacataaattgccgaaagcatcaatcatatgcattatgcagtcgatttgtataattgtactgatatgtttattattttgttagcaaaagaaaacatgctttctgttttgattagatagaatttagaaagaagtgaaggacactaattaaatttccccaactatatgtattcacattaaaatcaggtccattctgaggtgctatatacattctcacattcattaaaatagtagtggagtactttttaaataaggcatcatcattttagttactttttgcaaggaaagggtggagattctgatagctggttgccataagttgattcccactgaccatatatctccttataagttataaccaataaatttgcacttttattccaataactagttagtggtgattaattaacattagagggatgcaaggctacacttcaatgatgattggcactaatgaatagtttttaagtatccaaatactccaactcttgatcttttttttttttttcagtctccaactcttgatctagtttctgcatttcctgaataataataataactataatttgtaacgcttattagtactttagtaatgaagcgatcattcattgccatactcttcgttactgtgccattatggatgcccttaccctcatttcaaggttgattctgtagaacttccttattaaatgctcggaccatttatcaggaaaaaaatctgtggttattgtaacaatgaagggtggatgcaggtaggaagtttgttcattcactaatattttttctaataaataatttgtcatacaagtagatattaatataattgtatatgcaccgtactcgtgagaaataaatgcatattggtttgaattatttttttatttgttttgtcattcacatccaaagttgttgtctgcattggaaaagacaaactaaaactcaagcaatgcaacaacccgaaacaaagcaagcagaaagagttatcagcatggccgaagtggataaccatgccatatcattggcaatcttgtgactattttttttgaattttaactccaacatcaaagaatatgtatatctatatgtcacaaacttgaagattatttaacagtgaaaatttaggtgttggtttaggcaatatcctaggggcaataactcagtacaactccgccacatggcaccatctaagtggatgcataattgatgattgatggtactaagaagtggtaaaataccctcatgtctttattctgcttccacatcacacccagttggcatccatccatcacctaattttctctctttttatgaaagaaagggaaattttgttccaaatcatacaaaaatggggtccacccctatatttccgggattaaatccttttttattatttatttttcatttgtgagtaatatcatggaaacaatcattgcccatactgaataatactagcatcctgtgcacaaacccaaaaaccataactcaaaatctattgaagtataaccaatggccaaacaaaaaggcaccagctttcaaaacttgctaagctggcaccagcttttggtcccaccagccccagttattgctccttcacgcgtcccaccatagtctcatacccaaatccccacctccatatatatatatatatacccctcttttgaacacactccctcacatcacaagaagcacaatttctctcctttttttgtgtccaaaatggctactatttctactcacaatattcgattctatgttattatgctagttgggataatggttagcactatggttgctacctgtgctggtagcttctaccaagactttgatctaacatggggtggtgaccgtgctaagatattcagtggtggccagcttctatctctttcccttgacaaagtctctggctctggcttcaaatcaaagaaagaatacctatttgggaggattgatatgcagctcaagctcgttgctggcaactctgctggcactgtcactgcttactacgtatgctcattaatatttgcaatacattatttaatttcattactacaatattttatactacaaagtacaaacaaaaatttcaaacacaatttaaatatgatttcttttgatacttttagtgttatttttcaatcaaaattacagttttacctggataatttgggtaatataggtttgtaataaatgtcaacagacagattagattattgaagtaaaactctgattctgatcacagaataatacttttagtgtatttaaattttgtccatatttcaatatattttctattttttccaaattaaaaaattgtattgtgctattatcatgtttcttatcttctttttttttggtatactcatttacccttgcttttaccataagaaaaatatactaattcaaattattagtttctttccttcttcatgagctaatacagtgatactgtagacttttttgtatgtgtgtatatgttttttcttcttcttcttttaggttgctttagaattgattcttcatgaaagaacatgataaaatcctgtcttcaaatacgactactattgaccgcttcttcacttaagacatcaacctttgtcaaactcaactgtacattcacgagaatgctattgtagcaaacccacaaaaacaagttagactacagaattttactttgtcaacaactaatgctttatttattcactccatgctgctttctgtttcaaacattgacgtatacattaatcaacttggtcgtttttaagcagtgaatttaactagcgctcgtgacaggggaaggtggctaactttgacctagtccaaaacattactaacttttaatattgaaaacttcggttcatagcataaactaatgacaaattaaaaaaaaaaaaggctcgtgtaatattaatgaactacttttatcataatgtactttctggttttgaattgataaaaaaaataaaaaatctaaggctttttttagttgataaactcatactattcctatgcatgcacacaatttaaattcctgttaataaacaacaaacatcacaattccccaaaatgaggtccttttctttgtcgagttgtttgtgctgctaccacacacaaaggccatatcaataactatagtaattccattttctgcggtgcagttgtcatcccaagggccaacacatgatgagattgatttcgagtttttgggaaacctaagtggggacccttatattctccacacaaacatcttcacccaaggcaaaggtaacagggagcaacagttctatctctggttcgaccccaccagaaacttccacacttattctatcatttggaagccccagcacatcatgtaagtgataataaacaaatattcaaaatacaattttttgtttattaataaatagtctatcaactaatattgcaatcaaccataatcattatatatgttaagttcattgactttgacatcaattatctttgaactagaagtcataccatttgaaagtgtaaattgttttcactgaaattgcatagaaatataactttgtttatctctatgctaagttttcaccaaaatccattaaccaaatcatgaattgggttaactgcagattcttggttgataacacaccaataagggtattcaagaatgctgaatctcttggtgttccttttccaaagaaccagcccatgagaatctattctagcctctggaatgctgatgactgggccaccagaggaggattggtgaaaactgattggtccaaagcaccctttacagcatactaccgcaatttcaaagccactgagttctcatccaggtcttccatttcaaattctggtgctgaatatgaggcaaatgagcttgatgcttatagcagaagaagactgagatgggttcagaagtacttcatgatctataactactgcagtgatctcaagcgattcccacaaggtcttcctgctgaatgtagacgctgaaggttccaagagatgaagagaatggccactttcttattggattagaatcgtctatgtaaaatatgctatgtttattatgtcttagattctttattgacttctgtctttttttttcttcctttgttttttttagtttctattttatagttgctaatgtatatgtatattaaggggtcataataataaatcatattctttgtaccactttaattttcttgtcaatatgggcagttagtctcatcctagctcgtccaccctgtgaaattgatcatgttggaatcaatttctatctgttcatataataaaaaggtgtagtcaagtttaatagcactgtagttctggtactgatcgacgtcactttgctcgtatggaatgttaataattaataatcaactgtcagaaataccacattgacataaaaaatcgtagaccctgggcattcaaaattagtaagatggctgcaggaaataagattaaacgagaggattcaaaatggggcattcaaatttaagcacataaaaacattaacatttgggataaaaattattctgtgcattattggtaagagatctaaagagaatatggaaattaaatgggtggcctgaataatttagagtaatttcattcgtacattatatatatatatatatagatattcttttttttgaaagtaagatatctcataaagtcataaaactaattttcgatatatgaaaattattaaattgaattttgtctttccaaataatttttttttgatatgcaagatatatgagaaattgaatttctcttaatatatttaaataactccatcattgtcaactagacagnnnnnnnnnnatatatatatatatatatatatatatatatatatatatatatatatatatatatattctcttcccaagcatgtatacatttcatcaattaaataatgtattaataagatggacccaaagagaatttttccctcaaatgagattttgaaccatcctctactatcagctatcccactttccaccattgatgatcctctatggtatctctctttccaatttttctccaaaaatttctagacaatgtagacatacatttacgtttaacgattacgataaaattaaattaataaagtaataaattggttaatataatatatttttttactgctggttaatataattttatgatccgtcaatcacatatttaagattgatgaatataattttaaaattgtatggcgagaagtacttgatagaatccaaattgaaacaaaacatcaatattctgcatgctcaaaaggtttcatatattttatattaacatgcagagcgcccaatatcgttggacaaaaaagaacaaacaaataaataaataaagagagagaaaataaccttaatcgtagggtaagacaaatgcatgcagacatattacatgagaaattatgtgaaatctctttctttcgagtcaacattaaaggagtttaattatttaagccacttaaatcaggggtgaatagcttcttaattaatattatcgaaaaagataaagagaaaaataaaatttctacttgtataacttttataaaaaaaattactgcatatgatttttacaataaaaagagacaaaaagggggaaaagcataaaataaaatnnnnnnnnnnattaaagtaattaaaagaaataaaataataatattattgaaaatatactgtattatctaaatgttactcccctaattttgaatataaaaaaattgtccacaatataaataaattttaattaattttactctatttaatgaaatgatccttcaaacatctttttcatttaatgatattgtatttctaatgacccttttatatcaaatttcaataaaggacagtttagaaaaaatattattttttaaatataattaataaaaataaataatattaacatattttctcaattaacgtaaattaatttttgattactattcaaaaccggaagaaagtatataaataacatagctgaaaaaaaaagaagcatttatcttccggaaaagtgatccatcataccttgactgagcaaatgttatccccttggccaaacataatcagactaacaattttgtttgtatcgacaattattgtgccaatgattgtacttagagatccctcttcttgaagagagagagagagagagaatcagacccctaaaaatatcttaaatgcaataaaagtgattgttggttatacgaggaattcattattttaggtgcgtttaagagaaaatataaataagaaaaacaaaacgaagataaattatatatgcgaaaaatataataaatttagggtatttagttttctatctcctcttttttcactttctacttttttatatttttcttttatttacggtggtaggaattaaagaatctataaaagacagttaagtcttttttttttacgtaagaagaatgaataatcatnnnnnnnnnnaataaaagtgattgttggttatacgaggaattcattattttaggtgcgtttaagagaaaataaaaataagaaaaagaaaacgaagataaattatatatgcgagaaatataataaatttagggtatttagttttctatctcttctcttttttcactttctacttttttatatttttcttttatctacggtggtaggaattaaaaaatctataaaagacagtaagtcttttttttacgtaagaagaatgaataatcattagatcttatgaatggttaatattaaaaataccaaaatccaacatcaaatttcacatttgtccaagctagtgtcatatgttgtgcattttattctctatttaaggttgtgtttattttgaaggatgaaaataaaataaaaaaggatttttgtacttttttatgtgaaatttacattttttatattctattttaattcaaaaatttatcttctatttatataatctctatttctattttctaaatcaaacacaccttaaatttatgagtatcaaaatattcactctaagaagcttacttcaaaactcaagtaacttgaaatccttgttttttcacatctgcaatcattccaacaattttatagttattcatatttttgtaatggcatgcaatggtgtggtattcttctattattttttaaaagaaattattagtatttaatcacacgtatttaacaaaaaatttcatatttaatttctactatgtgaaaattttttaagctagatgaaattaatctttaatatagtggaatgaagatactaatgacatgaccaaaaaaagtattactttttaaaaaatgagatcaaataaaaaaaattatttaacttaaaaaaatagggcaaattagaatgaatcataactgcgaacaaaaggcatttacaataacataaattacaaaaaaaaaaaaaaaaatctctaaggttcttgtcnnnnnnnnnnnnnnnnnnnnnnctgtttcaaaaggacgaacatatttctctgatatttagttttccaagactaaacctgatttataatttatatttgatatcactcctaaaaaaaattccaagatgagaggataaatgctttaagaccgcaattacagaattatccgcctggttgaatgactttttcttcaacatgaaccgcaaacgtaaccgttggtggccgcaagctctgcaccaacaacttgaaataaaacagttgttcaaatgaaggaaccaattattggtgtataacaaccatgcacataccgttattctgcaatgagtattaagatcatcgtgcatctgactaagacggtcctttgcaacttcttctgctgcacatgctttcctgcaagcttctttcacctgaaacatacaaggggtaaaaagcctcagtttggtaagcattttgcctattatttttacgctaattgattgcgattttgcctatacagacacgaaaaaaggatggaattacaagttcaacggtaaactagattaagtccaaaaaagtttatgaaacggacaaggaaaaaaacaattaaataatagtgagaatgaagatatattttcatagctcaaatgtatttaaaaagaaagctactgagtgatgctgtcaatacaatgtgccctcaagatagaacatggccaaaattaactgaccaacaatctttcttcttaagcccaaagcagaatattatatacttgtgaagaatgaatactttcatgttcaatttttagtttcctgtgattttatcatgtgaaaaacttgtatatatttcccttttgatcgattcccaacaaatcttgatacactaatttaatatctattaagacttaaaagagatagacacaattttcagtcataaaattcacgtgtcaaactgaaagggcatcaaaagcttgacaaaataacaagttttgctaggtgataaaataatgatccagtgaccagatggagaaaaaaaacggaacagaggtaatgcaacacatgtcaaactctacctaacacattagagagactaactacaaatcaaggtagtactcacctggcttccatcaaaaacaggattgttgttgacattatcagcagaactttctaacatatttcttagatgaaatagttccttcataagattataggcaacctcttcggcatctaacagttgatttttagaaaattcaaatgctctttctgcgtgaaggcgaaaagaaacacagttcaaacatgtgcaaacccctctgcaccctcttgggtttctttttaaaattccttttttcaaagcaacggcagggactctaggttgctctacaacttgcagttgagacaagctctgacaatattcgtgtgtttctggtagcttctcattagaaggcatcaggaaagaattatttccttttacttcagagtaaactgataatgacatggacgaggtaggtgaagccttttcttctctgttggtaactttgttaatcataggcgccaaggttgtgattggtaagtctattccgtgaacagaaattgatgtatcagtgtagctctctggcttgcatagtccatttaatacaacctgttcattttgcagtagaatcactttgcatgaatcatgagatgactggtattcaggaatttgagatttggggcttgaactatcattgtttaaatcacaagcctgcaaccctgtttgttgctgaggaccagaattgccagcacaatgttccataggaacacagccatttgaatcatttacaggagttagttgtaagtttgaagttgaaattggcagaagaggtgtttgatccatggattccgcaagttttgggtaatgatcatttactgaagcacctagaagtattaaaggtttagtttagaactacagctgccgtgaccaagaaaaaaattgaaagatactaaactaaacaagtatcttccacaagaataagaaccaatacttacaagaatcatcgttcatggtattcaatagaaatggaagcaatctcttgtagtttaaagatccagcctgtttcaacaatttaagctgcggacagcgtttgagaacctgtttcaaaatcacataatcaaacatatttcagataaatacatgacagggacaaaaaaattaagtatcagttaaatcaatgagagtggcaagtagaatcataatgttgttcgttaatgcaagttttatggaaatataatttagcactagataaatttagggtcctcaccgacgtcatcttggattcagagccattttcgatttcactagcattttggttattactaccttttgaaggccttcttgaacataaaactatgccattctgcacagttccagctttgtcaccactatcccctgccatgtcagatttttctgaggtaatattctcagatggagctctaaatatatcatttgaaacccggacatgatttaaacttgttacattctcctcagcatctagcacattgggatccgattgacttaggctatgtttgggagttaggaggggaggggaaggaaagagattcaaggggaagggaggggaaggaaaggaaggaaaatgagggaagttccttcctccttgtttgggagttaaaaatttatgaagggaggaaaattgagagttaatgagatacttttatataattaattttaatagtaattttaaagtgtatgataaataaattttaattagcatcaaactcaccaataattattcatcacaaaacattgatgggtagaatagtaattttaattaattttccttctaaaaaccccccaaatagggggaactataatttctaagcattggagggttttggaggagttttaaaaatccccaaatcctttccctcaaaaattataactcacaaacaaggagattactccagctaaacccttcctttccctcccctcccctcctaactccctctcccaaacatagccttagggtctgacattcagggggaaatctgctgacagattcatgctcctccagattcacaaactgcttgctttcatcataagcaatagtgaatcctttttctttacttgaatgatgcacatatgtaagctcagagacatcaccgttgatatggagcatattttgatctttgggtggtgactcattattgtgttgtctggatatcttattctgtacttccttgacgccatcattatgcacaacattcttagcagagtgaaaatcatccaccattactgaacatggattaagctctgatgcactcaagcattcatctttagaagcaatcgcaaagttttctgtatgttcactgacagagggtgcagataaatccccacaaaccacttcttttgcgtccaattgtgttgacaattcaggcaagtcttgggaaggtgtcaattttggctggttgccatgagatatctcattagaaggattaactaatacatagttttccaaaccattagattcaactgtgccatgcatgggactgctgtttgtcttatgttcgtctatagaagcttcttcactttgagatgacaaagggagttgggagctctttgcatgcatatttgcctcatcttgatgatcaaatttggatgcatctgtaaaatcaactagctacttcatatccgcataaaacatctaatgaaatttgtattattaaagtggttgaatacacaaggatagttaccagagtcatctttggtaagatccattagaaatggaagcaaccttttatagctgatagaacctggggttttaaaaagtttccggtgcaaatgttgtctaggcacctgcgtggacatcccaaatcatacttaaattgcaactaaatgtaaaaccatattgttaatattaccaaaaaatcagacacatgaaatgctagaaagccgactaactactacatcaaaagttttttcttggaatataatatcataaaatatttcatcacttatggttttgagacctaattttattatgtaactaagttataattatagtttagcaaagatcagtaactaaatgtctaacccataaattggtagcaaacaagattagaaacaaggacagattcttacggatttactcttgagagaatatttccccttgtcaactttcagacaagacacttcaccagcattttcctgagtgtctctggtaaaatctatcggtttgacaatgacctctgaattaacacatatatcagcatcaggaggagttgtctgtatatattcttcattcaagacaccaaactcctgtgccgtactagcctcagcacgatcaagattattcccgtagctagacaattgcttcaagtcatcattgtgcaaatcacttgcaacacctttaacaccataatctgcggtggcatccgtcttaagttcttgtttagactcttcttgactttgagatgacaaaagaagttggaatccctgtctaccctcctcatctttctgacaaaaacccaattttggtgtacctacaagatattatcagaccaattagctcattcatcacacatacccaactaaatcatcaaccaatgaagtaaataaaaaataaggggtttgccgcacaaaataattaccagaatcatctctcacggtatcctttagaaacggaaacaaccttctgtaattgactgaacccggggccttgaacaactttccctggaaacgtggtctgagaacctgcaaacagatcccaatcaactctacaataataaaaccatgttctcaaagctacaataatatttaaaaacaagtgttattcactggaattttaacctagagcacccacaataactcatgtaacctaattacataattcgccataattaaggttggatctaacaactaaggatagaaggcctaatcaataaacataaagaaacctcttaagggtgtggtcagggcttcaatctccaggtacatgtgtatgaaattcacccaaaaaatgcataaataaataaccataaagaaaataaattaaaaaacatgtgagacccttacagatttgctcttgagagaagaaacattcccagtagaaggggtatctttgacaggaacctctgcgtccagtttccctacatcttcgttaaccttggaatttgaaccaccgcaaatctcagagtcgggtagagtcattgctccatccaaaccatcaattttctccgaacaatctccaccgttctttccctcgcaatctttctccgaacaatctccaccgaagccccgagcctcacaaaaaagccccaaatcgggactctcggttgcttcggcgcttcccttgggaaacgtgctttcgatcaaactggggtttgtagattgcggaggggaataaactcgcctagctcgaaggtccttggtcagagggcgaggaagctccttgtcgtcgcgcttcggtttcttgcaattgattcggcgaaagccaaggagttcggcgcagggttcgtcctgtgcgggaacaggatcgaagcggagttgaccggagcggttccggtgatgatagagctgtgatctggtgcgggtcagtgttccagaagggtggttccgcttacgggagcttgggacggtgtccatggtctttgcgcgctagagttggatacgcgaaatttggcgcaatggttggatatgagagacatttcatggcgggaataaaggattccttttggcggggattttagtctcctttagaattataatcttttgtctttattttttttttcgacttcattgtttattataccctatttcttatcaattgtttttcagaatagttaagaaaataataaacaataagaaagtactttttcatataactaaaatttataatagataaataaattaatataaaattatattataaatacatatttaaaatatattttatatttataataaaaaattatattatgatattattttagtaaaacattgtagtttgatttataattaaaggtgacaaacatataatgatcaaattaagaagtaaaagacttgacctctcgttctctccttccctctttttttttttttnnnnnnnnnnnnnnnnnnnnnnnnnnnnnnnnnnnnnnnnnnnnnnnntacaaggccatgtttgaaatttaaatgttatgattttataggtttcctcaaaattgtaagaccatttttgagatttaaatgttatgatttcataggtttccttaaaactgtaagactatgtttgaaattaaaatgttataatttcatagttttttcaaaatcgtaagattatgtttgacaaactgattgacaagataactgaaaatttgtaagttataagttaaaagttgaaaagttaattaaaaatttataagttgacttatttaattgaaaatgttctgtaaaactaacggataaattaacaaataaatatcaaaaatgacatatttaataaatgtcnnnnnnnnnnaattctccttcatttatttcaaaattcaacaaacttgtcacacctataaagtaaaaaagcatgagcaaggatgcttgagttcaaaggaacaatatccaccttttaaaagtcctcatttgcagctatttgagataaattcatatataaattataaatgaagagttttttttaaagaaaaaaactgacctagatagttattttatgacacaaattggcaatggtttttgtgattaggatgttcgaaatttaaatgttatgatttcatagatttcctcgaaactataaggctatatttgaaatttaaatgctatgatttaatagatttcctcnnnnnnnnnnnnnnnnnaaataaattgcattgatataataattttgaatattatgcttaccattttttcaaccactactattaatcactcaatgattactagtaatgcatttgagaataataaaaatattttaataaaattgtttcaataaataatatatttattgttgttcttaatctgatgtaaaagaattcattaaaaaattgtgtaaaagaaattcaaacataaaattatatatatggtaataactattttttcaataatgtttttatatatattgtttattgaattttacatataatagtttaaagattttaatttttaaccactaacaaacatgtgtcggctgtgaagggaattttttctcagaaaatctatcctttcaactactcctattgactaaaatgtaggataagggatgaagatagattgaggaagtccgctacgtattcgtcacctcaaaggtcacaaatgacaaactatgacaagtcgtagtctatgattaattgattatcagtatatatacattcagttttttcttatcacttcagttctcactaccttttcttcttcttccacccaccgcagtagttttctcctttgtctattccgaacataaaatcaatcatttcaaatcattaagctgcaattacaatatcacgcaccatgttccgccaccgcttcctcatcgtgatgtacccagcacaaggccacataaaccctgcattccagttcgcaaagcgtctcgttagtttgggcgcacaggtcactgtttccaccaccgtccacatgcaccgtcgcatcaccaacaaacccaccctccctgacctctcctttctccctttctccgacggctacgacgacggttacacctccaccgattacgccctgcacgcctccgagttcaagcgtcgcggctccgaattcgtcaccaatctcatcgccttcaacgcgcaagagggtcatcctttcacttgtttagtccacaccgtgctccttccttgggcagctcaggcagcgcgcgggtttcacctcccgacggcgttgctgtggactcaaccagccaccatactcgacatattctatttctactttcatgaacacggtgactacatcaaaggcaaaatcaaagacccctcgagttccattgaactgccaggattgccgttattgcttgcaccacgggacctaccttcatttctattgggttcaaaccctactattgactctctcgcggtttcaatgtttgaagagcagcttcatgatcttgacgtgcaagcaaagcccagaatacttgtcaacacctttgaagcgttggaacatgaggctttgagggccgttgataagttcaacatgatccccatcgggccgttgattccctcggccttcttggacgggaaagatcccactgatacttcatttggcggtgacatattccgcgtctctgatggatgcagcgaatggttggactcgaaggcagagatgtcggtggtttatgtctcgtttggtagtttttgcgtgttgcccaagaagcaaatggaagaacttgcacgtgcgttattagattgtggaagtcctttcttgtgggtcattagagaaaaagaaaataagtcactagttgaaggaaaagaagaggagctaagctgcagagaggagttggaacagaagggaaagatagtaaattggtgttctcaagtggaagttcttcaacatcgttctgtggggtgttttgtgacgcactgtggttggaattcgacaatggaaagcttggcttcgggggttcctatgcttgcatttcctcagtgggtggaacagaagactaacgcgaagctaatagaagatgtgtggaagacgggggtgagagtggataaacaggtgaacgaggaagggatagtagaaagggaagaaattatcaagcgtttggaagtggcgatggggagtggaaagaaaggagaagaattgagaaacaatgcgaaaagttggaagggtttggccagggaagctgtcaagcaagatggcggctcttcggataagaatctaagggcttttctggatcatgtttgcccacaataaatgcatatatagcttcatcgtatctgaatttttctatcctttctcatttaatttaaagaacaatacttgtgaaataaaaaagttaaatacactataataataaatataaataaattgtaatatatatatttgttactattcgagatgtttaccttgctattcagttgccttttgttttatactacctcctctgtttctaattataaaaccttgttgattaatttatacatttaaagaaagtttgttaaacttaggtattagcgttaattttttttatataaatataacattttttaaatttatttcttaatattaatattattgaaattctatttatcttctcctatctttataaaaatgagaaaaaagacaattcaaatcaacatttaattatgtaataaaatgaattagaatattttagtaaaaaaaaattaatgtacaataaaattaagatagagttttagagcatctttaataatagattttaaattgagattttaatctaagattaaagatctctcaatatttctcctattttttttctagtattagatctcaattaggaaaaaaaaagaaaaagaaaaaatattatctttttaatattatacatatcttaagaattcttctataataatttataaaaagtatatatttttattataaatagagatagaagtgatatactaatatatagcttggttatatttatgaatatgttgggtttattttgttattgttctaaatagtccctgttactggtccacaataaaggcccaaaagcattagccagagatatgatcaggcgtcactttgggactttcacagcatgcaaagtacacccctcccttctctttcttttatttgttaaaatatagttttgaaatttactttccagatttaaaaactatgttttttaaatacactctcttctaataattaaaatttaatagaaatcacaaatttgaatttatctccacatttaatgtgtctctcttcatctcatatgatctttgttctttttaattatttgtctttaaaagtttttatgtagaaactaagaaacataataatttctcttcatccttaaatataagacttttataattaattcataattattaagaaaatttattaatttagttaataccattagatttatttgtaactctaatatttttcaaaattgttcctaaaattattgggactaactaaattattttgcacgagaagagaataatagtagttgaattttaattttaaaaattaaattcctcaattatctaatcttcacaagatagagaaaaagacaattcatagcaattactattatttatagactataataattagggatatttttgtataaaaaatttaaataatattcttatatttagggacaaagacagaagttataggtttcctatttcaccctttatcattattactccataatccataatacatgtatgtatgtaaattaattgaagatcagataaaaaaataagaatataattgaaaaaaaataattagttatcttgaaatttgtaaatgataaataaaaaacatttattaaaaaaaattcgatactaaacaaaaatgaaaataatctttaataagtttcaactaataattaaatataaattaaagaatttgttgcttaccctccacttagcagtatttttgtaagattttatatatatataaaaaaaaaaaaaaaaacttaggagagtgcaattagaataaagggattggaaaaaggccctcctaaaagtatacgacagccgaagcggaaattgagatacagagtttggactgtaattagaattgcggatcttgtcgctcgttttattttattttaaaataaagaagtgctcgcatgacaactgcaattcaaagctgcatatctttcgtagattatgggccagtctgaaaaaataacttaattaatatcttattcgataagagcttatgttacaaatgcttaacatttaataagttgttgctatttggatattcatgttgaaaagtgctttcataattttatagtatttggatatacattcttgtataagaacttataaaatgtttcattttacaattttaaaaaaaattaagaatcaaactaaaaataacatttaaaagtaactaaaaaaataaaaaaataacgttgtataccatacaaatattaaaaatataaaatcactaaattattatttacctatttttatagtaaaaacaaaaaaataagaataataaatctaaaagaaaggaatatcttttgaatcatgaaattagctgaataaattaaaacattttcttgagattataaaatgcttgtaaaaagtatcaatttgtttttttgatagtcttatagacttgatctatcacacgagtagatgtgttaattaatttggaagaattcaatatatattcatctctaggattgtttggttgaagagaaaaaatattatttaagaataaattattaaaaaataacgtatgtctcacatttctttttctctattttaattcatatatttactctcaattttatttattttttctcttacacataaccaaacaacccctgtgtgaatgtttttggctagggaaagaaagccaacaaaattttagataaagccagaaaaatgaaaagctgaaagaataaaaatgttatanaagaatttggaacactcaaaggtgggtttcgaaagctgacccttctaaaaataacacctaagcacttgctaataagctactcctacaacttattaaaataagctaaaaaaatcttatgtcgtaggatctttttataaaaaccatcccaaacattcataaagacacttgtaacataagagaagctgttaataagcttttccacaaacaggaccataatgattactttttgttaaaataaaggattgctcatcagtgaaaataaattaaagaaggtgtaattgcataaggtgtgcaattttgttttctagttttcaattttgcgaattggatcatttaagtattacaattataaatcaaaatcgcacaattaaagtatttagtgaatttaatttcctcaattgaaatatgaaagaccaaaattacataaatgcaatacctaagacacctaaaataattaagctatatatatatatatatatatatatatatatatatatatatatatatatataaactactatcatatatcagagacggagcgaggagtactaccagcaccatcaaattgagacaagccaaaaaagaaaagtaccaagacataaagacaagccaatacaccaaaaccagtctagtagaggcatcaccacttaaacaccccaaattcagatacaactttaagcctacaacatcacctacagtaacccaatatgctaaaaaatggaagcacaccattccacaacaagacatcgaacgaaatcaataaatttaccacaatctggtcgctgaagccataaacctacacggctagctacaccaaacattggctcgaaacaggagcaaagttgtcaagtgagtactgacacaaggtgccctagtaggattgaatattattttttggcacacagagtctgagtaaatgaaacccaacaaacaaactacgctacacaaactgaatcacgtctaatacgctctaaaaacaaaatcgggaggcaagttccgcaaattaattaggattggataatgatgttgaaatataaatttctattaaaattaataggaaaaactctaaaaattaggctcgggaccgagagaatttatatattttttttatagataaaaatttaaataaggagaaaacacgtattcttgtaaaactacaagaaaagttatcaacatcaacaaaaatttgttataaaatttatatatcgcctatgaatatgcaaaatgcaaaaatcaaacctaaatcacagcaaggttttctagaggcactgtgcgactcaaagtttgagaagatggaggttttgaattgagaggagttgtaagagagagttgcgacaaccaccatatgcttatgcttggcaaacgacgttctttatcatgtgatgaagttgtcatctccaaggggaggtatgaaagaaattggagagtcaatacatgtcaaaaccgttgacgaacaaactatatcttaagtagaaattatatgtgttaaagatgtaggaggatttcgctcttcaacaacacatgaatgtcttcaatcagattatcaactaaccatctagcaaagctagatgtaaaaattgagtatgaggataaaacatgtattctgttgtgttctttgtcttattcttaagaacatttggtaataactctaatatatgagaaagactctattcatgtgaaggggaaacaaaaatgcataagagcataagacaaatgttatcgtgataagcatatgaagaagtccaagtctataaaacacaaaaaaacaactagtgttacaaatgtaactagaagggacattttaaaagggattgcctaaaattgaaaaaatttgttgaaggagtcaatctgatagagaaatcaatgattcaaattattataatgcgagaaatgtcaactaaagtgaggaaaatattattgcacataattttattttgaccaaacaatattctatttttttttaccatggttaatcgttaagaatattcttgacgtttccacattaaccttttgagaattgagatttgagactattcctaatggcatggattgccaaattctcaagaatgccgctgcaataaattgcattcggaaaaaaattgaatggtacatgtagtaatgttgagcctccttttccaccgaattttttttttcttaataaaggcttctatatttttcacaacatcaaggagatctcaggaaaattgacggtgtaagggcctattcattctccatcgatgaaaaaatatcaaatatccttggttccggttaaaaaaaggcatatttattaagttaaattacatctctataattttaaattcatctttctatttttaaatcaagatttttttaaaaatttcagaataaacaattatgtgacaagtggttatttaattaataaatttttaagacatttattttatttaattgattttataaatattattttaagtgtatcattagtgaagagttattattttttaaattataaaaatttataaattaaaataaatttaatatttaaataaatttaatatttaattttacatgtatttatttattataaaaatttattttaatataaattaattaaaatttgttattgttttattataattaaaagtatagattatttaaataattattttatgtaacttaaatggcataaatttaaaataatatttaaataatctaaaaaataaaaaaatattactttttattattaaaaagttgtacatgttacatcataaaaacataaaaaaattatgaacttgtttgaatataagtcataaatatttttttgagagtttttctattaaaaatataattttttaataacaaatccgttaaaaatacttctaattttttatccaatattatgtatctctacttatactttttttccctttctatgtgccagttgagtttattgatatgaaatgcaaggtatgtgcctatctgtgacctattttgtgtgagagagggagtactgagttgggctggcttaatatacaaagtaataaacaagattaattaaataagttttttgttggttacttagctatttcaatttttatttttagtttctcttaaaactgttgtttcgtttatagtctctcgtctatttttttattgtacaaaattagtcactgatcttggaatgggaataaaggataaaaatcaatctcacatatattaattctgaataatgaaaataaataagaaactaaaatggacagatttgaagaggaactaaaaattaaaatctaaaatagttgagagataaaaaaaattatttaacccaaaattaagatgacacgaagcatgtgggggagccatagcaggaaatttatttggagggtggtccccctcttcaggaagctactaggtagatcatacaaaattaaatgaaggcagttagctggtgagacttagcttttgatgcttttgagattagaatccacaaacgtcatgtcacacaattcttttttatgtataataacacagtgtgatcatgcaatctatggtttctatcatgcatactattcgaaacctcttacagccccaactgttataattataattataatgataatactctatatatttgatactagtatcccatcccatgtgatgcaacagtttttttttttttcaaatataaaaaaatatgatagaaaatgatgaaattaatgataatattcttgtattttagtagtcattgataactgtttaacattgatgtttgaattatcgaagaaaaacttgggtggaacagagaaattgtctaagagatgtatttcaatttcaaacgacatgacgaagaatttcacatttttcttatgtagtcaaacatacaagcattcacattggatgtccatatacgtatgaaataagtgcattttatatgttttggaacattttcttctagcaattaaactccattcatttttattctaaaaaaatcttgattcattttcctgtaaaataaaactatattcattttcttcaccacagcatataactgaccataaaaaaaatactgatttaaagaaaaattccagaagcattataatgataatgcctataatacccaactcctcaacaatagaaaaaataactaaaacaatatatattattattgtagcacattaaattggtcaatgaggctgtatatgaatgaaaaaaagatttttgtctaagtgtgaattcacagcaaaagagggtaactagccagttccagcgccaccatgctccaccaccgcttcctcctcgtaatctaccccggacaaggccaaataaaccccgcttttcagtttgcgaagcgactcactgccatgggtgcacgtgtcactattcccatcactctccacatgcaccgccgcatgaccaacacaaccaccgtccccggcctctccctcgcccccttctccgacggctacgacgacggcttccacgccatccgcggcaccgactccgattacaacctctacgcctcggaactcaagcgccgtgcctcggtgttcgtgtccaacctcatactctccagcgccaacgggggccaccctttcacttgcttactctacaccttactcgttccgtgggccccacaggtggcgcgtggactcaacctcccaacagctatgtactggatcgaacccgccacggtgctggatatcctttaccactactttcacggctacgctgattacatcaacgacgaaaccaaagagaaaatagtgcttccgggattgtcgttttcgctttcaccccgtgacatgccatcgtttttactaaagtcgaaaccgagtttgttgtcgttcgtctttcccttgtttgaagagcagatcaaacagcttgacctggaagctaaccctaaggtgctggtaaatacttttgaagctttggaagaagaagcgttgagggccgttgataagctcaacatgatccccatcgggccgttgattccttctgcgttcttggatgggaaggaccctgaagatacttcctttggtggtgacttgttacaagtctcagatggttatgttgagtggcttgactcaaaggaaaagaagtctgtggtttacgtttcatttgggagctactttgagttgtctaagagacaaactgaggaaattgcaggtgcgttgttaggttgtggttttccgttcttgtgggtgattagagtgaaagaggaagagaaggaagaggaggaggtgtgttttagacaggaattggaagggaaggggaagttggtgaagtggtgttctcaagtggaggttctgtcgcatggttccgtgggttgttttgtggcgcactgtggttggaattcgaccatggaaagcttggtttcgggggtgcccatggtggcgtttcctcagtggtcggaccaaaagacaaacgcgaaactgatagaagatgtgtggaagataggagtgagggtggatcatgaggatggcatagtagaaaaggaagaaataaggaagtgtttggaagaggtgatggggagtggagagttgagaaggaatgcagagaaatggaagggtttggcaagggaggcagcgaaggaaggtggtccttcagagaggaatctgaaggcgtttcttgatggcatggcgttgcagaatcgataattaatgcacttctttgccaaataattttgttggattcccgtcttctgaccagttttgcagttcatgctaaattattaattaatgctgttctttgttgttgtttttcgatctgcttcttttctttgcccacgagaccatcacagtttacgtggttaaaggactctgtgctgtgatttttcctgtccatctgtctcttttttattttgtttttctgcttcttttcttttttttttcctatcattttcaatgaattaattctaagtttaaaatactttattatttagaacagttaacttattattgttttaagaggtagtattattttaagtttaaatataaaattttttctttatagttatatctttatttaattttgtatactccttaatattattttatttaattataatttttgaaaaatgaatcaaactgtgaatccgcaaagggtagttcttcgttgtcgctgggttggattgctggtgtagttgttattgtgttgttttttattgcagtggtgctgtttgtcttggaagtgttttgtcaacaggcgacaggggaagttcagtagggttaatggtcgtgaaaatgggaaaggaagttttaaacctgatgctgtccatgtttctaatggatatggtggtgttcccagtgagttgcaaagccagagcagtggtgatcgcggtgaccttcatgctttagatggtccaacgttttcaaaccaagttcttcgacaagtgacgaataatttctgcgaggagaacattataggcagggaagggtttggagtagtttataaggggcagttgcatgatggaacaaaaatttgctgtcaagaggatggaatctgttgcaatggggaacaaaggactgaaagagttcgaagcagagattgcagttcttagtaaagttaggtatagacatttggttgctgttttagggtattgcatcaatggcattgaaaggcttttggtctatgagtatatgcctcaaggtacgttaacacagcacctgtttgagtggcaggggcatggctatgcaccttggacttggaaacaaagggtagtaatagctttggatgtagtgcggggggtggaatacttgcacagtttagctcagcaaagcttcattcatagagacttaaaaccctcaaacatactactagtcaatgacatgagagcaaaggttgctgattttgggttggttaaaaatgcaccagatgggaagcattctgttgggacacggttggctggaatatttggatatcttgcacctgagtatgcaggtatagaaagcctttgattttagttctgtacaattgtgccttaattgtgaaattcatattttacttatttggtggttatagttgtaggttactacttcgatggtgttcagcaaatttaagtagttcaatagagtaaccacacataaaaaaaagaaaaagttgaaagggaaagtaattgatactaaatccctagatacatggctacttcagaattctttgtggctatttctttgcaatgttatattttgcctgtttcacgtgttttttttcagttgggtaggggttttctgcatagttcttggtggtcgatgcctcaagttattttgagccatttatacagtttacagagtctgactcccaattatcctttatgatgtgatgaatactctggtttgcatcaaatcttggattgctgtatattgtcatgagcttaggtggtagttctctgtcgcaattaatcactgctgtggaatttatccttccatcccattgccttggtggctcagtgcattgacacatcttttgttaaaactagttaattttgagcttgttttgatccatttagcatcaagacttttgcaagcataaaacttcctaaaatgttgcattggatgtgattagatgcattttattagtgctagtctactctattcgtttgattatatttaatgttactctgtttcttgccagctactggaagagtgacaaccaaagtggatgtttatgcatgtggagtagttttgatggaacttatcaccggtagaaaggcattggatgatactgtgccagatgaaaggtctcacttggttacatggttccgtagggtactaattaacaaggaaaacattccaaaggcaattggtcaaattctcaatcctgatgaggaaaccatggagagcatatagaaagtggctgagctgccaagccaatgaaggcacttcctcaatatttaatgacatttccatctcacaaacccaatcaagcatcccctctaaacctgtaggatttgcagactcttttgattcaatggattgccggtagccaaattgataaacgagacaactatccaagggcatcttagtccatatgatagtggaaggtttgcttgagaatacccaagaaaaccagaggttgtaaagctgctttgatctattagcatcaccaatttctttgtaattgtttattattttcaaaatgtcatcttttgtgttcttaaaatctactcatctgaactaaacatggatctctgagtttggcgttctttattgattcttttaagccgacggatgggttttaaaggatggttattggttgggttacctgatccggctgattgtgagcatgattattttgtttctactttttttaggaatagaaggactatagtctatacatttattattttattaattgtattatattctttttttcccccttttgaatcagaagtatatttatcgcatgtttgatgtttcataatctttcttctttgcccgttatgcatctatttcaacactccatccacctataaggtctagtgtgtgtataaatcatttccactcgataccttacaaataaataatgatttaccaaatggagcaatatgttctctggtcaaatgaataatgagaccacctgcccggaatttatgatgtgttgtagttaggaaacttaaaaaaaaaaaaaaactttgtacgataacgaaatctacaaaattgtttaagcaattgagttggggatgaggtggttagatagtctttatgtaaatagtagttacaaaatttaaatcctttaacattgttggtaaagtctagctaaggttctatacctccattttggaaggagagaaatcaagccttcttaccgtacctttnagttacgaaactttaaaaaaaaaaaaaaaacactttgtacgataacgaaatctacaaaattgtttaggcaattgagttggggatgaggtggttagatagtctttaagtaaatagttgttacaaaatttaaatcctttaacactgttggtaaatctagctaaggttctatacctccattttggaaggagagaaatcaagccttcttaccttacctttcgtggaggaggaagcaccacttgaacaatcatctaattggtggcgatagaaagagacataaagggatttttttaaaagaaaatacataattgcattgatatactgaataaatttaattttttgaaaatggatataatcttaaaatttgggtcgtgatgtggtgattttaatttcacatgatgagagcctacacaatacgtgaacgcacatatggtgattcaaagctcagtcagtagatggatgataactttcgcaacaaagcacatgttatgtgttactgatttctgtcttctttattgtggttacgtatgccgtatccatgttaagttgcccaccacattctagatgcttttttttacctattggcaaaaatatagggcagattgagcagttgaaaataattgaattggtaatgataattgagattcaattatatatgaaagagaattgacccgaaaaaatcataaagaaagaaaattgcaattgttagataattacttcgttaccttttattttattgtgcctgctggtttttataagaacgtgaacaccaggttagcataacaagtgtggagtgtcatgtgcttagggtggtcagtggaggttccatggatcctccaaatttcaattgcaatattattgggtggactatgttccctgtttccaccatataaaatagggtttgtgtctcttttaatatcaccacttagtgtattgttatcatagcagaagttaattgatatatattaacaaccgctaatgatatcaacgaaggaatagtacgatggagggtaaaaaattcagctgcttcatcgcgtgtctgtgtatcaaagctgaattccatgggcaatttttttataaaaaagatacaaagactaaaacaaaatatcgaataaattacaatgagtatatttaagtctaatagaaaatagttaacttttgaaattttcctttaattttagaatgatcgtaatttatctattttcaatgattcaattgttattttttctttttctttttaggagcaatgattcaatggtttgactaatgaacttagttcatttttcgtttgagaggccttattattgatttcaaactaaagccatcaatacaagtgaaaaaaaatgacaggaattaaaagaatgacaaaaaggaattgacaaacaaatgcaacatatagcaagaatcaatgttttattctgcatttataatgcctacaaatcaagctatagtaaatggcatcaaggtttgtaagagaaaacttcttggatctacatttaagaacaagaaatctccgaagaaatgagatttaatggaaatggttggtccgaagcatatctaaatttgacaggaattccatatatggtttgaccaccattaacaagacaaacattgtgcaagaccttcaaaagtgaaggcttttcggatccaacggattgaaatcctttacaatttaatatcatattcttttgaacacacggacacttattggtgatagtcacactccattcttgttttccttgcactttatttcttgttggaaattagtgagatctttcaaagaacattgacgatagcctgatatcatgatatatggagaaattactaacaacaatatataaaaaaattatgtttcatacaatagaagaaagcatttaccttgagaaatgacagacaaggaacaaaactatgctaagaatcttgatggttgaaccagccatttcagaaaatgtaaatacaagcttcgattcttgaattgtatagctatgttatgttttgttatttataaacgaattattgcaaaacaatatgttttacgtttacatttggtgtgaaaaatattgcatttatgaacgattgaatttttaaaacaatgaaactgaaggtaaagaaacataaattactcactttaaaaaaattaaatacagtgaaattgtatagatttgataaatatgatttttttaaatatttgatatgattttattttactaggagaaagctatatttttgttctactatttctttcttggcatctgacaaagctaattaaaaaatatttcttgagtgtttaattgttttaaattgatttttttttaatttaaaaaattgttttcaatataatttttaaactttgttttcagtatagtattttttaaaaaaaattgttaaactttcaaaaatagatttattttataaaaaatttcataaaatatcagcatttatcaattacatgttgtatgagataaaacaatgttttatttatgaaagtatcataagatccaaaacaagagtaggaaagtaatttttaaaagacatttttttaagcagtgcaattgttcctacgaacaagttttaaaataagaatgtcttgaaaatctttctaatacttaatgaaaaatattaaataaaaataaagatatttaatgttttaaaactttaaaaacattcaaatactttctttatttaataagtaagaggaggaattattattattcaatttttttatattaaaaatattacaaatccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcttcttttttttttttaaagaaaaagaggtgaaacgcccaaaataaatcatcataaagaagataattaacgtctatcgactttgaggagaagaaataaaacaactttattaaggaaggagaaaataaatttaaataattatcacaaataaattttgtataaatacaaataaattataagataataaatatgatcaatccgtgaaaaaaattgtggaagagcaaaatttgtgaaaataaaattgaaaaagaaaaattcacaatattatagaactttatagataaaaaaaatataataatcaataaatttcaagataaataatatattacaattttaatatttagttttgaattgaatcaaatgagatcatatatgctaacggtatttggtcaaactagtttataaactctcctcgtctctttccaaaaatactctttgttgaagttgtagttagcaagttattatgcattagagaatttgctgcaagaactttcagtaactagttggattggaaaatgttgtatccagctgtaaatcacctattccattattggaaggaaagattccatgcgaaaatgacattggtgaaaattgataaaggtatagagaaagtggagctcagaaaggtgttattcttcacaaagaggagcaatttccaaagcagcgagtatattactcgtgcaactttttattttttacatatatattattgcttgggctactccaattaagagaaagtagaaaacaaataaatggtattgattgatgttacgtaagtcacataaaagtttgatgcatattgtaatttactcccacagtcatttattggacttaaagttgaactgtgtaggcaaacatgacttaaagtttgattgcagcctctgcattcattccaatgacccaagttttataagcttatagtattttattaactttttaaagtgggaaaaaaacggcatagattcttcttgcatttgctatctgattctaagcaatccaatttcaaggaaaatgtcgtgcattgcatttcggtatagaaaataataaagaattatgttattcatgtaccattttgagatgtacaacatgaaaagagaaaaagaaggaaatttatcctctgaattttttggttgtaaatgaaaggccgatccattcacagatcatgcaaaactgcaaccgtaaatttcaaaattgtcatccaaaaagtaatctataaaggttcgtacggattcgtaatccgtatgaatgatcaactgagctactagaccattcatgttaaaaactaatttaaattgctatatataacattataaattttaatgtatatttaacacataaatttacataattaatttttatctaataatatattttttacatatataaatttttaatgtatatgaacatctaattttataaaattaaattttttaatatatatgaacctaatattttattaaaatctataacttttaattaagccatatttttattttaatttatttttatcaaaaaatatattttataattaaaccatgattttatctaatagtatattttttatccaataaaatatattttttataacaattaatttttaaaaatatattttattggataaaaaatatattattagataaaatcatggtttaattataatatatatattttttaacaattaattttaaaaaatatattttattatgtaaatttatgtgttaaatatacattaaaatttataatgttatatataacaattttagttagtttttaacatgaatggtccactagctcagttggttagagtgcggatttgtaattaaaggttatgggtttgacacctacttggaccatttttgaaaatcattttaaaaaattttaacttgtacggattacgaatccaaaagggtcttatggattgcgaatccgtaagagctttatggattgcgaattcgtaagaaccttacggattctttgtttcgtcttatggattacgaatacatacaaacctttacggattgcttttagattacgagaagggcaaaattggtattgcattgtatatgttgggtgtattagaaaaaatgctggtataggaagttaatgtcgtcatactcgtgtactttatttatttttcttttgaaggggggtccaaatagggaccagatctctgcattccaaaagtaactgcagcaccctgcaatcctcatccaacggttcgaaattttttaagctgtatttctctttattatttaatatatagttatttttcatggtcaggatccaaatcagccaattttattgagattactcaagctattttttgctatttgctatgcttagaattttctctccggcaattttgctttgtataaaacttaagatgcagtttcttagatggcttttgacattatttttcaatcataatatgagttccattccatgttttatgttaacatttaatgcaagtttcggtttacagaggtaaaattctaattttaattggaagacaacactaaaaacactcaagaaactgcatttttttcccttttccttttgcattagaaaagactggctacagtccagtcccattgatgacttaaaagcaaaagatgggactcaaagtttagaaaaagaaaaggtttcaataatcgtgggatgatgatgggttttggactacattactacacaccactttatgatctgcatcatttcactataccccgaaaaagcattgatagctagagttgaattttacaaacaaaagattagagatgtataagcaatcagatcaaactgtgattaatatctatggcattaatgtctaactcttttttgtgtgattttcttgattgcttaatttaatcactcaaattaaagaagtatactaccaatgcctgttattccaagtggactctagcttgattctttttaaggttttgatttgattcttatgaaaaaaagggtactaatgagagagatttgtctccttcaatgagtgctaactcggactaggaatttaatttttttagacagacggattaggagtttaaaaactttgacattggctaactgtaagacatcatatggacatttagcaaataggccataattaacatcattaatttgtataacaaaactgataaaataaccaatttgatctaacataaatatttaaaatacagaagtgaaactttttaaacttaagagactaaattgaaacaaacaaaaataagacaagagaaagtatgctttagccataaaaataaaagcagtatactaactggcacatattcctccccaacactcgctgatgatgaagatatttgtgcatacttttcatccgattgggccaaaaaattaaaaagtgcactgcacaaaaggaaaggactcccaacttttcttattttcaaaaagttacattatatgcatcatacatactttgtatgtttttatgcatttggaaagcctttgaaactctcctcctattagataatctgataatggatactaattcaagaaactggagatggtcaagaaaggcccaattgcttattgcttctgctcttctcttactgcaagactctctggtcaactctgctgaaacaagatctgtgagtgcaacttaagtttctagttctgctttggtatacatgtaaatacatgtcattgagcacaatcaattattaaataaatgcttctaggtgcacattgtatacatgggagataagatatatcaaaatccacaaactactaaaatgtatcaccacaaaatgttatcatcactcctaggaaggtatggcctgtgtccctcacatactcattttctaatggagctgatattctattactttaataagagtcaagaaaaaaaaataacttttaagtgttttctttttgttctgaagcaaagaagctgcaaagaattcgattctttacagctataagcatggtttttcagggtttgctgcaagattgacaaaatatcaagcagaagcaatagcaagtatgaatgatccttgcattaattaggcttgttatttaacccagtttagaacatttcaaaagttatattatataccatgtaatgcagagtttcctgcggtagtttctgtcattccaaatggcattcataaacttcatactaccagaagctgggactttatgggggtccatcattccacttcaaaaactgctttctctgacagcaacttaggtgaaggaaccatcataggtgtcatagacacaggtagtactagtagttaattttccttttaacaaaaataactaagcagggcattggaaagtggcaatgtaaccaatgacaaatatgatttcttgaaggcatttggccagagtcaccaagtttcaatgatgaagcaatgggacaaatcccatcaaggtggaaaggaatttgtcaagggggaaagcacttcaactccaccaattgcaataagaagataataggtgctagatggttcatgaaaggaataagtgatcagactaagaaattcctccaaggaaacaacactgatgaatatctctcagcaagagatgccattggccatggcactcacacagcttccacagcagcaggttactttgtaggaaatgcaaattataggggacttgcttctggtttagccagaggaggagcaccgttggcacacttagctatctacaaggcttgttgggactttccaattggagattgcactgatgctgatatcctcaaagcttttgataaggctatacatgatggagttgatgtcttaactgtttctcttggcttttccattcctttgttctcctatgttgatcaacgtgattcattagcaattggttcttttcatgcaacttctaaggggatcacagtcgtttgttctgctggaaattctggtcctgtctctcaaaccgttacaaatactgcaccatggatcatcacagttggagctaccaccatagatagggcctttccagcagccatcacccttggaaataaccacactgtgtgggtatgctacaactatttttgaatcaacctggtcaaatatgctaacacttaatacaactgtcttaaatgtgttatatatgtatgtttaaaaaaaataagactttacatggttttggttcttcaacaagaatttccactaattttagttcttgcaaatttttaattaactttctttaaaatgttcttgtcattattaagtggtgacgtgacatgcaaaaaagtcatgttatcttacattgatcactaatgtaacatgattattcgtatttcatgtcacctccttagtaatgtcaaagaccattgctaataatctgtgtcaatgcattgacaatgtaaaaattattgtcattcaatcgcaaaatattatgtaggttaagtttgttgatttttacaaaaatcatatcaaaaacaatttttgattggttggcaatacaaatttttacactgatactgcataaaaattaaactcattttataggattaaaatcacctgaaatcatatttatgagaattagatacatatttaaacctgtgattattgttatatagggacagtccattgatattggaaaacataatcttggatctgttgggctcacatattctgaacgcatagctgtagacccatcagataatttggcgtgagacctctttttttttttctttcatttttactgttttttttatatcaaattcctgtacattttatatctactgttcgtgtctgcctttcaagcaaggattgtcaatctggaagtctaaatgcaacaatggcagcaggcaaaattgttctatgcttttcagtatcagatcaacaggacattgtttctgcagcacttacagtgaaggaagctggaggagttggactagtatatgcacaatatcatgaagatggactcaatcaatgtggttcatttccatgtatcaaggtagattatgaagcggggacacaaatactaacctatattagaagatcaaggtgagctaatatacttagattgacaacattggcttataaaatgttcattgagttaaaattaatattatgcttatctggaaggtttccaacagcaagcctaagttttccaaagactgttattggaaaatgtacatcacctcgagttgcatctttctcatctagaggacccagtagcatgtctccaacagtgctaaaggtatatctggacctcatttgcagacatgattttgtttttattcaatcagaccaaacttttttcccggaaattttgagacaaaagcaattaaatatagttcatactttattataacaacaaaggcaaatttgatttgagcgtgcttaaaaaatgtttatctagtgtgccatgatctgtaaattgtagtcaacaacttaccataaatatttattgctcttactccgtttttaattatatgatgtcatcattaacttctactttgggggatgattcatggaggtagcctgacatagctgcaccaggtgtggacattttggctgcatttccaccaaaaggcactacaaggagtagtggatttgcattcctatctggaacttcaatgtcatgtccccatgtggcaggaatagcagctctcatcaaatccaaacacccaacttggtcacctgcagccataagatcagctttggttacaacaggtgagtcagtagaaatcattaaatcaacaaattaaaattacatatttacattattacatataatagtctgtatccaatgtatctaattaattgttacacttaaaaattgtagcatctcaaactggaactgatggaagccttatatctgaagagggttccacacataaggcagcagacccttttgatattgggggtggacacgtggaccccaataaagcactggatccaggactgatatatgatatcaccactgaggattatgttcaattcctatgttccatgggtcacagtagtacatccattagcaaagtgaccaagaccaccacaagttgtaagaaaggaaaacaccaaaaactgaacctcaaccttccttccatatcagttccaaacctgaagagagctgcaacagtaatgagaacagtgacaaacgtgggaaatattactgcagtctacaaagctctagtgaaggttccatatggcataaaagttagagttgaacctcaaactttgagtttcaattcagatgcacgaatccttaactttagtgtcagtttcctgtcaactcaaaagtttcatggagattacaaatttgggagcctaacatggacagatggcaagtattttgtgaggaccccaattgctgtgaggaccatacagtttgaatgaataataagcggatgtgatatgtagaaatgagcttaattggtcaacaaaatatttaagttcttgtttggagtcatactatgaacttagtatattctttggtgagaatatgcagcacatttctttggagaaagagaactcgtcactcagggaatatactgttcattttcaagattaaaaacgttacttgattgcaactaacaattgcttttaaatgaaatagatacttgacaccgatttcaaactgtgaagagcaaatgtcaaatattagaaaccaaaaaaacgacactgattttgacggtatcttaaataaatatatgagatatagaatttaattagaccaaaataaattaaataaaacttatataaaattgaggatttgattcgaattgggaattttttaaaatatgaaaattaaaccgggaatcaaaattataattcagtctattattatcaaaaaggagaaagtatggtactacattttttaatattcttttcaactttcctctaaaaaaaattcttttcaactttgttttattagttaaagtttatgtggattatactaattttggaatgaaactcattaaatgaaaaatgaaacacatatttaaccagacttgcgtcaattatgctccaaaaaaaaatgaaacaagaatgtcaaagagtctggtgctaatatgaatatatgaaacaagaatatcaaagaatgtggtgttaattttttttttatttttaaatactgatggagtgacggaagcaaaagaataaaaagtagttcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaaatgaaaaatgaaacacatatttaaccagacttgcgtcaattatgctccaaaaaaaaaaatgaaacaagaatgtcaaagagtctggtgctaatgtgaatatatgaaacaagaatatcaaagaatgtggtgttaatttttttttttatttttaaatactgatggagtgacggaagtaaaagaataaaaagtagttcaacttccatgaataaaaatggtctttccatgatttgcacttaatctaaataaccaagcacaaaatatatgaaacttgtgcatatttcagtttagtattaaactattaataattattgattagcgacagaatttagatttataaagacagtacagttaattaaatatattttagtaattattttaaaatattctttcaataatttaatgattaaattaattactcttttgtttttacattgtaagtgcaagcatctactacgtgcaaaaggaggatacgatactcaactatagattaaacttgcacatcatcatcagtcttttttttactatagattaaaaaggctgttagcgaagttgaaaattatattaattctgtttacttccgttcctttacaatataactcacaaaaaagggtaatggagttctgttccattcccttattattcttccagacaaaagataagagaaacaagcctacattacaacgttataagcagcaaataacctacaaagaaaatcaagataaataaatagatgatacaaatttgcatgtgtttggatatccaatcgacatcatacgtttcgatcaaaattcacgttttggacataaaagcaactcttcgttgcttcagataatgtgtcacgaagcagtggatgcgaaaccaaacatagaaaattatgcttgcagaatgaaacttgtgagttatgatggagcaccaagatatgaggcaagtcgtaaaatatcactaaatattccaccagctgtgacttgagcaccagctcctggcccacgaactatcagaggttgatccttataccttcgtgttgtaaatgcaataatgttatctgacccagacaattgtgcaaacggatgatccttcttgtatcttcgcagctctaccactccttttttattagtcacgtccaccactcccacgtatctcaagaccttcagagtgcaaacataacaatctcagagttgtatgtggaggacatgaaaaatatacgtatatttaatggacataatatacatatacgagagatgtcatcatgaaaaatagacgtttatatatatagtcaaggacacaaactggagaccgcaaacccaacataaatcaattgtcatacttttacttgaaatcaaggtctatatggaaatctaggttgcttgaaatatataacaagcatccttccatcaggttggagagagagtcttcattaaccaaccaattgaagatttgatatgcaaaactttggcgttttggtatgtcatcagtctaatcagaaaattcctatcccaccttctgtgtctcaaataagtactatatgtttctgtgtcatgtactatgcagaattaaaataaatatataacaaactaagggtacctaatttgtaaggattttttttcccttttcggttatcactaaaaattataaaatgcccccttttcaacattacctgtacatatctttgaaaatataaaagaaaatgaaaataaagtagcagtttttttttttttttttaatttgtatggaaacaaaacaaaccctaagatattccatgcatgaattatgcatgtatgaagcagttggtagaactattctattagatactttaacatagaattaatacttatttttttggaaaggcacatagaattaatactgtcttagaatttactcacttccccagcattctcagcatcttcttgtttctttgtgaactcctgatcaaattttggtagctcttgcataaactcctgagctgatgcacaagcctgcacagaatcatcaaaacatctatgtcaatcaaaatactacatattaaaactaaaaactgcataatcaatagaaataggttcttactcgtagtggttctggcacaaggctttcaactggaatattagacagttctagctttaaaccagactccctagcaagaattatcacctgtagagtcaaagcagcttcaggatgttgattttaaatcagattacatgaagcaacaaaatgctaacatgaaccaatatcgacattgtgattagcctacatgatccaattagttgcagaaacaagcaagccttccgattagttacaacaacaaccaaacattttctagaatggggtggtcaactaaatatggatttcacaataaataaattaaaaaatacttaccaatatatttatttatttctacatttaaaattaaaattaggatatttgctcaacaaaatttgtgtattggcaccaaagaggactattgataatattaatttcaattgtgtataggcacaaaagaggaatattaataatattatcaacttttgatttgtgtttttaaatcattaaatgctttcagcatgtcaacaattaaaaatatcaaatttgagcatgaatcgaaatacttgataactggataggtagatgtatatcaaatttaaattctagcctgaaaccgaattcaagcttcaaaatgtttgatcaaatgagcctcaaacatataaatatttaatttggatatagtcttttagatcatttagattacagcctactcataaatcctaaacgaaatccaaattcaaaatatgtctgcagcataaaggaactttattaacatttgacaacaaaatttggtaaacatataccatattataaattgtacctttctggcaacatctgttccagacagatcatctcttggatctggctcagtataacctgcttcctttgcttcagaaactacctcactaaaagcccggccatctttaaagttattaaatatgtaactcaaagtcccactgcagattcagaggcaatactcatggtgaatggtcgagattaatgaataatcgccatatagtcattaataatcctcaaaataacattctattttttttttttttggctttagaatgggaaaattgcaagagggtggacaaaggagactgaatgcaagatctgagaattgacagtgtcaatccaaaaaaaaaagagaaataacacatcaaagcaaacctaaagatgccttcaatttgcagtattttgtctccagtttcaaggaggccacgtaaagtgctaacaattggaagaccagctccaacagttgcttcatagaagtaatgtgtataggattgcctttgaagagctcttaacttcaaatactggataaagagagcatagatgtgaaaaagctagcatgagtactaagaagcaacaactgctgaagcttaaagaaaacactttcaaaattatgaaaaatattattaaaacatgtcttcaagttcaaagtacttgttctatcagaaaagcatgaacccaagccaatgcctactgttgttcagcgttccagtttatgctaaccatgaaatttgatcgtagatgttaataactaaactatgaaacatcacttggtgtataaagcaataaatttccaaattgctaaataaaatggaatgacaagagaacaagttgcagactggttgacatcaacatttaaatgtaacaagcttatacttataaatcattcctgttagaacaatggtaccactagtcaacagagtccagtgaacctgggtttagagagagaaacagagaaaagagtgagaaaattgtttaaaactgaaatgatgcattgaatcattaattttgttggctccatagtcttgtatagtgaactttagcttgcacttcaataaccagcttatcactttgaaatttagccaaactgaatactatgctgagtctgacgcagctaactacaggttagtgacagccatataactgctggacaataaaattacaattactctggtactagcaaatatgatagctgcaaaaatgacacagaaactcacatgatgatattttgattttaaaaaagaaaaaaggaaaaaatagacagctgccagtggatagaggtatgaagtaaatgatagaaataagagtaaaagcttcctatccaaactccctaatattgataatgtgatgatgtgtatttccctttcctttaaatgaattattctttaatttataaaaaaaaacaaataaaaaattagaaaataaattaatccaaactaatgtctggaaatttccattttcagccgagtacttgcagaaaaaatatcttatagcattgattacatgagatacgtcaacaacaaacacaaacatgttatacatcaaaagaacaatatggattactttacctgatcaagtggtcctgaatttgccttcttatttggagtgactacatgtattcctttgcgcaaccagtcatagtaatagccagcaatgacagagtcagctgtgcagtccactaatgttgtgtttggtataaaatgatttccatgtacatgttgaacaaatttttctatattagccacttctcctctttcctctcgaagttctctccatctagctaagtcaatgcccctgcaaggagcaataatagtatataatgattgaacaaaaaccaacttcaagaatgcacatataaccaacaaatcataggatgaattttgttgatgtagctccaggaccactgtattaaccaatgaattcctcttgccaacagattaacttcataattgttagcaagagagagttgtcaaaccaaagtaggaagtccaaaaaccatccatatcaagaaacatggctccccaaaagcaatcaggtattgcctacattttgagtccattctatctaggagacctaatcatgttattatggcttacttaaaaatataataatcttctttcatccaaataacaatacataaatgatatataataaacaataaagctttccaaaaacagtaaaaggagtgaagtgtaaaatgaagtctgctttctcacataaaaggcctcttagttatacaagcaagaaatttaattatcattcaaagacatatttcagtcagagtggttcaacttacacatcactaagaagcatcgactttgaaccaagtatgcccattacacgcaaatcaatgttgaattcttctttcagggttgaggcctgcattaaaagaattgtcatgtgaatttgccacatatttcaattatagtatgttaacatgataaaatgaagttaccccactatagtataccaggaacatattttaacacagaaatgtaaaaagcttgacaggtatcaaatctctataaaaaaaatatctcccagatgcataacaatgttagaatccggaaagttgtgccttggtgacttattggtcataggttcgaatccagaaacagtctctttgcatatgcaagggtaaagctgcgtacaatatccccccccccttaccttcgcatagtgagggagcctctggacaatgaagtacgtagttttatttttatagtttttatgcataacaatgttagagttagacaagtaaataccccatataagaaacctattaatatttaataaaattctagagatagagagagtctgaatctattttctgttattgattaatgaatcacttattactatctgattgaagataagtttatatactagagctaccttgttctgcaagcttacaataggaatttcagctgtctacagccattaagaagactaactaaacttcagttaagccaattctaactgtgctttactatttaagtcctagtttacaatttctcattctttttctttcaattacttgttttgaaagcaatcatctgaattttctctatcttgtataatgataagaaccttgggagatttacaccacaaaagcgagtcattgtagtttggagagtcaacagtcttatacatcctaaacttcaaatatgagactcaagtctcataccttgcaattggatcctaacattccatcttgcttcccagccccgtgcccacatgggcaggctgcgcaataacctttaactagtccctagcaaaaactacaatgccagcatcaacacacatgtcactcatttgtagttgagaaacacagtggaaatatctgatatcaattagataagaaccttggaagaaccatacaacaaaaactagtcattgtagttggagaccccaaagtcttgtatataaacactacagtagaatgtcacatttctaatgtggtggcaccttttttacttacattgacaaacaaataaattcttttgaaaatgtattttaatccgtaaaacagttacaactggtgcagcgtcaacataaagaaaattacctgctatttaaaataaacattattcttcaattataggcattatttccttgaagtggaattttaaatttgaaaaaaatagtcaatttcacagcaaggataataaaagccaaattacacaccaaaacataaacaaggtaaaaccaaaaaaactattcatgcatacaaaatcgtctacagaaactgcacctgatcccttagctggtcaagtagtgtgctcccaattaatccaggtccaataatgcccattgctatgctggttcttgagagataaaatctggaatggacagctcgtaaagcctttatacaatcctctcgcttaacaacaacagtaatattgtactcagaacaaccttgcgctatagcacggacatttatattggcctgtttatgaaaacaaactagaacgtaaaacaagcgaaaatatataacaaaataagcaaaaatttctaacctaagcaatatcttaaacataatttcctaaccttagccaatgcattgaaaagggaggcactaacaccaggagtgcttgccattttctggccaacagcagccagaatgctacaatttggaatgactgcaacctgagagattatacataactttttttaatgcaataaaggtaattaaatagcaagctttaaattttaacatcatcagtcacatatactaatttaaacagaagaaatgaaattactcggttctcaagtttctacttcatgatagttaacaaacaaaagaaataagcacaaactgatggggaaaaagaagacgaagaagaagcattccatttaacacaactttcacatccaactatcttgtgaggaagaggacaagagtatattccaagagactgcatttccttttgattatcaaacttaaacccattagtagttctatgttccagtcatttccttttttagttcttttcctcttctttcctcctcctttcactcctcttttattttagtttatttttcctctcttttgtcttttttctactttttcttcccctctccctttcgcgttctttgtcttatttctgatttatcattgggttcatctaccaccgatcccaattaacttgggttaaaggtgttgttgatgttgatgtatcaaatacgttattgccatattttcagagcaaaaaagtagcaaatccctagttagtattttattgaattatattatgaacatccttacatccaagcatcaaatacaacaattggtgaacaaattcaaaggtaacacccaaactttttgtgataagcgagcaaagataactcaatgcaattcaaccatggcttctacgggcataatgatctattgttcctggaagactcaaggctcaagccttagtgttatttgatgtccttcagccttcatctttggcactttaaagaagttcccaatggatctttttgcttgacattttatagtaatccttgatttttatatcaatctagtgccaaaaataatagtcttagtcccaactgttgatatctgcatcaatgatgtttgcttccactgttctagatcataatgagtggactgtagcttgcatatttattttaaccctaatatgcccttgttgttaattaatattaagatgaaaattaaaacacttacgcaatgaagacaaattacatagaaaagataatacaacacttaaaaaaattaagagcatggcaccatggttttaaattgcggtctgctaccacaattgcagccgcaacataaaagttttttgactcatgacaaccacatcgcaacagcaatttaaaaccatgcatggcactcaaatgtttcatccagtttttaaatccacaaaatgtggaatgataaatcttcagtctgatatcactcaagtgagtcaaatcttaacaattgaacagaaacatgcatttggttttagaagaattggatttagcacctgagaaagacgcccattatccaaagcttgacgaaatctagattgcaatgcctcagcaactgcttttacctctttctcgggcacagcaaagcatacagaatgctcactactagcctacacaaatactgttactgattaatgccatttcttacaacgtgaacaactagaaaattgaaaaaagttataagtgcacctgagatatcatgataacattagctccgacatcttttactgcaccaaaaatagcactggcagtacctggaacaccagccattccagttctgcaaaaaagcatcagagaaaaattcattggaatctacaacttggacaattaatattggttaaagaaaaccttaaattaaatacaaatcctcatgcagcaaaaaatgccaactattcataatgtaacacagctgcaattcatgactcacccctcaacatttataagtgccaagttgtctatggttgcaaatcctttgacaaaattttgcaggttctgcatatcttcatgatcattaacagaaggatggcagatctttgttccaggagcagaaaggttgaaaatgttccttatcataatgggtatgccatatcgcatcacaggaataattgtgcggggatgcaagacatttgcaccaaaataagactgtacaacagacaatttggaagttaatctcctttatttttatgagcagaaggagcattgaggctttccagcatctaactcaccatttcccatgcctcttgataagacagtgtcttcaaaatcacagcctcactaactgcagaaaatataattgtttatatttaatcaaaacttcatgttacggaagtcaaacacaagacaaaagcatcatcaatatgtcagagctagaactccatctggttactaaaaaccaattctcatgatccagtccactcaatgtttaactcagacacaaagtacaaagcataacaaaccttttctaggatctgcactatacacaccatcaacatctgtccaaattgtgacctgacgagccttaaatagagcacccataattgctgctgagaagtcacttccatctctcttcagtgtggtaggaatgttttgaggtgtgcttgcaatgaatccagtagcaatgattaccttacatggattcaaagagtaccatttttcaagtctttgctcagattccaaatagttaggatcaacttgattagaacctgtaggatttactataaggacatcccttgtatccatccatttgcaatcagccccattctgtagaaccggaacagaagcatgatgcaatgagctaaattcatataaagggggaaaaagcatatctttctaaataaaacagcacaccataccttcgtaataactagagacaacatctgagcagaccataattctccatgtcccacaacaaaatctgtaaaggactctgttgcatgaccagctgcaagatattaaaaatgttagtcaggcttaaaatgcaattccttaacccaaattcattttaagcaataatatttatggaaaactaaatatcactttttgttgtggaaaaggtgtttacagagatcacactatgaaattatgggaaaaggtgattgagcatagactaagagaagagactggaattgtttgacttaatttggatttaagccaaggcagtctacaacagaagcctttctcaatcttaaccacccagcttatatcttgcgtgtgacttgttcattaacttcctcatcattctgtaatattgatcctatatgcttaaacttagaaatgtgtggtaagatattttctacaattttcacttctaaatcattttccttttgtttcaaaaattgcaatgcatatatattcctttctgctcctactcaagtgaaaaccattttattccaaagtttgtcttcaaagcttaagtttagaattaaattctttccatgattctacagaacgggactgattgcaaatatatggatacaagggatgtccttatcgtaaatcttactataaatgaagtttaatgaaactaatatcttattgaatcatctaattcctgataagaacacagtttcaactctaattcttcaagtaattattacaccaatccttttcgcaagtcactttaggtcttatactaccattgcatgcaggacaaaaaagcaccatggtggtaatctaagggttatcttcaactctagaatttactcaagaaacacattcagctgccaactcctctctgcccccatttcaaacttgtgttccaaccctgataaatggttccaaggaaacaacgtggtcagcaaatttaactttactattttcactccttatctcccttgtatatatctcttggtcaccaaccaaataaaacttgattggtgtaaagatcttaactgaacgaggatgcatagtgcagtgactagtttctgttaagatctatgttgaaccccaaacaaaataaagtcaaagctggtgaacatttatatatactttgatttttgacacatgaagaaacatgcataatacaggtgatgtgactaattgcatgtgtactacaggtcatctaaccagtagcatatatactacaggtcatacgatcaatacatgtatactacagaagtacagatcatgtgactaatagtattttccatgaaatacatctaatctgtcatgtgatattaatgaccaaaaagtaccatacattattattattgtcatactagtgtccaagacataagcaatgatcaataatataaaatagcaaccaagacatagctagtgcaatatacatcaacatcaatactattacaatgtgaaaacaacaccagaaagtgaaagccataaataccgacttataataaacaaggacaacatgaagatacatcctaggttcaaaagaggatttataaaagaaatagatataactgaacaagagaaaacagaacagagtatcaaagagaaagagagagttgatgagcttataacctatgtatattgcacgaagcattgccttaaggttactaatatcatgatgcaatttagacaagaaactagcaagattatctccatcaagtatgtcatgtgcagttgcactgtgcttctccaaaacagcatccaatgcagctatataagactcatcacgtgattgagccttgtggataaggtcatacatcatatctgtcacctttgacattgcagagacaaccaccaatttcctctccgaatcatccttaagaattatgtcagcaacattttttattctttgagaggttcctacacaggttccaccaaatttgtgaacagaccaagtttctcctttgggtagttgtttttcctccaaggacacactccgtgaaacatctgctagcaaataaagaaaaaaacataagttactatatttgtctatttcaaaacaaaaaggacatgttctatcataaaagtaagtcgcaacctgtaaatgaagaacgtactgtcgtacttggtgcctcccttcctcgtggtaaagtaagacccttcctgagaatcagtatatagcaaaacacaaaaatccaattaatttcatggggagaatatcatttaaacacgtatatactgccaaaattccgagaaaacagtttatgctctgcaaaggataaataaacaaaaaaaaaaaaggagagtagagaatatactgtgtgtggagtaaccaatcacttaaaagcttatttagaacgtatctgccaaacaaacgatgtttataacttttgttaatttgctcttataatcttattattcaaactgagggaatataccctcaaattcctcattcagctgataaacttaataatcaaacatcacgtttcataactgagattcgctctctcttctctgcttattctttttcttttaagagcaaaaacaaaaaagaattaaaaatagtaaagtcgcatcatccaataaggaatgttcaagtaaaacacaatagcgagtgactagctgttgtatgtgtggtcaaagttagaaaatccgagacatggagctacaaaagcattggtgtaatttgatctaaaaccaaatgcgaaaaggatcgaggaaacgacgttgatatgcgaaacctagtagtcgataggaacgtaccggagtgaatgggaagggcgcgagaggaagaaaggggggcggcatggagaatggaagagcctatcgtgagagtgagagtggagcagagtgtgagtgggtgaaacacgggagaactgagcgacggcggcagaaaacgacgccatgggtggtggctgctgctgcagagtaaaatgctacggaaataaaatgaaagcacgtgtgtatctttataaactacaatcaatgattactattgtcgtgcccctagggatgcaatgcggcggcgagactactttcctggtggcgttttactatttttaataggtctaggtaaaaatcacttacatttgctatttagtccctcacctgagaggaatcatatctacacagcctaaatagtccctaaaactgtgtaatacagtaatactatcaaatcagttaatgaacttttgaatttaattttcgaaagtaaaaaagtacgatatattaatatgtcactattttattatgggctaaattgtttaaattgttattagaatgaaccataattcatggcataacaaattttcaagttatcagaatatttgaaaaaacttatatttatctcatttgaaagaaacaattgaaaatttgaacatgtaacgtatcattaggggtgaaaataggtcaggtcagactttgacaggtatgagtctgactcgcattactattattaagtttaagactaacttattacatgataaaaataagttattaagatctgaatctagtttgtataaagatctaatctgacctgaaaacttgtatacaaatttaaattttgattaaataaaaataaataattaaaaataaaaaataacataatatatatgtttctcttatataaaacctatagcttgacctttttaattaaaaagacttttcccacccctaaccacaagtaatgcggatagagagaaagagcaatgcaagggtcccttgaattatattgtcttataaataggtcagtttaataggtttaacagactttttttaaagtttaagtctgacatttttatttaaacaaacttttcaaaaaatcttaatttagcttttataataaacaaactaggtcaagtcaaagaccacttatatccattttcatccctacctatcataagcaaagcttcatcttatttcactttattaatattttttttattagcaaatgttacttttgttaaaaatgtaccttttttttctcccttcacccttaaaactccattttcaaccattaaattaattttatatttttacttgactaatcccttatgagtgtttagtaggggagaaattttccaaaaaatgttagttagttttctatgaaaatcttattttcttgagttaaaattttctctgaatagtgtaaaaatataatattgcttttattagattatttattattgtaaataattaaagtaattgataaaaacattacataattatttgattttcagtaaacttatttaaatatccacaaaaatattgaatatcaatcaaatattattcattcttgaatatgaaaaaaattcttctcctagcaaacgttccgctaatgttaatagtgttgttattgtagtttaccttaatgacttgcattttttttttccaaagagacaacttgtatttatttacagataaatgttttttttttcagtttttatgttatagtattttcaatttaacttcaccgtgttcttgtctctactcctgcttttgtttcgattcctttgttggaagatgatgctattgttctctttgaatctttgatcatggcttttaataaattcgtcttggtttggggctgaaaaaaaacacacaccacaaactagttgaaatgaaaagtagcaaaaattagacatttgtagggagaataaagcgtagaaggaaaaaaaactaccacttggttttaataaaaacattttcccacaagcttatcttgcaaaattttaagaataaattacaattttagttcttgaaattttaggacattgttatggaagtatggactataatgataggagaatataaaatttaggaattataataataatactaagttgtacatatcgtagattaattaaaatgacaataattttaatttgaatgatttatttaatatttttaaaattttatgaactattataacgatgtctcatattttaaagactaaaataatagtttactcaaaattttgaacataacattacctttccctacaaccttcccaaatactgtgatcagtttgactcatgcttctgaacaaaaccagagtccataaaaggcaactacaattttttttcccttttgtttcggggctgatggggaattatagccattgtgagaattttataagctttaaattaaaatctacatattcataacaaaataaattaaaataaaaaaaagttatcacggatatttcagttataaataattcaaaatcatactttaaataatactcaatgactataaattttaaatttatttgtatacttatatttaccccatttgtcattttatgtgattaaatatagatttctaaagtaacatatgattgcatggtttaataataaaataatcaaatgttaaatatatactaacaaagattaacacaagtgatagtatcttctaatgattggtccaatttatggtcgttaccacccacgtaccaccaaacaaagctgcgtttagtaactaacagttggagaatttacttctcttcgacatctacaacaggtatagtagaatattgagttcaatgtaatctgtttagcatggaatcttaaaatttgtatatctatctgtcggtgtatgcacgttttctatatttttcatccattagagatgtgaaacaaaggacactgccaataaaaggaacctggtgtttacctgaacaagttaaatttgaaagctccctatactactattatttgaagaaaagttctttataatttacactaataaaaaaattcttaaaacatctggccctcgccacctacttgccacgtttttctttttaaatatcttttttaatgttcaataaaattagttttttagcacattgtgaagggtatcaattgattttacttcataaatgttagagtataagtctgagttaaagtctcacttcggatagaaatagaaaaatttaacactatataagtgagtagaagactcataaggttgagctttaaggttttgggtcaagatgtggtgtccaattcacttatatgactacaagtgtaaatctcctatatttatccctccttcccaacccataatatgtctcaaattttcattttaatgtatgtatacattgtatatatgtatctttgtataattgtattgcatttgcacgtactatgtaaagtacaattctacggtgttcaacatgtgttacatgcaataatgaatcataaacaatattataaatgagtaacaaacaagttgttcttaaaacacgaacgagtaagacaagatcctgttcttgaatttgtttattaagttgttgagttttgctcaaccttgtttttacgctggtttgatctcacctttggaaatcatagaagttccttgagtattaaccacttgttataataagagaaggtgaaaatgttgaaccggtggaaattgaagaagctgcaatgaggagtagcataattcaacaaattgttgttgttggccaggtgaattcttgaattctttcaatttctgatagctagctcaagcattatatataaaatgtacttcagatagtacaaaatgtagtgattatacttcttggtaataactgtaacttacaggataagcgacgtctaggaactgtaatcgttcctaacaaagaagaagttttgaaggtagcaaggaagttgtcaattatagattccaacagttcagatgtcagtaaggaaaaagtgacgagcctgatatataaagaattgaagacctggtaagacttatttcatttctgtttcttgtaatgaatgccggaaaaaagtttatgccttgttcagatatctctggtgtgctagtgtttttctgtttctgggggaaggacagtgtttgactctattggttaattagctttacttaaattttatgacaattaaagggagtaaactagttttggacactgttatggtggagtcactgaatgataaacaaattaaatgtattctataattgaactattcatcatgcaggacatcagaatctccatttcaaattggaccaatccttcttgtaaatgaacccttcaaggttagatttggaattcaaagcagtagtatcttgtatgttgttcacatcacaaaactgacatatttggtaaatccttttctccaatgacagattgataatggtctaatgacacccatcatgaaaattcgaaaagatagagttgtggctcaatacagggagcaaatagacaatctatacatgtaacctattgaatgccaatggcatcatcaaacacaagagatcattgaccgtatattaagacagtgaccttaaagtcctaatccttggttggcaattttttttcttttcttttctgttatcttacagaatggaagatactgttctcaacaatacattgacgttgatgtatttagaaaatttggctcgaactaagatgattgtttactaaaattgaagttaaattgcttgtaactgaaaatgtttgccttttattttgaaagtgataaaatgcattttccgtttgaaaataaaaaataaaaaacatcatgcgttaacttttaagtttttttagataaaaaaaggctaacgccccaaaaaactaagaattcaatcagaagtaggcagaatagtcaatttggttcttaaaagtatatgacggcttcaagttagtatgttaataaactaaaaataaagtcttcgaaagtagctttcctctctcacattcatccttcgtttcaaataggtctttgcatttacatgttatcattaaaatgcaatttagtcctgaaaggacaaatgtaaaagacaagctatcttcaagggctttatttcaatttatttgaattcaaggactaacttgaaactgctgtacacttttttggaccaaatcgaccattcaaccatagaagtaggatattggaaggtcctgtaacatcaacaaacattaatccttttaatggagagggagggtcgacaatccatgaacaccacaatattctctaggtccagtttgcaatcctacttaattgtggtgcctagagactctcttctctggagggggtactgaatttataaaattaatgttaaattccaaaagaaagaaaaaaaaaaaaggtaagagtctctcttctttggagggagtactgaaatgaactcctaaaatttgcatagtatcatatagattgattcaaaacatttgtcttctttacttgttttattttcagtttcagtaattaaaaaataatatattagtgcgtaaatatcacttttaagtaagaatatttttttcttctgctattttttcttagtcgacgtgtatttttcaattgaagagagtgaaaaagagacaagtaaaataaaagatgattttattccaatgtggatacaattgatttgagaaaatgtttgaaactactctatgtggtaaacaaattggaggttttctaaagctctgaattagtgaagtttcacattcgactgagttactggacttgaatcttagtataattaacgtaattagtatttcttcgaggcagtcgacatactatataataaatctatattttacggattggaatttgtaattcaaatgtggtgtgttaattttttacggattggaatttgtgtcacgtcttgggttttaatttacagcatgtctctgatggtctttatgggaggcatctacatgtatacagctggactggggtgaactgagacaaacattggaccttggtgagtcagggcttctaccctgggaggtacattgtttaatatataaatctggaattatttccaccagttataatgcactttatgtttttttttttttttttttgctgtaattgaagctattatgttaatgtacttgtgatttaatcataaatatgtttgtcctttgctacattttttctctctagcttgttcttgtgaagtattatgtgaaaggtgagataatttgtaagcaacttgtcctaaatgcaggtaaggtttctgcatgatccttctaaagatacaggtttcgttgggtgtgcattgtcaagtaacatggtacgctttttcaagactgaggatgaatcatggagtcatgaggcacataaaaagtatatagtaaaaaattaatccctaaattataggagaatcacaacatctcattaatcggaaggtttacattcagctattctatttttatttcattcctgtaattttgggattcctagttcttgaaatatcctatttatcatttcctttttttttcttcattttttctatatattgtatcggtgctcatatgaaataatagagactatataattttcttcataatctactctattcatagatatccatactgattttgtatagtcgtgtggttagtgtttgtgcagcttcaaccaacgcataatgatcaataatacttacagactagactgactttgcaggttgcaatatcagtgaaaccattgaaagtgcaaaactggattcttccagaaatgcctgggcttataactgattttctgatatctctcaatgatcggtttctgtactttgtgaattggcttcatggtgatataagacaatataacattgagggccctaaaaatcctgtactgactggccaagtatgggttgggggactacttcagaaagaaagccctatagtagctataactgaagatggtaatacttggcaatctgatgttccagacatcctggttagtgcagtttaacttttgaattagtgattctagtgttatgcttcttgcatctcacatgtttggagttgattggttcttagatgtagtagatataatagacgtgcattacattggtgccttaaatttttggtcacttttgtattttatcttatgtgatgcttaaacgtggtaaataattacacttataattttgacctttttgtggtctaaggtgaagagatcaaaaattgtaattttcagggaaataagttgagagctggccctcagatgattctgttgagttcggatggtaagcggctatatgttacaaactcactcttcagtgcatgggataaacaattttatccagagcttgtagagaaaggatcccacatgttacagattgatgttgatactgaaaatggaggtctgaaaattaaccctaacttctttgttgactttggagctgagcctcaaggtccctgccttgcacatgagatgagatatcctggtggtgactgcacttcagatatatggatgtgatagctatgccacttgaggccaggctacaagcaatatccatgtgaataaattccttagtccaagaatgaatagaggtgggctaatgttataaataaataatagttgcatatgtatgatgcttgcattgtaataaagttatattttcatgtagttttcagtactttctcatttacatcttcctaaacagaattctctgtaaaataaatcttgctcacctccaaaacttgggtctcctgatcgagtaaatctattagagtaacattctagattaatggccttaattgggattctatgattttcattcaaatcatgaatgtgctgcaccttctacgttgcttgttcccatttgaatgcatttgaaatcacaacccaaccaaatcatttcgttgtgaattgtgattgtcagatggtaacttgtagggcgccttggtcatttatgtgtttttgtagactgtaatgattcattctaattaggactccacctattttgaaaatgactggctcatttggattgacttttgaaaagaacctctgtttgctaataagtggaatcatctataagcttataacagttatgtcaacaataccatcacttaaacgccaaagttaaaataaatgagattgaacaacattattatagaatcaactttctagtttctagagaaaagttctgtgcaaaaattagttgaaggtgaacctattccttatgccttattccgtgaccaccaccaatggttctcatttctcatttttcaagttttagcactataaatggacagacttaactccaaaatcagtaccagaaaatgtaatgatttgtgaggaatgaagcagtaagcttatgtgaagggttgaaatggagtcttaaaatcatgctaaaaatgcaaacaagtacattattatggaagttaccaagcgcaacatagcaccatgtagcaaaaactgcttaccgccagcatcaaatccttacaacagaggatgctccaggataggcaacagcagaaattgaagtcttcagtccgttcaatgggaagaataaggaaatcatatactatgatgagtgctttcttggccatgcgtgttgttttggcttctgctttgtaaacacaagacaataatacaggatcaaataataaactgtataatgacatgaagttcaatatctttctttgaagctaagaaaaattgttatggcatgtatctacttttgttgtcccacaattgtgtggcatggagtaatttttgcatatattcgtaatatttattttgtgaactcgatagtctacatctattttatgaagtgtagtgaatccaacatcaaacccctttggcccactgtacaaaaaaactctgatcatttgaacctgataaatgcatacaaactgggtccataaacaaaaattgttgtgtcctacgtgcaaaaaaaaaaaaacttcactacccccattttgtttttatcatgttaaatatatgaaaaaaaattattgccaggtccaaattgcttgcaactattgaagcctgtatttgtcttgatattaaataggagtacttatccaaacacagtatcagtttgaaacaaactagttcatactattgataggaaatgcttccaagaatgctatgcaaggtgtgaagattcaaacctgtgcagtgtgtgccactttgtgtaattaaactaaaataatagaggaagaaattaagtaaatgcttggaaccatccttggctttacaatttccatgagtgcaataatttgagattggtgtgaaaggaactcaaagtcattgtcctcgttttattagagtcaaaggaaatcccgaaatccatagcccatagggaccccaccacaattgtatgttgaggtccattgtctgatagaagactgagagtttaggtggggcaacttcgaggaatatgtaccaaatattttagatgtatgattatatcaacacacaccttagcttctgttctctcctttttcttttgtcatgataacacccttcctataatcctatttacctaactccacatttgttcatttatactttcttaaatgtgtgtaaggattttcaaataagaaacttaaggtggcaattgattgatttgagtgttttttgtttttatttttaaagaaaataaaaaataagtgaaaatatatttgtttaaaatttagaaaatattttttctaaaaatatttttaaaaataatccaaaactgaaaacaacaaattaatatttttagtctcttttaaaaaagtgaaaatgtgatgacactttaaagtatttttttttcaaatacatattttctaaatctggtaaatttgaaaaaaaaatattttgaaaaaataaaactaaaaaataaacactcaaatcaaatatcaccttatctcattatttttggcttcccttttgcaaattttttcttatgaatagattttacccagggaacaaaactaggaaccaaaaaaatatcatcatattcaaatgccacaaaaccaaccacatgttttctataaatattttttcattttggggtactattatttggtatggaatttttaattagtctatttatagtatacagaatacttgggacatattagaattttatcttccgagagcaactcagttatctcatacatatgcaatcacttattagcagagtaaatcaatagtcttcacagaaaagaaagaaagaaaaacatctgtagcacatggcaaataacataatttccatgttgtccaaaacaaaaggtttggtgaagtgcgctccaacagcttatcactaatgcaacttgcaccttttcaaaaaggtggtgtcatatgatctaatattatctatatagtgcttattagtgggagagtggagggaagagtacatccaagagacaacagaagaatggcctcaaaatcatccaccgttagacttctttgtttctgctacttcatgctcttcagctttatgcatttcagcagctgcactgtgctctcattgataagtcatgcaagcacatgcaatggttccatagctgaatgcaatcaagaagatgagctgttgatggagtccgaaataagccgaaggtttttggagcagaagagatcatacatttccaatggagctttacagagagataaaccagtttgtaatggtggtggctctggtgaagcttatagtaaaactggagggtgtcttcctccaccctcaaatcctcaaaatagaggctgctctaagtattatcgttgtaggtctgactcttgattgcatcttcatgcaaacatctttaaggtttaaggttgttcatgaatcatgcctgttcacataatctttaagttgtccattaaatttgatgggaatttagttttgaatttgaaattatatgaaaatttccaaaaggttctctaataactaatactgtgaatgaagaattcttattctgtgaccgtaggtaatcaattctgaataagtgaatattaagtgcaatagcgaaagatcaactgctgtgattgtatcaataatcttttttctttttatctcccaactctttctttgttccattatgctagatggaatttgatttttcttctactttgtgggggggggtatttgtaatgcttataagacaaccataagctacaatgccatacggagtagactttgcaatgttataaacgtagacatcacccatcaattgcaatatacactccttaaaaaaaatatgtggaatatatatatnacatcacccatcaattgcaatatacactccttaaaaaaaatatgtggaatatatatatatatatatatgataagtgaatagaatatgaagcttttaattacaaataaaatgcgaaaatgattcagtaattgtcaagaatctgataactaacagaacattgaaacatgttacagaagccatacgcagcatgtaccataatgataagtggtgctcgaatataacgaatctaaacatatatgaataattcagcaactcaccttttccagaaagacacatgaacaaactcgcagcaacaacagcagtcaacgcactctcttgagaaaatttgatgtaaaaaatgagtgataaaaatgtatttatatttttacctaaatattattttccaatttttttattatttatttgcctcatgcaactcagtgaataaaaagtgttcaagccagtggaagatatattccgttcctcttcttatcttatttggctcaaatgtattttggatcttttatgctgtgatttctcaaatttgttcccctcattcttttttcacaaatttggtcatttaattattttaattgtgcaattttaatttatctattaatttgacattcaataattagcaaaaacatcaatgtgacgcttctgcacatccacttcagcaaatatcagattaacggatgaaattatacaagttaaattgtaggatcaaattgacaagaaaaaatggaaaccagatttaagaaatgaaaataataagagaccaaagtgtaatttatttcaatttgtcccttcactctttgatttatgatgcggattcgataaaatacgcccttctctcttgaactttgctcttttaaaaaattattctggatggacctcatatttaacttattagattatatatagcccaaaaaaattactctaatattttttggattaatataaatatgatttaatttgtcaaaaaactcctataaacaaacaagcagcgggttgaataaataactttcaatatgcccctttgttcagctagaagattatccaaacatggaagtttatgctacatttactagtgaactagtacaccaattgacaccatcaattcagtgtcactctcgtctcgggagttccagtcagtatcgaagttgcacatataaatgatcttagattgaaaaacagtggctcctaaagcatcaacataggcagcaatctcaattaaatcctcatagccagccagtaaaagtcaaaatgatgacaaaacaaagaaaggaagtcatagtcattaggctgggctggcaggactctaaatcagctatgattcattaactggggaagaatatccagataaactagcgccgaattcctgtcacaattgccttccatggtccacaacatacacgctccagccgtgatgaactactttacgttctgtttaagacagaacacaatcatacataggacaaggacatatctactctggtatttctccaaagtctaataactgaaaggatgatatcttcatgcatacttttgtaacttcaagttcatcgagattcccaatcctttaatttcctgcttcctttaggtttcactataggtgcgttcattgctgccattttgtcattatactttgcacgaagtggatcattgtaagtccacctgcattacaattcaacaataacaagaacatcagagcataatattgcagcagtcaatatataagcataaaaggctcattgcagtagtactaaagaaacccttttttcaggggaaggggttagttgcacattaagaaaattgaattcctatcatcaatgcattaacgaactccaaattcttggcaagggagatagatagatccgacacaagaaaagtaagatgcagaaagccaatgcaaaaatttctttcataatgcagagaatgctacctaaacatactaaaccccattattccaaagatgattatcaatatgtgatagcatgactgcaagcctatcaacccacaatgcatgataaaatccaggtgtgataaaaaaattgtgtagactcttttgttgtaataaaatcagaagaatggcagaatcaatttaacaagttacatcaacatccaacacaaacagaatcaatcataaaagtagtatttcagatgttctcagaacagagaatataacttaatctataaattaaaatagaatcataacttctatatgttatgttatcctctcaacttcacaaattacaagcaagcaaatgacaaaagtgaaacccaaaagtactatgaaaacaaataagcataactcatgagcatgcacttgtgtcaagatctcaaaccatatcaagggctgctaatatgcaactcgtttaaattgtgacatgcaatataatcccttcttactgtccagctaaattcacatagaaggtgaggttgtcaggtgaagttgagaaactaagaaagttgtaaacaataaacttcaagccaagtacatatttctacaaaatgaatgccaaaaaaataaaataggatttgtgagatggcataactatgcttactctaaatgaaacatgtcttttaactatattccttcctatcaactctccctctttctcaatctcacccacaatcaaattccttaaaaagcaaaatgataggtaccagcaagctagaaagactaaaacaaagaaattaagcatacaaatatttgtattccagtaacaggtcttaatcaatggagttcagatcctggtatcttctgtgtagaatggtacaaaatgaaaaaagattcctagacagtttcgagagtgtgtggtctctcccagcccaagcctaattccagcctaccttctacacacccttctcaggctaatattctctctctccttagaacaagcccacatgccctcctcccatgctcagctacagggttggcagttggttatatctctcctaaaattgatcatgtgaaccttttgcctatccttacatacaccttagtgatcttgggccttggggcctccatcacaaaaccgttcttcttaaaaatactcatctcattcttctgacgacaaatagcagcaaatattttgacatgagcatctcaatttcattccatgaacataaaagtaatgtccaagaccattttggaccagtgccacagcagatgaacttcataagtaaatatgaacagatatgccaaaaaaaaaattctcaggataaaacaacaaagatctaataccaaagaatagaacaaacaatctaccactattcttgaaagatatagaacataggagaaattgaacttacggattattccaatcagtagtatcctcgttgacaagatgggtccacttggttcttccactacgaccaaagtgcttgacttgcataaccttgggtaatattgtcttgtccattttatcctccccagttggggcagagaaatcacgagcaaaaataccatcagatccaacagtggcagctcggtcatcagattcattctggaagaaagcgcctttgtgataatatttctgcataaatctccacttctgctttggtggtggagcaggttttggattcctcctttcccactccctcctctcttcctctgtcatgtttctcaccttctcaatctcttccttttccttcaacattgcctcccgatcttccctatccctcttgatcctaccaatctctctccctttccaagcttcatattcttctgcctcattgacttcatcatcagtatccacatcagcaatgttggcctccatttccaagtttttctggatttcttcatcctttcggatctcctcaacaacaatctgcttcgtctcaatcctccgttcctccaatctccttttccttttatcctcgagagccagctcctcagcctcaagacgctcacgctccgcgatggtatctctctcggacttgggaacaaacacaggcttcaccatagccactcccgtatattcctcatcggagtcagtctcgtactcagattcctcctcctcctcctcttcttcttcctcctcttcctcttcctgaggaagtgcctcttcctgctctctttgaagcaacttctctttaatcagcctccttctttccgccagagcgttctcatcttcttcttcaaactccaaccattcctgcctcctggcctcctcttcaatggtggaaacaatttcagcctggcgaatgcggcgatgatcagctcggacctcctcacggttatctatccggctctcagccaaacggcggagcctacgatcatcttttctgacaatagcagcatcttcttcgtgacgaggaaatgctttttccagggcagcttccctggaaggtctaatatcggcgggggcagcatcttcgttctcatcatcagcccattcaggaactttaccaggccaataacgcttaactttagtttggccaattttacctctgagcttatccctaactgctatcacagtatcactaacacccgctgtcaccgacatcgttcttactcaattgattttcgattcccttcaatgccaaaccctattttacacaacacagcaacagatgatttcagattaaatgaaaagcaaaataaataaataaatgaatgaagaaacacagaaagatcaatggtgaatgataaaattcgatatgcgaaacattcgaagggtttgggttcaaaagactaacagttgaatagaagaaagggacgagagaagtttgaaggacttacgattacagcgaccggaaggaaccctcgcgtcgcccaaacccagcttctcctatcaaatttattttattaaatctgcaaatttttatttgtttgctttaatatgtttgctacttaaatatttttattttatactatgtaaatgacatgtttatacgaatattatgtttttattaactgttaactgataataataatattttttaaaattaaatatataaactctaacgctattaaaaatattgaaggaatatcatatttatttaaattttatattttggaattgtatataagatataacataaaatacatttaactttccccatttcctaacctaaagggttagtttattagttaaattaatatttttaaattttagcatattattaactaatatatattcatttgtttatcatacaagataaatattatttttgtatagttaaaatataatccttattatttttatttaggagtaaaaaaatattcactaagcagtgtattttgaaaaaatacgtcaatgaccaatctatcttttttcagctttttgtttatttgaacataagcataattactaagttttaatttcttattaaaaacaaaacacaatttgtccgcattttatttgattttcgttttatactactactaataataataataacaacaataatattaatattgtaccttattaacggttcaaaatcctaaaccagcctcctgacaaaaaaacctaaacccttgccagattctgcaaccaacaacggttgcagcaagttgtttccgacactgatggtgttcggaagcaaaagagtgagtttttaatgcttcgaagagtaccctctttctctcgttttcgtcttcttcatcacatgatgggtactttctctcattccatttccatccactctccttcttcttctctgtctttttcaaagcactgtcattgctccacaaacactgatgacactgagagccatagcaacggaacccagttcttgatttccatgagaaacctatgcaggtcagataaattgaagaatattgatgaagctttggacttgttccacggcatgtctagaatgaagcctttgccttctgtgaaggactttactttgttgttgggtgttattgtgaggttgaagcattacaccactgccatctctttagttaagcacatgttttcttctctaggcatagaagctgataccattactcttaatgtagtgatcaattgtctttgccgtttgaagttggttgcttttgggttctctgtgttggggactatgttcaaacttggtttggagcccactgtgatgactctcaccactctcattaacgggctttgtgtgcagggcaatgtggctcaggctgtgggactggctgatcatatggagaaaatggggtatccattggatgtttacacatatggggcgttgattaatgggttgtgtaagacgggagacactttggcggcggtaggttggctaagggagatggatgaaaggaattggaaacctaatgtggtggtttacagcacaattatggatggtttgtgcaaggatggattattatctgaggcgttgaatttgtgctcagaaatgaatggaaaaggtgttcgacctaatttggtcacttacgcttgcttgattcaaggtctttgcaattttggaagatggaaagcggtgggttctctgctggatgagatgatgaaaatgggaatgaggccggatttgcaaacgctcaatattttagttgatgctttctgcaaagaaggaaaagtgatgcaggctaaaagtgtgattggttttatgattctgactggggaagggccggatgtcttcacctataattcattgattcatatatattgtttgcaaaataaaatgaatgaggccatgagagtatttcatttaatggttagcaggggccgtttaccggacattgtggtttttacttcacttatccatggatggtgtaaggacaaaaacattaataaggctatgcatctgttggaggaaatgagtaagatgggatttgttcctgatgttgtcacttggaccactcttataggtggtttttgtcaagcaggtagaccattagctgcaaaagaactgttttttaatatgcacaaatatggtcaagtccccaatctccagacttgtgctgttatattggatggcctatgtaaagaaaatcttctttctgaggccgtgtcattggctgaggcaatggagaagagtaatttggatcttaatattgtaatttatagtattttgcttgacggaatgtgcagtgctggaaaaatgaatgctgcatgggaactcttttctggtttgcctggtaaaggtttgcaaattaacgtttatacttataccattatgattaagggtctctgtaaacaaggctcgttggataaagctgaagacttactgataaatatggaagtgaatggctgccagccaaataactgcacttacaatgtctttgtccaaggcttgctgacaaaaaaggagattgcaaggtcaataaaataccttacaataatgagagacaaagggttttcagtagatgctgctaccacagaaattattatcaactacttatctactaatgaaggagacaccagaattcgagaatttttgtttccagaaagatagcaaatgccaagagtttcactaggacatttattcaaatcctgactctcaatttgtccatgttccacaatcctataggaccccatagagagaactggcataggcttcagaacttaccatttgttaaatatataaaaccattaccattaagtgcttccacctgacaatttgtgtgattaggagagttggtccttaacatggtatcacaagcctcataaataagaaattatgagattgatccttgttgattctcttcttcataattaacttgtatttgagccccaaggtaaagtgggtttgtgcattgtccacacttcaaactcaaaaagctctgtttaagggggtgttagatataaatctttcttagctccaccaaacagcttaagctgtcaagagaattgttccttgacatttttagtggtaagtattttcacctctgcttgcacatttattttgataaaacctcaagttattaaaatagcttagaaaaaatagtcctatatacaacttagaaattgtgccatatccttgcacttttatggaactgagtaattttttaccaattatatatttgccttcaagtaagtttaatgatgaagcaagttacattaggatattttgtttccccataacattagggataagtcaatcaatattgctaggaaatgataattgtcagcataaattctgccagggcaaattcaatatacccaagaaatcatgtaattgcttattgcttagttttatacatttatcaaatggattccattaatgtaaaaacatttaataagatcataagctggttttaaaacttaatccttttccagctactggtattaaaattaataaatttcaactatgaaggtacaccttattaagttaaatggaaaagatctcatcttctggtctgatataccgtatagaaggggaacttctggggagcacccaagaattttctgtttcatagaaactcctcactcaaaaatactgtagtgtgagctagtgttcagtagcttccttttatcatagatatctctttggagccaatgttattttatattttgtttcctttcttgtgtattttacttttctgtttcaggaggattcctgatacttctgcactgtactcctttctctcctagttcattgtttgtgatgggaaaaattttccatatttattacctgttagaaaacaaaaatctaagatctaatttagcgatgctagctgtcctctctgcaaacaaatttttatttacttttgacagttttccccccttttaaaataacagtttgacttcatggttcttgatttgcagattgaaatcactttatgcactcgttttgctatatcttatgtacgagggaggaccacaaataattcagcgatggatcatggaaggttagtcaaacatttcttctttgtaatatctgcacaacattttttttgtaattcgaatttctttaccataagtagttttgtttgaaactttgaatattcatctctttaagttataaattcacttctttttttctttctatggctgcagactaggttatcattacacaggtaagtcacaaactctcagttgaatgttttatgggggcgactagatggtttgctcatcaagcaatgatgctcattagattggttactgggttttgagacgtaaatgctgattctgccgaatggtttagtgatagaatgaagttgtgatcatgtcttcttgaaagttctttcatgtcgttcttttgtctataaccaaaatattcaatatgttgggcacttgtcatattaagtgaggggtaatttgtaaattttattgggttgcagccttgtgcccaatgcttcatattttgcttcaatgtaaagctaaaaatggttcaaatgtgccaaggaacagtagtccttgacagtgagatgacactggttttagtggtttagcatttaaatgagatttcaacaatatctggttttgtgaaacattttttcagcttttaatcttgttttctgaacattttattagttgccacttgccatagattatatgtggatggatctattcgactggaacattagtgcctcaaaattagaggtatatttggacgacaaaattgtttttggcaaatgatttggcaatcaaaaagcactttgcattctcaacttgatatgcatcaaaatgcttaatattatgacttggttataatgatatctattgaaacatctaagcagatgttgggtaaggtacatggccactcctgcatggttggtgtacccatactaggtacatttactgtactgatacacgggtctgcacagacacttgatttcttttaatatgaattgtgttgtggatatgtttgcgtacgcattggttatgcatcacgttgtctgttgaaaaagtgtatgctatgcatttaatcagcattgagattaacataatactgcacacaaatcatgatagacatatatgataaatgagctgccttatattgatgttttggttatatcctattgtcccctgcctccatttgactgattcttagtgaacaatacaatatgtgtggggtaatggtttttgtaaaacaaccaactcctaggcccgttcatttgaggaaataaagaacgaaaaagaaaaataaatgaacactaaaataaggtgaaattcacacttttaaatcttactttaattcaaaattttaattttaatttactttttttttccactctaccgaacacacccttactctattcggtgaaattgtctacatggatcaagtgcactatagggctctagcaatatccttattttcagtaaaacaatatagagcgtagccttttttaatgggttcccctaatattttcttttgtccccctgctccttttaattgaactatcctccatttgatgggttcagctcttttccagcacttcagaggaaatttccccccatttgatccacttttaaatactatactaattacatttttagtttactcggtaatcacatttttcatcagaatgttttcaagaatattcttcaaaatataattaattacactttgaaataaacatctacgttaaatcacattctgaaagataatttttttaaaattgttttcaagaactgctaaagaaattgactgcaaaataagcaaattattaatcttaaattgaaacaaccctccaaacttttatgtttaacaaaacaatcgttcaacacgattacaagaatttacaccactactaaaattattcaaggaaacaacaccgtctatagtatttactctcaactagttagactatatatcaccagttattttcattttgtgtatttcaagatttactcatcaaatgaattgactgggagatggatgacacaaaaatatatttatctcataataatgctttgccttttacaatctttccctcacaaaattgttttctttaaataaaaaataacttttacaatatttagcttgactccaatcttaaccaaagcagctttaaaaatttacactaaccttcgagtattttaatcccattgtttaagctgtaaagtatcaagcaaaagtacaccatattaggctaatcaatgtaaaggtacaaagctccagtcagattttgaactaggcagatgactaatatgaaaccaatattcccaatataaatagcactcatttagtacagtaatacaacccggagaagtggggtcccatggtgaggatttcagacaacagaaagctaaaagcacaaagaaagtaattctaagaaaccctccattggcaactaaaactagaatcggtattcaatcagtccccacttgcacaacccttgcatccgcagtgaacacactctatgaccttctcctccctaagttgcttgggaactctgcaaacacaagtagtggcaaaattgtgatcacgtggctgcatgcacctcaggcagcaaagacgttcataaccaggctgcaattcagaccaaaaacataatgatttaagtactcaaaatccaagaaaacacagaatgcacaaatcaaataaaatcttagtgacagtaaaacaatacctatttctttaacgtttttagctaccaagtaacaataaccttacaacaattaacatctcggagaaggcacaaatgagtacagaaataacatactttctaatttcaccagtactcaatatcagacagacaatgtgagttcagattgacccaaagacacaaaacattgatcagctgtgggtaaacagagaagagaacattctttttgggacttgggaggtttgtcataggcctaaaatgaagggggttaggggttgataatttggcatcttaacacagaaacattgctttcagaggttaaatgactttggcactttcctttggagactaatgccaaaagaggcaacaactcaccaagcatataagagcaagtacaacccccaccagaacaggtgggatgctgaccaagtaagcaacactgctcatattagattttggaattggaagattattttccaggaatacacttctaatgtttgggtgatggtatggtataatggtatctttgtcaagttttgagaggaagttgagatggggagtgctcctatttcagagacttttcctgcatgtttcaactatctactttgctcattagccatttctaattaaggctaagaatccaagatcattatttacatagggactttaatttacttaagagatttgaatatgggtgatatagtgaactacaatcccttttggttttaaactttttacttgagtctctttctccctcaactaagttagatagaagagtttggatcatggactcttccagtattttctcctgcagagctttctttcaatttcatacacaccctaacctagtttctacttgataaatccattttaaaattcaaacctgtcttcaaaagccatgtcctttgttaggacagtggtacttaacatgattaatgcaaatgatttgttgcaaattcacaatagacctttcacgcagcttttggctcattttattgaattagtcttatttgttttggagaatttcttttattttttggtaactagcagattttttgagaacttcctcctacgttaaaagaaatggaaaaacaaaaccagtttcaaaagtagaataaaataactaattttagataccttcttccattttgcaattagattgcggtccgcatatccttgatctaaacagaattcatacagttctttagaaatttccttcctccgatggtagaggtcaaatatgtagcggctcttctggtgtgcaatcttaaatataggccataacgtctcgcattttcttttgccatcatgtggatcattctcagctgccacataaaggatataaaactattgatttcattgatttcagcaagaacgtaataaaatctactaagcacatgatgtaaaattccaaccttccctcatctttgcttgaagttcacggagtgtaggctcaattaattcccagccctctgggtatttaacacgatttgtctttactttcggcatttttgtatctgttcaaggaatacatggcatcaaagagtcaatttccatacattctcccaagcaatataatggtacatattatttggtacacgttatcaagtaagcatggttatcatagtgagatgggcaatattctgaatttttatatatagattaaataatttatctgtacaatatacatttaacgctcaaagtttaaatgacaaacatcaacattcatgatatattcattaataataaaaggtcataggttttaagcaaaacatacaatacaagtcaaggaaacaaacaaaattgaaaggcacgttcatatttcaaatacaaggcatcttaaacattcaataaaaagtgagggtgggtgttgcacagataaaagaacagaggttcagagttcaaaggagaaaaatatggaaggtgagtgttggcagaaatactgccagagatgcaccgaagttagtcaaatagtgagtgtcacacggtagataaaagcgagagaaactatatccaattagggatttttaaattctaaagaaggggaggcaaatctcaactgtgcactaagaacacacccttaaccgaaaaactacgctgttttgtgggcaaaaatgggtttagaaagaagcatcaatctagcgccacttatcaccgctagagccactattttggccgtgattgcagccactacagcgctattcaaaactttacagtggccactttgcactgctatagtgcgctattgatgcagatattggataactgagcaaaacagaacactctatgccttgacttggttgaaatttcacataaaaaaggtgaaattaattttgaagaaaaccctaagccacagcattcaaccatataaataacattgcgaggctagggcacgaagccatgaacgaggggaagagaaactcagtcacaattcacaaactgtgaaaaacaaaacgaatggcttaattcactgggcaggctatagttattcatgaaaatgtagataggaacactcctaaaccaaatttgattgaatttcacatcaaatacgtgaaactaattttgaagaaaaccctaagctgcaacattaaaccatataaataaaattagggcaaaaaaccaatgatgcgaccactatgccgatttcgctctactctgtgactcgattctgaagataggtagagagaaaccaaataataagataaaacgaaaatcaaaggagtaaacttgaaatatttgaaaaggaagaaagaacctacctcagaaagattttcaagaagcgaaagagcgcaggctgaagagaactgatttagagttattctggaagtttcacgctactgaaataatccccacgtgtgtaagacgatgaatgaaaatttaaagacttaaacataattctcgtgtctcatgaaaatatttttattttttattttgaaaaaattgtttgaaaatgaggaaaatatcatattttttaaaatcctacaaatatacgagataaatataattatttaattatataaattaaatcactttaacatgtatttttaataaatcaaattaatatatacaaatattttaatttactttaaattttaaaaaaatagtatttcatagaatttaaaataaattaagatttattttgaaaataataacatacttataactagtattttagtttgtacaatgtataagttactcattattttatataactaaaacttataaggaataaaaacttttgaatataaaaattatatcataattaaaaaattaataaataaatacttctaaacatataattatgttttagatttacactaaatgatttatattgtgaaaaagttatttttaacaattgataacttcttttaacaaaatataaaaattcaattttaaaaaatattaacaataaaattgaaaaagataagaaattaagaaaagttgttagaagaaatgggagatgaagttttgagatgaaggaatgtgacagagatggatagccagacaaaattaagaaaatagagtcttgagacgacaaaatgagaccaatgtgggtagtaaaaaaaattaggtgttacttaattttttttaatttaaaatagaattaagtttatgctactggttattacacatcagtgtaaaaatgttctgtactaataatgcatataccatttattcatatattatatattaaaataaagtaatatttttattcgtgttaaaatgcagtaatagaataaagtttcaattatttttaaattagattagttttggaaaatcaatttaactaaatgatatgaaatatgttcttacagatatcaactgatatggacttttatctttttaaaataataaatgaatcatatttataaaaaaaatctttctatcactaaaattttcggaatatgtcatttttatgttttttttccatgtgtattcatggttcatttaaaaggaaggattaagcagtaggtaatatgaatttttttaatctataataatttaataaccattcaggacaacccctttatttctttttatctattctccatttacctttattcgtttatctcgcacgagcccacttcctagtttactgtatatgaatgtcgttataatgttgtgtcatttgtaagacattttaaaatattaaatcttattaattattttaaatttatatttatatgaataatatgattttttatttaatctttctagaaaaatcttatcgtacctacttctaggcatggcaacgggggtggtcgggggcgatttttgcttataccgcccccgcccctaaaaccccaccctcgccctcacccacgaaaatcgaagggtcagaaatttgtcccccgcccctgacggggatcaatttccccgcctccgcccatcttactttctctagtttgtttcttctacttcgtctatatttgtatggattcatcatagaaaaaataagtaaccaccagaaatactgaatttatcccgaaccaacaaaataatatatatatataaataaaatcaaatataagtatttcatgttacgtgtaattttagaattaatatataataattaatttgttatacaaaaagtttgatattttatattaatattgatatgtatcattaaatgtataaattaattaatatgaaaacttaataacagtcttaagtttgattttcagatatatagatttgttaaatatttgaacataattatcctcaatagaatttacgtgaagtttgaaacaaaatataaataatatgatatatcattaattacactattgaatatataatagtataaaataattttacttctttattaaatctttttcattattttgtttttttctcctcgattattttggctaaattctcatattaaacattatcgttcttgatatgaaataattgaataacaatacaaaatgcatgcctacaaacacaaattccttcccccaacagaagttaaaagaacaaaaattaagagtttaatttttatatacatttaattaatataaaattttatatacatttaattaatataaaattttatagatttcaactaattaaaattatccttaaattttatatattttaagttctttattatgatagttaatcaaattatcagactcgatatatataaatgataagtttaaaaaaattatattgttaaaacaatcaaattaaattaaaatttaactaaattattattatgcataataaatagtaacaaaggtttaaacgaatatcattattatttgtgttactataggacaaataggtgcgggacgggggcgaggcggatgtcaacattaccaaaaccgtccctgcccctgaattcagcatgcagagaaaaatcgaatccgaaccagaaactgataaactcgatttttttccgttaaaatcgggacgggtgcgggccaatgcgggtggggacgggtgaagttgtcatgcctacctactccctacttttacatttaaaaaactcatcatattctttttctgataaatttgctattaaggagtatttaattttttaaattacttattggggaccatttttaaaaatttatcaaaaaaaagagtaagtcataatattttttacgacttctgttattttttattttcttgcgtcaaagttgtaaatagttagtataaattttttttaagtgataaaattgtgcacaacgttaagcctttttgttaattacttttttaaaaaaaaattgtgttgaagtggtacattgtgttatgaccattctattgttttttctatttgaagtagtaagttggtgtactatttcctttcttcttctttttttaaattctgttttattatgttttttattttataaaaatttatgtttattttttaatttatagtttcttaatttatgttaaaaataatatttttaatataaaattaacaaattaaaatatgtatttttttgtgattttgtattttgtatatcttagttaaatgttttaatttaatatataatattttttatgtaatatcattatgattttttatatggtttgatggtattttgtatatttaatgttggctatatgattttattaaaaattatttatatttactagtaatgttaagatatgtctttgataaaattaaatttaaaggaaaatatttaaatatttttttatattaacttataatatatcaaataatttttaattatattttgattttgttcattaatttataattatgattaagaaaattaaatatctcaaatactagtacgttaattttttgtaatagctatttaaatatcataaaaagaataatgcaaaatattatacatataaatatttttaaatattattaaaaaaataatgcaatagttatttatcaaatacatatcttaacattattaataaatataaatattttttaataaaatcatatagccaaaattaaatatacaaaataccattaaaccatataaaaaatcatatttatattacataaacaaatattatacattaaattaaaatatttaaataatatatacaaaatataaaatcacaaaaaaataataaatattttaatttgttaattttatattaaaaannnnnnnnnnaataacaacatatcatttgttagttattctaaaactaaaatgtatttttatcccttcttatggtgtgaaaaagtattaaatactatattaataagaattttttaagacttataaaattttaaataattattatatcttttatgaatagtatatgatttacaaatgttgcatacaaagtttttaaagtgaagtaattaaatattgatcttttcaatatcttaaaatattaattcttgacatgtatatatagatggatagataaataaataggttaaaaagaagacatacaaatcattgactcaacaaatatatttatacattcaaacatctaattactagcaacttatttaatatagtatattgttgatatgctctaagcatagtaatatataacatagaaatcacactaaaaagagggaacaattagttagagcagcaaatgttgtaaagaaactatttgcaaaacagttatttgcaattaaattaaactcacttctnnnnnnnnnnggaagaagtacactaacttactacttcaaataataaaaaaaaaaacaatagaatgatcataccacaatgtacgacttcaactcaaacatttttttttaaaagcaattaataaagtcgtaacattgtgcacaattttatcacttttaaaaagttttacacaaaagtcgaatgattaattacggctttgactcaggaaaataaaaaataacaaacatttgtaaaaagtattacgacttcgattttcaaaagttgtaatattttttatgactttatcactataatttttttaaaaacagtccccaatcaataatttaaaaaattaaataccctgaatagtaaatttgccaaaatcttcactctcaatcgttcaacgctttcttcataaacctctctttctctccctcttgagtcttccctttgtgagtcccaggattttacttacaaaaatcttgttagttttgtttcaacaaatgtttagaggatatgttaaatcttaaagggcttatgcactacgttgataagtctttaaaacaatacgatatcactcaccttagactattttatttgtgattaagagcacgtttgatttgtcatttttttcttataatacatattttaagatatatcaaacggttcaacggagaagtaatactttgatgcgttggcaaacctatgtttggggctttctaccacattttcaaacatgcactaattgagtttgtgattgcttcaagattgatgattttggtctactacaacaacaattttaagaacttaaggtaggatcctaatcccgaccactttaaaatccattaatttattaattaattttttccccaatctttttttttatttgctcaatgataatgaatgtcaaattagtgactatgggattgttgttgttccattttcagcgttttttaaattattttagaggttttgaacatgattttagagttgtcattgtgttgtgtaaaactttgtggcaacttcgtgtgattaaatgtgtgttaggatgtggaacattgtgtgactaaaatttaggtgtttagagaatttgataaaaaaagacctattaaaatgctttgatttgagtagagcgagagaaagactatgtcaatatgtttgagttttaagttttattttttttttaaagattaacatattttttcttttaagtaatcaagttttataaccattaaatctaattgggaaaacctaaggattctatattctttcaatacctaagcaataaaataaatacttgaatatttttatagtctaaaatattaaaatattatttttcctaagacatatgtgattatgggatatagaagtagtattttacttattagtgcggtggaggtgtatttgcatgcattcttttcggtgtattcaaaaatggatttagacaaccctttgaaaaaacctagagatttagtgctctttcaatatgtcaacgataaaataaatacttgaatatttttctagtctatgacatatgtgattatgggatacaagagtagtattttactnnnnnnnnnnaaatcttaaaacatccaaaacagttatttgcaactaaacaattaacgtcattatatattactaatgaaaacataagcgttgttttgtttatctgtctggtttttattgtatcaaattattacatattaaatctttgaatcaagtctatttgtattgaatcattcaataaaaaatggattgatcagtttggatcaatgagtaaatatataaaactcgttaatttttcttctcttatccacctataaaaaaccacataaaaaagtaacatgtaaaaataagactataaaaaaaatacaatgaaaaagaaatacatgtatcaagaaaagtaattccattggatcttacaaaatactgtataaaatgcaagaaaattttgtcgtcttcacctgtaaatttcagagataaggatgatacataagtatagaaggcaatattcaaaataaagactgtttgtcaagactgggaggaagcaaaaagatttcatgtagattgaactctctcaatttctttatcctaatgtgcagaagatacgaatgagaagtatgtagaaataatttagtcagaataaaaccatctagagtatgcaaaatgtttttggaaaagtaaaaagaaacactctgattattcttctacgatagtgatgctaagctgatatttcctcctcttgcatgtcattggtatgatgaatagatgttttgcttgattttcaacttcgcctaacaccatttcagcactgtcatttcaccaccgttgctcttcttctatcgttagtagttgaacaaagtattaaaaaaaaaagaaaagagagagaacgaataattaactttagaccatcaaaatgaaaataaaatataattcagaacaaaaacgttcaattaaaatgagatatttcgtttatatattattataaatttcatataaaaatcaactaaacattatttaaatcaaggttaagtttaagaaaaatattatcaacacattatattgaacatactttcttctatatgttaaaatttattaaaaaaattgaaatcttataggtcacataattaatttaataaatatcttttataatttttaataaataataaaactgagtatgttaaagattttttttttgaaaatcctcaaagtgctataaaaaattaaattttcttgctttctcttcaaaattagtgatatttttgcactcctaattcgtcatacttgaatttatcaatatattaaatccaaataattgacccaaataagtaaaattttattatatttatatgtgagaatgatttatttttttaaaaattatttacttttattatatgtaaaattttcttaaatatttgagtatctctaatatagtgagtttgaaagagtctatatgatagtaatacataagagagagaagaaattaaaaagaaaaacaaaaatatattttccaatattccaaggtgggtagcaatcccccaacaacctgcagcaggctacggtagagacggcgttgaagtcaaacaaaaccgctctttctcgctttctctctctaaactgcatagcgtcagcgtagttgcaaattcctggttttcttcctttacccatgatctctctttctctctctcagaggttctagaaagatccattcctaaatggacggtgcgccacaatccgccggtgccggaggtccggcgccgttccttctgaagacctacgacatggtggacgatgcctccaccaacgacatcgtttcgtggagctctaccaacaacagcttcgttgtctggaaccctcccgagttcgctcgcctccttctcccgacctatttcaagcacaacaacttctccagcttcatccgccagctcaatacctacgtacgtttcttcgattcctttgtttcgctgcggttcatgcgctcccttcgtttttattcgattctaattcgttcttcggatttctgtctttcatttagttgtttgcatgtcttgaaatgatcgccggattttactaattttttgtaattgttgttgttggatattagcactgagctgaaatgaaatgttaatgatgatgatgtgagatggagagaatgcatagtgagatagagagaccttcaatggatctcatagagtctatctgaagatatatgttacttaaagttaaagatattgacaaggttgaaacataggtttctttttttggaatgtgaattgggatataggattcagaagtcattgaggaaggtgatcagaataatcttatgctgtgccttgtggtattccttgctcaagtaaagtaccagaaaatttaggcactcagcagaaggtaataagaatctggtagtataggacttagcattcatcagagaaggtttatcgatcttctgcaaccccttgatatatatcacgtactcatgaattaccaaatcaccaaatgtgttccaaagtttttaatcctggtttctgctattctattattgacaagggatgcatgttgaataattatcagaattagaatattaagattcttagtttttatgagtcttacaatgttagcaatcttagtaggctgctagcgagggttgttgtacattaatacttgacctatcttagaaatagtggttggtatctataacaaatgtcaatatagatcattagatctcaataatttctctttctgtcttttttggattcttcttatgcgtttaataccagtcaacttctaatagtaaaaagtataaagcagtttctaaaaacttatatatgcttttcccttggttctccaaaagcgaatttaataccacctaagtttcaggtgtcattagacattagcatgacaatttggcaattttcttatattgtcgtttcgcagagtggtactttttaatgttgtgttttggaaaccattgggaattctaggagcactggagaatattgtatgataaaattaccaaacttgatgaaaaattcatgctagagcattttcggttgttttcatgaataggatttgttactttacctttaaactgtcttcctccaccataaatgtttttctttatccagaaaaaagatggctgatggaggtgcatatgtctattagtaggtcttaacacaaaatagatgcctaataatacataaatactcttcttgggctgtgctattgaactgttgagtgtttatgcacttgatggtttacactcacagttctttattttcagtctaaagcacatattccctggcactttatttgatcaattgataaaaatgctcgattttataatacattttccttaacttcttggttgaaataggtgttataatgatctttttgtgctgatctgatattaaaatgaactgagtttgaaagtgaagatataattactgacaaaggaaaggaaaagagctccagtagacatggttactttgtaaccgttatatttttgtattctcataaccagtttgtatctcatcttaaactggtaccttaacattttgactgaccaacaacgctgctgatctggggttgttactcactactgtaacaattcttttagacttctttggttttaatagaccaaaaaatgactccccaaaaggtaaggctgccaatgttagataactaaagccaaacctattagttccttctcgtaagcaggtttggatgggttttgtcactattcactaaccctaggaccctcccgaaaggcatcacactcaatcacaaattcctttgaaaaatgttgtcaccttaatattggggctgttattgtcacatctttcaagcttcatgataaccttatttcttggtcaaatcagttaaaggtttggccatcttgccattatccttttacaaaatttggtaatttcttgttaaacccaagaacccttgaagcccctttagaattcttgatataggccattctaacactcttgatcatttttgtgtctgtagccaactaggaacccttttccttgagataatatgcccaagatactcaacaaattttctcccaaattgacatttatttttatttgcaactaattcattttcttttaattcacccaatacttctctcatgtaccttatttgagctccccaacccttgctataaaccaagattgtcatcaaagctcatgcctccacagaggtactgattacttgtttcttgataggtgctatttttgtgcttgtagttaaatgctaatgccttagtttcttttatggatattgagtcataaaaggatatttgggctttaattttctgtctttgggaaatgttgttggctatgattactgtgtaggcccattcaggttgcattttgagacctatcacccatgcatattctagagctctgtactattgcagacagtaattaatttcaactttgagtgcaatcaaactctagaaagtttgttgctttctcttgctagaattgcttcctatttcctagatccctatttgtgtgagcctgcgaggctattagtacttttgtgttactggttttttttttattcatgggttgccttggaactttagtcctcaaaatttttccatttactataaaccctgaccataatttcagttctttaatattactttcccacaactcaaacactgcctacttttgctttccagagggtgggtttctttcttgtaaagagtatatacctgtaaggatttaatggtaaattattcaaagaaaattgtagttcttgttgcttgaaaaaaaaattattgtttgtgatcattttttttctttttcttaatacatattttcgagcatttaataaaaccattatttggttttgtttgttttggtctattgatattgctctattatcagggatttcgaaaaatacatccagagcgatgggaatttgctaatgatgagtttctgaaagatcagaagcatcttcttaagaatatacatcgcaggaaacctatccacagtcatagtcatcctccaggttctcttgtagatccagaaagggcagcatttgaggaagaaatagacaaactttcccgtgagaaaacttctcttgaatccaatatttataacttcaaacaacatcagtcaacagcaaagcctaagctagaagattttctgcagcgattagatggtattgagaagaggcagaaacaattgctgaacttctttgagaaggctcttcagaatcctacttttgttgaacatctttcacgcaaaatcgagtccatggatttatctgcatataagaaaaggcgattgcctcaggttgatcacgtgcaaccagttgccgaaagtagcttggtggacagtcatagcaattttagaatggaatttggaaattttttccatcaagatttctcgaataaacttagactggagttgtcacccgctgtttcagatatgaacttggtatcacgtagcacacagagttcaaatgaagatggggaaagcccacagaaaaagctgtctgaagtagaaccaaaaggagtgcagacaagaacagctcttacatttgcacctgaaacattagagcttgcagatactggggcttcttttacttttaagatggattcatgtttatcgcgaagagcaacaactgctgagagctcaaaactgatctctttggagccaagtagtgaagaaggtgatagtttatcctgccaactaaacttaactctggcatcttgtccattgcaagtcaacagaaattcatactcggccagatcaccccaaattgactgccaagaaattggaaaattggcagaatcaagattttttgccaatggtaaagaatctgatagtggtgtttcctcaaacctaaatgtagctgctgaggccaatttagcttcatcccaggaggatccaagtaacaaccaagttaacccagctcctccagacagggtgaatgatgttttctgggaacagtttcttaccgaaaggccaggctgttctgacaatgaagaggcaatatccaactaccgagcaaacccgtatgatgaacaagatgaagggcggtcagctcatggaatctctagaaacattaagaacatggatcaactcacactttgagttattctggcttactgcctgatttatcttgggaaaaatccaaaatccttaccagctttgggggactgatggatacaatgttaattaactggttgacagtgttgtaaatattcaagttctgtttggctttcaaacgtattactataaacttaaaaagtcttgattatggagtttttcttcatgtttgcgcagagagctgtgcagtaagtatttgctggatagatcagctttactttccattacatgatggaattccatctaacacagcatgaaaacatttgttcagaacgcacattgacaacgatattttctctcgctacatacaccgcacgaattacaacggtttatcttcgcttgcaggaatcatatgttgtcttcaaatcatgttagtttcataacttttgctggttgaatattttaagaagccaaatctcccctagctaaaatttcaccgtgggtcacatgattcactcgtgattttaaaacttattccattttacctacttatttgaattttagaaattaccaaatacactctaaactagaaatgtgtctatttctgagtaaccctacttttagtttttgaaattgtaattgtcagtcagtttactctctaatttcacaaaaatttcatttttagttttagattttataaaatgatattcactttaatcttattctgtataaaatgatagtggaaaatatctgaaatgaatgatttttacaaaattggagactaaagtgaagaatttctaaaatcaaagattaacgtgattaatacaatataatacatgaatgattgataatttcttgtttgtcaaattaatatgtacgacgagattagaagccgtttagcagaaaaataaaaaataatggcaaaattagccatagcattacttttcatcattactttcattatttaagaatatgtatcatcatatttaacaatgcattcaatcatcatcaaactcattttaattatcagattcatttttatttttttatcgatcaaagaatcttttaaagtgaatttatatttgaaggttttttttctattcataaatattagttgttaattgttagggacaaaaatgacaaaacaatcaacgatggacctaaaggtaacactcttataaataaaaaatacgttcaatgtcgtctccatttcaggatatttcttccatatatacctcaagagttattgatccaaaaataactcactaattatccagctagacattgttcttctctaaaatagaacacatttaattttcatcaaactcattttcattatcaaattcattttattttattttttatttttttatcgatccaagaatctttcaaagtgaatttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagatttttttttctatccataaatattagttgttgattattagtttttattaatagaaaaatcaattccaggatctctctctccctccttttttctctttatcattaaattaaccttataatttcacttagtcatttatattagaatttgtttggttgaaaacacaacctgttttaaattaaatcagaagcaagcacattattgtttgtctactttagacataaatacaatttatacgctttatacatatatacttgaggaaaaattaatatttacgcttcatatgtacattattattggttnnnnnnnnnnattggttttgatttaatcctgtaactttttttttttttgtttcaatttactttttaacctctcatttcctatcacgtttgtcttttcatggcaattttactaaataaaatataaacccaagtcatctaatgaaacttacataaaaatttcttaataataataaatatattaaaggatgtgtcgaaaagaatataattccaccctacttctccacttatatatttatttcatcgcatgatacctttaacataattaactggttgtctaatcgtaaactttgtgcaataaaaacttttaaaaggggattgagaaataaattccttattatttatttaatttgaaatactcctatatatagtagtcttaacatatttaaatttaaagataaatatagttttatttattcacttctaaaaacaattttcattttttattttaccttttgcacgaaaactggagagatagttgtacacagagtctccaatttatgactatccacccactaaggctctcacattcactttcacaaccttaacaacaaactgaaaacaacacagaacagtgtcccaacccagattcattgtcatgactttcccatgtttggcacttgttcttctgcttcacacccttctcccaatctgcaatggcctattagttgtggacctcaatttgagtgaaactgccgtgatgaccaaaagggtttgcaccaaaagcattggagagtgcttggcagagccagaaatggactcagagagcaacaggagagttctggaaggtgttcagcacataaagtacattagctatgagacactcaagagggacatggttccatgtgatagagcaggagcttcttactacaattgtcatgcaagaccagcaaatccttataataggggctgtgaggtcattactggatgtgcaagaggtgttcaaggcatcaaaacttgatacagttatggtccattaaatggatgaaggaagctaggaaagtgtcccaagtggctgtatcatgtatgttattattcttaatttccttttccatctaatcttgtttgtttcatttatgagctttcctgtgtagttattatggtcattgtttttatacttttcaaatgctttttatttagttctttccttgtaacatatggtatgactagcttaattatgaaaatatctaacttttgttcttgagaacataccactgcaacttgacatactctttgcgattttgatgcctatctgttacaaaatctatttattgtagagtttagttatcaattgcaaggtgtgggacttcagtcccacattggaaagatggaatctagtgtggggtttataaagtcttgactctacccatagtggttagtttttatggtgtggttctcccaagcttcttttcaagttgcaaaatttaacaggaaattattcatacagagcaatcaacctgagcattcgtatcttatttaatatgtaatgggtctaaattttatttaaaatgaggctcctcacatcgagtccaatccccttctgcaccttcgtggctatatcgagatttcagggaaaagaagctgatttcttcacatttggtatggagaaaataggaaataagaagaagaaaaatacaaaatgcaaaccgagtttaaaacaaatctcatcttagtttttaaacacatagtttccatagaaaagagtgctagtaacacattctccaacgatcttattcttagattagttatgaaaagaggaacgtagtttccattttatgttagtaaaagtctgccagaaataatagtttctcgtgtcaaagttcaaaagtgggagccattttcagcaagttctaggaattattcactttttatgaactctctcttccttatgtttggttattctcttaataagtttatgggatctcgtcaaattccttaggatcggcttagtgtgggggatttggatagtttgcataagatctaagtcttttcttgtttttgtcgaaaacaaagtattctcgtagctgaaagctatggtaaaatactagtttaggagcaacttctctacttctattcacaaaaagattatgaaatcttcatggcatggaactaacgtatcgcatataatgtgttcttatcctccatagcaatcacaaagacagagttgtatttgcatgaagatatttcctgtgatactatggtattatagtaatgatgtgcgtgggaaggggggagttgtttaggaataatatcataatatgatagtgaaatgtgctgaacaaatgaacaatgaagcacttgggacaacaacccgggttggcatatgctaaaatgtttcattgtgtgctgcattgcactaatggaagataagcacaggaaaaataattgaattagcaacagatcagatataataattaacaagagattactagcactaattagaccacatggtttcagttatgtttctcttggcaaagccttcacattgcaaagttagtcaatagccactagccatgtgccaaatgccaatgtcaaactcaaaaaactgagctatgcttggctggagatttgtgaagcttgacaaaatggcctgtgatggcaatgttgatgttttattaacactagatatatccaagcatgctatgctatagcctataggtaatggtaggccactttcaacaacaacaacaactatccaagtgagcatttatgcattggtgcccctaggggatccacactccatactcgagcacttgtggccctcatcttttatagtgttagtttggaaagaggacccaatttacctacccaccccacctcattctttttcaacaaccaccaaaaagaagataaatcatagttgttaaaataaaatcgcctgcaaagaaacaatcaaataaagagaggggaaataaattattttcatctctttactcatttcttttttgtcatttttatttaattaaatgaagatttttattctatcatttatattggaaaatgtgatcacatctgcattaactaattcacttttcctatctgaatttacatttaatatatgtgtatatatatatatatatatatatatataaataagcactcttttctattataagagttacctttggtctattccctacaagaaacataaatttccctttctgtgacacagcattttaagtagttgaatgacagccaaataatctttttttgttcatgttatataaacccttaagtaaaatttgtgatatttcaaaacttatcttaattgatacaaatctattgctactatctataagccagtgctcctctgacaggtaatgaggtgataaactattttctacactggctactatctatcaaatgtttcactgcttcggcaggcaaggcaaagggctgtgaggcttttggaatgaaagcttttgggcctaagatgacagataaaacatgatggtatttaagtagggatggtaaaaaggcggtttaggaattagtttggagtcaggtttaaatgtttaatagaggaaagaataaaaaaaaaaattccaattccatctccgtcaagatcagaaaatcccagcacactattttcaaatttattttacttatacatatttttaaataaatactatattactatatattttaattcaaataatgcgtaaaattcaattgaaaaatcttaaaactaagactgaggaactaaattgtattttttagtataatatgtaattttaatgtttttagtgtgaactttaatgttattattaattatttttatagtttaattttgaaaatattatttttgctaaacaatagttactaacttactatgaaatttttaattttattctataagcaatatatgaatttataaaataatcaagtatttgtatttagttgaatatctcaattagtcatcattttgtatttacattacttttgtaaaactttgattctgaaaataatagtaagtctcctattattgagaagcccagtttgaaaacattcacctttatgggccggaaacctctaaaaagcctagagtctaaacctttgtgacttttcagcatctaacaattggtattttcgaattttctcttttctttacaatcaaagctaataaattccctagaagagggtactatatattcctctctaatgatgtaagtgatgatttagccttcagattccacggtgattataaaagtgtaacgtatttaaacttgtatttaaaggctaaataaatttataaaattatgaaacccaagcacacgaataaatatccataaatttatgtactggtaatctttcaagatcttctaacaatcttttccttatcacaaactagctcttttatatagttttaatgtagttacttggtgatgttttattacccgaataagttctactctttcttcctattgtagtaaaaagtagtaaaaaaaatgttattcaaaattgattcaggttaagaaaaaaaaaatcacttacacgataaatttctttaaactaacgtctctttcaagttgtaaaataattgatttacttatatagagttctaagtttgaatgttgtgaacgaaaaataataaacatgagaaaaaaattccacgtaaaatgtttcgtgcttgcgtaaagattaattgaatcttaaagtaatttttggttattgaatgttaaatccctaaaaaacttatgagtttaagatttagaagaaaaaaatataaaatgaatcaagtatttgaaattattataatccaaccaaacctaccacaagatgagatgagctagtatttgaaactcttgtccgtgaaatgatatttaagaaacttgcaaatttaatgcctaaactaaaatataaattttctattggttgcttacgctcccataggatatgatatgatacaaacaacttgcttagtgcttctccatagtgattgagtgtcatgcgttatatttccttaactaaaggcatcatgtgaatccaactgaatgatgattccatgaaaaacactatctcaaacaataattagagcgagccaaatgtcagatactccacatttcatgttttctgtcttgaactaaaataatgccataacaacatcactttcgcataaatttattatttattaatactacacaaagattatttatgtgaggccactccttcgacagaagggaactgagatcgtagttttaagatttgtcgaacacgcaacccaccaaataggggacttgtatagtaatgggattgataacctactatgttttgtcctttctgttattatttattgaggattgaggactaagcaagatacgacccttttttacttttctagatccacttctcattcctttgtgtgtgtctgtttttgtcttttcattgtatagcaaatcattattaatatccatgttcttcatgcttattttcacacctcacattagcttattcaagattcttaataaaagtattagtgaaaacagatttaaatatgtttttaatttttcaattttggatcatttcatttttagttctttaaatttaaagttttttttttgtttttgaaagtcgagtaatgctctttttaccagtgtgatccaatggagaataaggacaattttttacactcaaaaaataattttctattttatattttaaaatacaatttatgatagtttaaaactattaaaattaaatcaatgaaaaactttaaagcaaattttaaaataattaatgggtttttttatttttttttattgacttgatgatgataatttttaattgccaaaaaattatacatataaagtagaaaatcaattctaattgtaaaaaaatttcataaattatgaatatcttattttacgtttagttaatacagtaaagaatgatttaaaaaaatattatatgaattccagaaactaaagaaagtatcttcaaatttggaggattaaaaataagataatctaaaaacatatttaagttaaaaaaaaaaaacatagtgaaactttaaacaaatttagagtattgtgtattgacaaatgaaccgttaatttttttatttgtttatgacgtttttagcaatatctcaatagtcgcttgtgacttgttactctcaatcaacctttactaccactctcaatatacttggtttttttgttattcctgtcttcaaaccccccatactttgactcctgaactttgaggctgcgtataaaaatacaattggcgtatcggacatgcaaaattgcagattgtgtaattggcctctggtccttttccagaccaatattgagaagttcaggcccttatggcacagacaagggttgtattgaatctgactttgacaggtagttaaaatttactgtaattaatggcaatgcaagactagcatcgaagaggggtgacacagtaataatagttgacacaacgagagcgcctatgttctagcaaagaaatttttttttttaccactctttaccaacagcatccaagacgttacgttaggatattcaaattcaaattcttcaatgcgtcactgagaagctgttgtactcatttttttcacgtaaaaacagagaaccatctaacacggaatcttgcaaaaattgatgtgaaacaagaattctctgagcctaaattggattactgcctaaaatttagagtcattttgcagaataggtagggaatattttattccagaacaactttaatgtaaaatcttgattaaagattttaagttcaaaatcttatttttattaaatttttcaataaaagagataaagagatttccaacatgaaaaaatgagttcttatagaaaaacccttaagatatacatattattcaaaaaagaatatttttttttctttttctctttctctaagatttcaaaatgaaatctaccattaaagaacaaaatgggagaaatcttgaaagatcttcaatcctacgtgacactataaaatttaccgaaaaatgatctaagatcctaatttgagatctatcactaaagatactttgtcttttttctttctttttctaagcacccatgaaaacaaatcagattttttataatttgggcgaggtctaaatttgtttttatcattgtaacaaaaactaaagaaatcaaagcaaacgatatcataggttatttggacctttgttattatcctacgttattatcagtttgatagtaatataaaggaatctctcttgattttgagaatgaacaattgactagttaaagatattaatatttatcaatttttcccttgactagttttaaaatgtttgattttttaagccatttttgttattaaggtaaaactgtaggttttaaacgacagtgtaaacacccatcaaatcaaattaacaattgagaaaattgaattctaactcaccaatctgtgtaaattcaattaacaaagaacttgatttcccttaagcttgattctacttatgacttatgagagagctttaccccttaagttaattcaccatatagctaaaatcgaattaattggaacttataaggctctaaaaatatgcaaagaaaataggaactcgtaatataaacgatgcaaatccagtgctatcattattttttcaaataaaaaaagagaaaaactcgaatgaacttccataaaaaaaagagtttacataataaaattacttaattaccctgatagccttttttaaaaaaataatgcagaagcaccaaataatacacgatgtgtcaatgtgttatgaaactggatacatggtaggaatttttttctctcttgattaattttgatatattgaaatggtggacagaaacacattttagtatttaataaagcaaaatgcacacatcccccagacaaaacaatccttattcaatccaaattggtttcatatcacagaaaccaacagtatgtcttcctccttacccgtcccacccactcgaacacaaattctacggaaattaaaaaaagaaaaaagaagctaaaattcttctacctcaaatctgaaagtctaacaccaaaaattcaaaaaaaaggaaaattaagcaatcaatccgatttataaaaccgattttgtctttccctcactttccgttgatcatctcaatcacttagtacctgtagtgagcaggcttgtatggaccctcaacaggcacactgatgtaatcagcctgggcctggctaagcttggtaagcttagctccaagtttgccaaggtgaagtgcagccaccttctcatcaaggtgcttgggcaaaacgtaaaccttcttctcgtacttgccagtactcttctccttccacaactcaagctgggcaatgacctggttggtgaaggagcaggacatcacaaaactggggtgtcctgtggcgcatcccaagttcatcaaacgaccctcggccaagacaatgatgccggagttggtctcagggaagacccatctgtcggtttggggcttgatggtgatgcgcttcacaccggggtagttctccagccccagcatgtcgatctcattgtcaaagtgaccaatgttgcaaacaatggcattgttcttcattttcctcatgtggtcaaccatgatgatgtccttgttaccggtggtggtgacaaagatatcagcctcagaaacaacgtcctccaaggtcagaacctgaaggccttccatgagagcctgaagggcacaaatgggatcaatctcagtcacgatgacacgagcaccagcctgcttcaatgcagcagcacaacccttgccaacatcaccatatccagccacaacagccacctttccagcaatcatcacatcagtagccctcatcagaccatcagggagagagtgacggcacccgtacaagttgtcaaactgtcacaaccacagatcaaaaggttaataaaaaataacacgagcaataaagcaaaatcaattcataatccactagatccacaaaacccaatgacccacttattggtttcaagaccctaatccataaacaactcatcacgaaaaactcagtttggatccatgtttgcaaaattaattttgaaacgacatgctttatgtttgaatgtttttctaatcctaaatcaaaatcagtagtaaaattcaaaagttatctaatgtagcttcaaataaaaaatgtttactcggaataaatccttattttgcggaatcaaacatgtgatcattgtcctagagtctaattagtaagctacttactaacgttctgacgtttcaagtttcaacacactaaaataacacctaataccgatccagacttctcagacggcattagtcaaacagttaacagattcaaaacctcatatcaccaatgccacaaaacccatccaagaacaacagatctgaactcaaccctacatttaaacacataaaaagcaccagatctgggaaaagaagagacattaccttgctcttggtgacagagtcattgacattaatagcagggaagagaagagtcccattcgcctgcatctgatagagcctcttaacaccagtagtggtttcctcagaaaccccaacgagacgccccttcatcttgcggtacctggtgggatcggtcttcaacccatctctgatgatggtaagcacgatctggaactcagcgttgtcagtggagttagggtcggggagttccccggtcttctcatagagctcctcggccttgacgccctcgtggatgaggagggtggcgtcgccgccgtcgtcgacgatgaggtcggggcctccgccggggccccagtcgagggcgcgctcggtgcaccaccagtactcctggagggtctcacccttccaggcgaagacggcggcgctgtcgcgggcgatggcggcagcggcgtggtcctgggtggagaagatgttgcaggagcaccagcggacctcggcgccgagggcggtgagggtctcgatgaggacggcggtctggatggtcatgtggagggagcccgtgatgcgggcccccttgaagggctgagatgggccgaactcagtccggcaagccatgaggcccggcatctcgacctcggccagctcgatctcgaggcggccgaagtcggcctgggaaaggtccttgaccttgtattcgcgcccgctcgtggttttctccaccaacaaagccatggtttacgagccggggaagaagaaagaaagagtagagaaagagagtgaagaggtgaagaaagaatgtgagagtgtgtgtataaataagggtttgggagggggagggagagggagttggtgaggtggactagatctgtttttttttttgccctgtgccctgttatttgcatcatttagtaaataattaataagaaaatttattttttaatatagtttaacacgtttagtaaataagtaaatttttttaaatatgttggacaaatttttttagtttaaattattcatttagtcttttaaaactcatttgacattatttttgtcttgtatatatattttatatcaaccaagtttctctaaaattataaaacacaatatactatatttcaatcttcaatgtatttatttcacattataaatatttaaaggatatcatagcagcagcaataggtatcaaaatctatgttacaaaatgtttattagatagagataaattatttgttaaaaatttgattattatgctctgttcatatgttcaatgatgtgtaaaatataaaatgacacataagtaaaagaaaaattgagttaatttttatgcacaatcagtataaaaagttttacacatataaaaaagtgtaatnttgataattatgctatgttcatatgttcaatgatgtgtaaaatataaaatgacacgtaagtaaacgaataattgagttaatttttaatggacaatcagtataaaaagttctacacataaaaaaagtgtaattattttatactattaagtattaactaattaaaaatatgataggtatgacttttaacataattattgtcaaaattaataaatttattatatatagttgtttgtgacggaataataatataaaaactctacatttcaatagatagactattatcataaatttttaatttccttgttgaaatattttataatggaattaataaagtgtaaattttgttttattggttaggttaaaaacctttttttctcatttgatatcctttgtataataactaatatggtaaaaaatgacatttttattatttacaaacaccccgtgcaaaatataggtttaacaattagttaattattatataaataagttttataattgaatatgttagtaaaaagtaattataacgtacgttattccggtaaaattatcaattaatttttataataaaattatacaattttgcataaaactatttgctcactaagataaaagctgcttcgaaaaaaattaacatcaacatcacctttaatctaaattaattaggatcgataataaataaatccaataatagataaaaaaaagacaaaaaagagaaagagagatggaaagaaaaaggaaaaataagacaaaagaaacgaaaaataagctaaaataaaagaaaggtgaaaagaactaaaaaatgaagactagaacatgggaagactagaatataaacatactaatgggtttaatcctccaccaaatttataatttttctccactttgttctaagacacaccgttcgtcaatctatatcacactctattatatcttgtttaacaacctttccccaagtgagtttcaatccacctttatctttctttgtgtcgaacttttgttaacaaactcttgttctaacgagagcatatagtgatcgtctcacaacatgcccaaaccatctcaatctatactccctcataatcttttcatacatcaaactacttacctttcgtcgaatattttcatttcttatattattcatcttcgtataaccacacattcaccttaacatcctcatttctgctacccctattttgtgctcatgttacctatgtgctagtccaatggtggacccacacttgttttcctgtccgcatgtgcagacacaaatattttgtatttttttttataatattttctactgagcagacatttgacgcatatgtggttggaaaagaggatgctcgtggaattgttgtgattcaggagtggtggggtgtggattacgaaattaagaatcatgttgtgtagatttgtgagcttgggtagtgggtttaaagctcttatctcagagtaagataagataatggcactttaggggtagggtggtttgagaaaacatttcatgtttttatttttaattacaaaaaatattactagcaaaggatggacacttctattagcaagaagcgggaatgaatttatataaaagctgtgatatatgtgtttaacttaggtattactagcaagtaccaattattctcattgcagtagaagcttatataaagggattaggatctcttctgattcattctcttgaagtaaagttcaatatacaaaagttgattatttatgctctgtttatcttcatgatatataaatcttgggtatagcctaaattactttgttaatagtttgtcgcaatattttttactcttcacatgattaaactatcaatattgttggtaattatatttgactttcatctttggctcattttattacttaggggttgttactttcaaatattttgatcttacacatactatattttgagcgggtttataatcttgtacataaaatgttgatttaaattttttttacaatttttttttcgggaacgctgcccccgaaccccaccaataattgtgcgaacataaattaaaaatcatgggtccgccactgtgctagtcaacacttcgctccatataacattgtcggtcttacagttgttctctagaattttccttttaacttaaggaaaattttgcggtcacacaaaaattcatatgtgttccatcattttattcaccctaccctgattctatgatttacatctttatcaatttcaccatctttttctccgaaaaaaagtatgctgcaaaaatttatgaaggtgatgaaaactatttttatggcaattttttattatataaataaaattttgaatcttataattaaaaatgatcgaatttattatatattagttaactttattttcttactttatccataataatgaattattttaaatacaaatcaattattataaataacttcatatatctcttttattacgatttaaaagacatgttcaaacaattcaaataattatattaaaatcactaatcacttaaaatacgaaaaaaaaaatatatgtgatgcatgaaagatgattgcaagagtcaactcctaaaatcttggtattaataatgtactagtataagggagatggggtcaccatagttgtatctgaattgctatttttcattggtgtatgacctattaactacgttgtggattgccaaatcataatatcagtgaagctgaagcaacaccctccgccagcgccctgaatatatatacgtgtgtcggtgtctgtcgtcggtgatttgcttgtaaattatttgaaaatgaaagaaaactaggaatcgtaaatggaagacacaaggaaagtgaatgtgcatgtctgaaaacattctgataaaataaaagaaaaaaaccagcatacataaataatcaagctgtggtccccggttatggagattaattagatgtggccttggaaccaaccattaaccaaaaatattggcaccgcacaatcacaattattgagaagatatttttaccgaatcttggcacgactcggcgtgttgcaatcgcaccaaaatgcaactgttggtctcgccctgtactcaccctagcttttataaaactcaactgcacattgatcttctatagtattctttttcacctactaaggaaattattagttttccattaaaatattcatggaaaatatgtttttagagtaaaatttggttaaaaactgttttaaagaaataaaacttatgatattttttcaaacacactttacaaatttaagtttaatttaaacttaagtttacaaattttaattaaaatatacattgatacgaggtactcttagactaatttattttgtttataaaaaaattgttaaaattttacatactttaaatttgtcattggtacatccaaccaactatgtacatcaaacttgagtgatatttgtgttgaaaggaggatgggagaggcatgacagagggggctggcttctagtttacccgagtgagaaggttttcatgatataaatatctcttatgattatgtttatactaacatgatactatcaattaatatggtccctaaatcattaggatctggtctcatgtcaggaacttacgtttcgtgacatatcaaaaagttgtaaattaggagtagaaatagactagaaagtctttcagggatctacaatctagtttagttaaggttttgtttggcttaacttatttattaaaacgtttaaatttgagctttttaaaaacctttttaattaaaaaggttaggttataggctttcaaaaaaatcaattaaatctgaacattgtgtctatataaattataatttataagattatatttgataatttataacttataagagaaacatatctattatgttattttttacttttaattatttgtttttatttaatcagactttgtatataggtttttaggctaggacagacctttatgcaggttacacttaggtcttaataacttatatttaacatgtaataaatcaagcttaagcttaatgataatgatacagactaggttcaaacctgtcaaagtctagtttgacttaacctatttttattcctagttgcaatgatacatttatacaccttcatacttggtataaaaccgacaatatcacatacgcatgtgcatgtcccccctaaaaccaataatgaggggacacatggcaagactagtttgaggacattttatattaatagatatcagctgcatggctcaagaaacgttaatggttgggttgagctaaggagggtgcttgtgaagcttatgagccttagggtgcttgtctctccctttctctcttcgacgtcctcttacgcgtactataatatctttgattttcaatttcttggcggctctcacactacgacacttcattcaatatctttgttggtcaaaatcttccactaatcagaactctctgtaggtagccattttcgagactttgactatcattctgcctgttttcaggatcaatgactgatcccacaaatcaacacaagatttttcagcatgttttgtcctcactcatatgctttcagggaagcttccaaaatattactcatcttataactactctaagccaaacacttaactatgaagttcttaagtaatgaactattgaaaagtatatgtatcttgttgatagaggtagtatcaattaattcatttaagttattatcagtcatacattctcatacatgcacaatttttgcatccctctcattctggtgtaattcgatttgaatgttacacttactatctccttgtacctttgaccgtatagataaactgatgtagagttattttaaattaaccaataatcttgaattcaagtaataacaatgcgattgttttgatacttatgaagagttttttcgcccataaaaatcatgttcgtctcaaatagaattgattccaataaaaaattaatgtgtttaatcttcacttttgtatctttatttctaaatgggatttcaattttttttaatgacgaaattatcataattagttaaaaaatatctttgttaattaattttcaactatcttaaaagccattttatattactttttttaaggacatttttatattagctttgcgttaccagcttgccacacaagtacaggtcaagacctggaaaaaactgtgtcggttggttcctgtttaaagaaaagagaataaaaaataacaaaaagaaaaaaagtgcccttccattacattcgcattcttaggaaaagagtgagcgatcccgggaaattaattaatatacgactaaaagatttgcgaattataataattaataattctttttaaaaagtaaagtacagtactgctggaaacatgaacatgttcatatattaaaatttaaaagaatatgaccagtaacaaaaaaaaaacccatgcatccaagaaagaaatatcatgtgcttctgtgtcctctatctgagatgtgatgacctttttcaaatgatcataatagttacttcataatgacgacatgcatcaaactattttttcttcaaaaaatatattggcaactttttactatgataattgtataaattattgttagaaatttatttaatttttatttggcttctctatttataaaaagggacattttttaagagaaaaaagaaatcaaatcatagaactcagatagctcgcccttctctctctcttttttacatgcaaatggccgttccaactattattactaatttgtaattattgaagtaaaacaattcaatgaccaaattaatgttaaaagttaaaacaaatacagtatatcaacaaccttttggcatagcttgagtagatcgtaaaattaggtatttcctcaattaatacgcttatattaatatagcctagatgtagatgcagtttgtcctgcgttgtaattaaataaaaatatcacggaattattatgagagcattattgaatataataaagtaagtcataaattaaaaactgcaggtgggtaattgaggacttagaagttgggacgtgccaaccgcaaataacatacgtgatttaaagactctttacaaatggctttgacaatggccaatgggcgatttaagtcaaccaccacatcaacctctggaattatgaagtaagaaactaaaatgcttcctagtcagtgaactagttgcatctcatttatatgagaaattttgaattacgactttcttggccatgttggtagagtttgggggaattcaaacttggtggagtggttcagcttaatctacaaatgtacatttgttcaagtggtttggtaggcagattttttcctcatcctggaatttatttttttattgataacatatcaatatctcttgacgatgctacgagatttctcatgattatagaactgagtagggtggcttaaaaggcttcattttaaaaataatttcaccacattgaattgaatattagtaaactggtatgcctgtaaagtgtacaataataaatgttttgatagaagctggtaggattttaaaatagctcatgtataaaatgtgaaaatggaaacgtgaactaaaatgctaataataaagatatatatatataataaaagataaaaactaaattaattaaagttaaaggataaaaagcttgttacatcaagtcatgttaaaggtgcattagagggtgcagagtaaaagttaccactggtttatctctaatgatgttcttaattaaatatcttttgacttatggggggtgaagacacaagaggttgttgttgtgatgtgattttggctgaatatgttgtattatgataggtaatacaaaagacaaaattttacattaattagtatacttttgactcattggtttatatattattttgtgatataaactattaaaatatttaaaaagagatgaaagacttatgtccatgaacttaaactaagcaggctttcctgaatgcaaatccgtcaatttaccccctgcgcgtgcgataatcagccaccatgcacaacataatatgcatgcctgctgaacattgacttcattgttaaatcaaaattaatcccatagacctattgtagtactcaatttcatcaatcaaaatttattggatgggggaaaaatacaatatttcgtagttcctagtcatattcagaaacctaaaaattaacaatccccatgttagtgaagcaaggtgtcggggaaggaaagcgtctgcatcagtgcagtagagagggttggtgattttggtgggaataaattggctatattgcccccacctaccacggtgctaccaacgttacacagaattgagaatgaaacctaaaaccaaatcttgcagtgacgtacaatgtacatatgctacgagggcatcaccttcaggtttccagtcaaatgttgaacaattggatttcttagcttgctttaacttaagttgaagtttaagaagtgaagctgatgcttgtttttgaatgaaaagcctttgatatatattttaatgtaagcattttccaaatttaactcgtcccatgcttgattgatcagctaatcaagctaactggtttgataacagatagacttctaaatctacgagtgtgagtgcaagcagcacaccttttaaatactagccactgtttgtctttttaatcaacagaaagagaatcccactaataacactattcgagatcggtgttcttttctgtttttttccttataaataaattaataagttttgttcttgtcctgttaaaaactgctctgttgtttcatgtgttgttattaaattaaaaaccagaacattacgaataatgacatgattttattcacatctacaagcaaatttacctaaaaaatgtgaatgacgtggaagcaagtacttcatgctttgaaattgacacacgttggagtctctaatgtccaaccgacactctaatatcctgtttggaacaagctaggacataaatatttacaccaaattaaatattcgtaatttttgcttttacgttttccacattaaagacgtgatttattggttgtgaagcatgttttcaaacatactataaatgaatataaatattataaggcaattaagtaataagtgggaaaaaagttactaaaaaaaggcacggcaaaagtttaggaagaggaagaagctactctgtctgtaacgagcagcaggcgaacaagtggagacaatttaaccaaccggaagcacagggtacaacggtcaattcacaggcggtcgcaaagcttttaaaaacgcacacataggcactgggcactcacattcgccttccagctcaaaggcttagaccaacacaacaacactctcttcactcatttcatcttcaacattcatggatccagtgagcgtgtggggtaacacgcccttggcgacggtggatcccgagatccacgacctcatcgagaaggagaagcaccgccaatgccgcggcattgagctcatcgcctccgagaacttcacctccttcgcagtcatcgaggccctcggcagcgccctcaccaacaaatactccgagggcatgcccggcaaccgctactacggcggcaacgaattcatcgaccagatcgaaaacctctgccgctcacgcgccctccaggccttccacctcgacgcccaatcctggggcgtcaatgtgcagccctactccggctccccggccaacttcgccgcctacaccgccgtcctcaacccccacgaccgcatcatggggctggatctcccctccggcggccacctcacccacggctactacacctccggcggcaagaagatctccgccacctccatttacttcgagagcctcccttacaaagtaaactccaccaccggctacatcgactacgaccgcttggaggaaaaagccctagacttcaggccaaaattgataatctgcggtggcagcgcttaccctcgcgattgggactacaaacgcttcagggaaattgcggataagtgcggggcattgcttctctgcgacatggcgcacactagcggccttgtggccgcgcaggaagtgaacagccccttcgagtattgcgacattgtgaccaccaccacgcataagagcttgcggggtccacgggcggggatgatcttttaccggaagggcccgaagccgccgaagaaagggcagccggagaacgcggtttatgatttcgaggacaagattaactttgcggtgttcccttctctgcagggtgggccccacaaccaccagatcggggctcttgccgtggcgctaaaacaggcctcgtcgcccgggtttaaggcctacgccaagcaggttaaggccaacgccgttgcgcttgggaattacttgatggggaaagggtacagtcttgtcactggaggcacggagaaccatcttgtcttgtgggatctcagacctcttggattgactggtaatatatataggattggaccgctgcattttgatttcgatttgttgccaatgtatctgaatctgaatctgactcgtttcttgtgtttattgctttgcagggaataaggtggagaaactctgtgatctctgcaacattactgttaataagaacgcagtttttggtgatagcagtgccttggcccccggtggagtgcgaattggtaaccaacttatttctcttttatgtgctagaatacagatcttgctttactaactcaattcaaaacaagatctcattcttaagatcaaataatgatttcctaaggctaggactatatcctcaatttttttttttttatcacagaacttaatgaagtttcttacgaaattttgtactgttttcttatcagaattggaatgtaagtaataatgtttctattaaaggctagcatattccaccacctgtccagggttgagccctgggatatatcgaagtgaaattttaattttgattggagaacaatgcttaaaacacaaagtgattgtatctaagttttgtgcatattttaatgcatttgtacaaggtatcttggtaagttgtagattagtattggaagaaatttcattgaggatgtgtttttaatttctagtgctttaacaatggtgtattagatcgggctaagcttgcagactgccattattaatgagtttctagttgtttgattgtgcaatatgattgccaaatcaattactataaactaatatgtttttttgttatttgtttttaatatttatccctaaaaatgaattatcttgatgtattaattacaaaaatgctttttttttattgcccctgtttctgtatttttctctgatgttagtgaaatgtgtgactgtgctttgtttatcatgggtgagtgcctgactggagtttgtgtgaacaggtgcccctgccatgacttctaggggtttggttgaaaaggactttgagcagattggtgagttccttcaccgtgctgtgactctcacactggagatccagaaggagcatggcaaacttctcaaggatttcaacaagggcctcgtcaacaacaaggccattgaagatctcaaagctgatgttgagaagttctctgccacatttgacatgcctggcttcctggtatctgaaatgaagtacaaggattaggttcaatcataccgctctctactgaattatgttactcaaagttcggcgcaaagggcagaaatggagaaaaaggaaataagtgtcttcctttctgggagtattagggtttatcgtgatggtgtttcaattcaatagtttgaagtttctttgtctttgatttcatgtttaatttgttagcctgattgatatcatatttttttcatatcaaaattgaaataatacacctgctttctttattttcctcgcaagctagtagtagtatgtttcatgatttcatcttcaaaatattgctcaacagaacatcttaattcttaacaaccatgagttttagttgagttaagcaaaaaaaataaaaattatccaaataaatctatcgtctttcttatgcctcaatgttcaatgcctcccccccctcccttgaaaaccaaaatgctccgtgtctaattgtgataaaccgataatacccctctggcagattatgaagttaacgtaatcctgtaacctattgtagatagacttttgtaacttaaactcaaattcttattgtggtgttttcattgtctaattactgaatcaattcttgatgcatcacttcaacgtcttcttgctgtagtaagttccacacgctcctattggaaagagattatgcatcaagagttaatcggtagaagcaaaaaattaataagacattcattaataattatacagcgtgacttttcaacatacttccaacatcgttgtgtaaattttcccaatcccatatctgctgcttctagtttcttatttttgctcatgtactcattgccaatggatccaatgcaagaaagcctgctaaaagccattaaaatgtacataggaatgaagtgagcagctattgcattgtggttgttgaactaatttacttgatgcaatctgaatcagccactaaagggctcgtttctcctctcattagaggcgtaggatttgtttgctcaatcagcgtcctaaaacacacatcttatctctaatgatttctatcattgccagaattacaattaaaaactaaaatatcatttaaggaaccaaaaagttctgggaagaaaaaaaggaggatcagtccagtaaatgtaatcaattagattgaattgaacttctacagacccagaaggccctcgatgcattttcaccgtaggtggtttgtctttctgtactatactgctcgcttagcaaaataatcaggttaagaaagtttgcaatttttttatcttgttgaggggtttgttgtcattgaaaacaaattgtactcaggaatttgactcaacatgttcaacccacacattatcacatttaaacaaatctaaatcaatcgcaaatcatatattcaacgttttacatactaaatatttcatatcatagttcctcacttcgttactacaaagtcaaaactttatgtgtacaatattctcaatacaaattgaaataagaatcaatattcttacatcatagactacaacatgaggttttaacatgtcatgtaagaaacttaatgccaacgagtaaggcttgaaatatgattagagtaagaaacttcccagattttataactagaaggagaatgcacgtgttaggttttatttctccttggaatcatagtaaaagtacacccaaagaaagccacttgctggtttctttgttatcaatcaatgtcagagataactctcaaagaagccctagtttggaagatatatcatacaatttagaataggctaccaatcaattagaaatgcaaatgagctaaattgcatcaattacttcaatttctagttaagaaggccttcacaactattggactcttgacgtaatgcttgccatctgaccatatcagttttccaaacacgtagttatttgtggcctttccttgcatggccttgaaggttactttaaagctcttctcttcaccaacatttttgaacttcaagatgcttggcttcacagaaatggtgattccatgcgggttttgaacatgagcaatgtacgtccctggagaaccaacatttttcaatctccttgtaactgtcactgacccagagagtttggggactgtgattgagggatagttcaggttgaggagactaaatttcttgcggcattgatatggaccttctgtgaacactgagatctgtgtcgcattgtaacctaaagcacataagaagttgaggtaatcatcaattgttgtgtcataaactagcccgggatccattgctctgtttggttgaacatgtcctgccccgtaactgaatggtgttgccttgccattagtagcattcagtagtggttccacctcattgtctagtgttgtagctgaaagttgcagaggacaaatcatcaacttttgatagccactttaacctcaccaatcaaagttgctttctatatatgtatggacaaaaacttagatacagttccttagatactattggtgttgttctccaattagaattggagtttcacctcccctcataatcttacatatagtttcttaggtactgtaatcgctgttttctaattcgaattagagtttcaccttgcacaatcttttaatgaaaacctttattaacactagaagaattaaaaaaactatatctaagttactttctatatgtatatatctaagctttatatttctgggacattttgttgtagattggcttaagaaaaaggatttgaagcgtgagaaacttgaagaacatctcactcacccgtggtcatgattgctgatttaatagcagcaggactccacgtaggatataaggctctcaatagtcccacaatgccagaaacgtgagggcatgacattgatgtgcctgaaactgagttaaatggaatcctgcgcttgtcgaacacttgattggttggtccttgggcttcagtataggccgctataactgacacccctggtgcagtgatatcaggctgaatatatgggacaaattaagagttgttagatatctaacacattacaaaaaattacaagccaaattacactagtgagtaatgtcacctttaggatctctggcacgatagtatttggtccttttgatgaaaaggctgccataaacggggctggcttagtatccaactgagtctttggatgtgtaatatatgccactgggaacctagcaatatataaatttcaagtagtcaagttgaaaaactgaaattcatgattatcctttcgggatctttatatagctcaaacaataacaatcacaaaaaaactagaattgcttcctttacttatttgaccataaactgtaagtataatagcaatccatttgaccataaactgtaagcataataacaatagtatagtgcaaactccaaagtaggcataactttaaggcatagcatgaattagtattaataagtggtcgactagactggtaagtatcttacttggttgagttgatgtaattaaagacatcactgccatcagtaaaattgatatgagaagcaggaaggacatgaggatcagctataatttcattcccagtagtcttgtcattagcaaggaccattcccacagcaccagcaagaaaagcttgctctcccttgtccactcttgcatttattcctcggagacataccacgatctttcccttcaccttgttgggatccagggtcccattctggcacagcaccctgcatgcacataaattttatttaccatatctagtactatgttaattatgccaaatgatcactcaacaactgacgactataacgaatttcaattttttttttatacttacgcatctccagctcttgcactcgccaatttagcatctgtagctttaataattgggtagaacttgcgtgccaatattgtagctgataggctttcgcccttcaaatcaagcaatgtacaagaatattgagtcaggtgataatgttttatatattaagagtgtctcctagatcatattagttttttccatcattttttgcaataataatattaattttgactgacatgacaagtgcccattttattttacatgaaatctcttacaatgccacatatcatcaaattatcttgatatgataaagtgaaataaggactaacttagtgtattataaacatttaagggactatagaactacattgtaaaaaataaaaattacactcacggtggataaagttaaactctttcaaaatttccataaaagaaaatgtgtgtgggaaagagacaaaccttgaaggtgatattgttaccgaggacaacgtaagtggggaactgtcgatccatggtgctggcagctaccgtaacatgccagggtgcaagattttccgcagtggcatccgcaggcccagtgttgccagcggagcaaaccaccacaatgccatgtttggcggcatggaaggaaccaatggcaacactatccttgaaaagcgtggaggtagagccaccgagcgagacggagaggacatcgacgccgtcgtggatggcgaagtcgaaggctgccaagatatcggcgtcgaagcactcgtcgccggcgacggggggccagcagaccttgtaggctgccacacgtgccattggtgagccacccttggctgttccgtggccctggccgaagacgctgacacgtgcgaccatgttcccggcagctgtggatagggtgtgggtcccgtggccctcgttgtcacgtggcgagtcaaaggaggagttcaggggacccgccactgaggcgtaccccttgttgaagtaccttgcccctattagtttcctgcattgtttagtgtgttcaaattggtgttaatggcgtttgtcttgagtgaggaatgagtggcccctcatgttatatgggaaatgctgaccttcagagtgtgtatgaatggaaggaacatagataaggagaaaaaaacaagaatagtgtgtacacatttgaagttaatgtcataatcctttcatgaagagtggccctcaataagtggttgactaaataagataaatcctaaattcaaccaaagattgttgtacttcatggttagaaaagggttaataacatattttctaatataactttttcttataacaccttcttttactttctttaatctaatcttaaatataaggaggaaaaattattctaataaaaaaattaatcgacatcatttaattatataaattttatttaaaatatttgtttctaaatcattcttaatattcttattaaataaaataactgagatttatttatatttgatattgacacataaggaatttttttcttcttatattcaatatgatattaattaaaatttattaaattaggaaagagaatactgaatgagaggtgagattcagaaaaattgatgatttttaataaataataaataatgtgttgaaaataatttattattaatatttttcaaaatattcttcttttctaacaaggccatatcgttctagacacggagagaggaattcagattaagagtttttttaaagaaaaccttggatataaaatgacaggaatataatgaccaggtttacattcaatttatccatctccataaattttcaatgttggttcgtttgattttttaaaaagtctttataattacaaaatatatttagcattgaataaatattttaaaataaaaataatagtttgatgaattaaaactatattttctttaaaaaatatattctgaggagacttgttaacgagatccaatattaaatactttaattcgaattttctttttataaatatcccaacaaactcaaaggaagatggtacctgttgcagtgaaaagtatgatcaattccgttatcacagattcctctccactttgaaggaattggtcccaatccttcctcactaaagctctttgattcaggccaaacacctagcggtaatgcggtgggagcaaaagagagaagagtgtggtcaaaataagataagcatattgtaaaacggagattctacttccttctaccccttctccctcaatctcatccaaattggctaaaagctagcatcatgatggtcctgtttttagttttcattgcccccacccacttttcatgcttacagtttgggagcattttcaaaatgaagctcatgtaatgcacttatcgattttcttattggtgagcttattatgacttccttggactatccccaccttggcaccattcttagccccacctcacattataagcccaccctttttatttatttatttattttagtcctatcgtaatgaacagaagtcacaacttatagttttgtctcaatctaagtatgatttatgaccaaccttctgcatcacaacatatgcatagactgaaaacatatatttataacttttaaattatttaaaataatgaacatctaatggtgtagtataaaccaataattgtaacaaaattctaatcctaatatatataacagacaaatgacaagatgcctaattgcccatgtcgcctttctaaaggtggtccattctgaaagtcgactactccattatcaccaaacattttctatacatactaattttaccataagaagtttttcaatttctttataaataattactttcatcttattttattttgatgataatatttttttggatgatctaagatatcactcaatcgaaaattaatcttttaaaatattaaaattcatttaagaagttgacttcttctcatatatgattttgatcatatttttaagggataaaattattttacttaatcatgtcatgtttgtccatttcattttagtgttaattatgctttgagtataattactatataaaaatgatgtaagtgtagttatagctaatcacaagagaataatgcaattagtctatttctttaagatggttcgtgaacattcatactttgggtgtggaaaaaaactagtctaacaacccattgacggcaagattcaaattaataataaactaatgttatgaaatcaacttttttgaaacgatcaaactctggaaacagattggtggtgggggatagagatacgatgagataactttgagtatgttccacatgtgtgtataagtcaacgatctagattaaaccataataataataataatcataataataataataataataataataataatcaaaccccgttaattccaagatgttgctgaccactttgaaaagaatagcaagagtttttaaacacataaatcaggaaaacttaccggtatccaggtttccaatgatgactccctcgccaaatctggctttattccagattgagttggattggatcaccccattatgctctagccccatgaaatcccatgatcgagtggtgtgtagctttctcccacggttctcgaacactgacaacactttggggtgctctagaagcagtatggacaaaagggtataagtacacaatgagatgaaggaagcacagagaagagaaaacagaggaactaagcagaggataaggttcttggttcttacttgatatctcagcagctacttcttcttccaaagttgcagcaaaaccattgatgtgccttgtgtatgagtaaaagatggagtccttggttgtattagaactacaaaaaataagcaaactcaaacaatttcaataggtaataaattgtaccatatgtgagttaagatgttataattgcatttttttttaataccttcctaagaaagatcccagaaactcatggtgggactgtgtcacttgattgaagtcaactgaggataattctggcttgtgtgagtgggctcccaagtacaccacatatgactacaatttaaatggttcagtgcaagcattagatctttttccacagttttatttatctttttcaagattgcaaattgcaatagctcacctttttcactgcaaagctgggtctgtgcagtagaaagacaagaagaatttggaggagaaagtggatggaagaacttggtggcctcattgcttttcctctctttgaagtcctcctttgcttttgccttgttttgaatgtaacagaaacacaacctttggttttataggtaataacagccttgtaaaatatagtcattgcacctttgctccttaggttgaaattatatttaatgtactatgtttgccatatcagattcagttcactaagtggttttaatactttttttaaaaaatttgtactgtacttcagagctaagtttttatttatttataaattttacatggtattaatctgtttttgtatctgactaataatagagtttataatgttatattcttagccttaaaaatattatacacaagcacactctcattaaagtgtttaaaatagagatattgcattaccattatatttaaataataaaaatatacattagttataatttcatttgattaaataaagagagccatcaaaactctctcaaactaagcacatccgagaaatcaccaacgtgacagctaataattaccaaatataatattaacaaggtggctttatataaattggaccccatacagaaataacacttttggactattgcgggtttgtgaaaaataacaaatgcactgtttatttattccgagtgagtgtgtagcaagttaattaattaaggcgaggattgaggaaataggtaattggcaaaaaattgacaagttagctttaagtacaaaaaaatgtaatttctatccaaaaaaaaaaattgtaactgaaagttactaacagaaaggtatttagttaattgaagtagaaatattaataaaattagttataaaaattatgactactatgaatttatcgttaaatttaaaaataggttcgactggaatttaatatttttaaaattttaattataaaagaagtgaaaatagaaatagaattttaaaaattggattgatataatttgtattttttatataaaattcatatatttgtcctttcctgcgagctaaatataaaaacgtatttcactgtaattcatcaatgcttagaaataagtttttcaaacttatgccaaagataaagatagcatattgatgaataattatacaaattttacaacaaataaactataaaaaaggtaaatcattcgtgtcccttagtatatgtatttcttttaagaaataatacatcataaaaaaagttactaaacaggtaagttcaaggcgtatgttacccttaataatcacattgggttgggacgtcaaggttaacatcaattactcttcagaaatggcctcgtgtaattatttttaagtgtgattatcaatttaaccaagaaccaattaagaaaaatgaaagcattattgaaagaagacgataagtatataatgctgtgatgagattccatcgcaatcaaaatagcatatggtatactgttgccagccataaccatatttatgcttcgaaaaggatggcaaaaggccactgctgcctgcgaaaacctccggcggacagatataatctatttgtaaattgtaattatttataatttatttatctcttataacttttcagatatttttatatctgttctgtatagtttctagaacacaaatgtacagcacgaaagcgctgtatgattactgtttgatcactctaactccgcaactatgaagatatcgatggtgaacgatatcccacagtagatgatcactgagatacacgaaattggggtggggtgtgtgctcagtgtaattgaaagagagagagagctagagtgtgtgtgtacctttcaccaacgagcaagtcatatttatagatagaatacctgaccgttggccaactgcatcgtgcacgagtggttcctatattcccggcttttacctgcacgttagtaactacctgagtggactaagtctttagtccatgttcattgaatcccaatatcaggccacgatcagtttacatgtcgcccactaattgggccttaacctaagcccaattgtggcccccagaacagttgccccccagcccggttgccgagtacactcgggagccggggtgcttcctccgacaccgcaattgtcaagtagacgactacaattattcatcctcgtttgtccggacacaattcatccgggtactgggagcggccccgacccgggtacatctcatccggacacgttgtggacgaccccaataattaccttctgatcgacattaggagttgaagtcgaacatttgttcaaggaagaaacattgtcgaccatctatctagagaatcgtgcccgggttggtggtacgaagtcgactcggtttaaattacgtccgggttgccgtcctcaggaagactcgcgaagctcctaggcttccacccctgcgtcggttattattctttgcccttaaaggcagttaacgcatttaatgcgtccgtctcttcactgacttggtgatgattgcccattatgcacttttaccataatgcccttgcgacgtttcaattttgacaactgaaccggttcttttccttctggcggttactgaaactgtcattactttttgaatttgattttcgaaaattgccttttcgtgcctactactcccttacttgtcatttctggttatactctttctgtcacttcctccttttctctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcccacagacggcgccaatgttctgtatagtttctagaacacaaatgtacagcacgaaagcgctgtatgattactgtttgatcactctaactccgcaactatgaagatatcgatggtgaacgatatcccacagtagatgatcactgagatacacgaaattggggtggggtgtgtgctcagtgtaattgaaagagagagagagctagagtgtgtgtgtacctttcaccaacgagcaagtcatatttatagatagaatacctgaccgttggccaactgcatcgtgcacgagtggttcctatattcccggcttttacctgcacgttagtaactacctgagtggactaagtctttagtccatgttcattgaatcccaatatcaggccacgatcagtttacatgtcgcccactaattgggccttaacctaaacccaattgtggcccccagaacaatatctattaataatctattttgtttctttaaattcatttttctaatttcagatctaataacttagacattttctattttaattcttgtaagatatttaatttatctatagtctatataactttatatatatatatatatattttttaattttggtccctataaacacaaagttatgggagttataaataaaaaatcacaaaaagctgaagagtagcaacgacaagaggatggtatttatgtttatcctccgtcttcacatgccatatttcttattgtaatcttctttttctcttcactctctaaattagtattttttttatccataaaaatagaaaattatattaagatttataacattctcatatgctcctcaattaactcagatacatatccttggtattattttaaagttgaccagcattttcaatcatacttgcaagacgttaaaagtcacatgtccgatttaacttcctaaaaattggtgtctcctttaaattggtgcaaactgttgaaccaataaaaaactagtaataacctataaaacccgatagattaatctgtttcacttaaacttttttttaaaataaaaactttcaaaatgacatttttttaaaaaattataacttatgacattttaaatgaaatttacttttattattattgatttatgcatattattattttttcaaaattattaagttattatattaaaatctatttgatcctaatttgattttgattgaattattaatccttgaattaatgtcttcgatgaccggtccgattctaacagctcccttctgctggcagattagcccagttctctgtcttttgttgctttgttgccgtttcttctctgattttatgggcttagcttagacttcgtaagcactgggttttcatcccttttacgcaaaaaaacaaatccagtctaagtgagtacgaataaatttggtagaaagaatttgttaatcccattatacttaatatttagcaagcattttaatttgtgtgttgcttaggataagtgtttgttttaaattcattacatgattaaatttataataaatgaataccttgaaatatatataaattatatcttagatttataatgaataaccattgacaattttgttaaaaacaatctattgaaatttaatcaagacataaagataaaagatgttagaatacaatattataaaaaagtttaacaacgattttagaaggacttcaatgacgatttttcaatcaatgtttaaacaattgtcattggcttttgatgatggttttccaaaatcattataaaaatcgtataagaaatatctaatatcaacattttcaaaaataattttgagaaaaatcaatgtaaaatgtctcttttcacgataattttgcttaaaactaatgtaaaaaatgcactttataaagacaattttgtagaaaattattctggatatagagatctacatcgattttttggcaacccatgtaatttgtgcaactttttccaatgttggttttgttttgacaacaaatccaatttgtaatttcaaacataaccaaactcagacagtttataacaaacatatataattatattcaaattattatcgatcaaaaacaataaattcaaataccaaataaaatgataccacattatccaattaattaattacattaaacaaaaaaattcaacatttgtcatgtttataatataaattcaacctaaaactattctaaaatacaagtttaaccatcatatacattttcaaacactgttcattgcttcatttctaatttttaaaaaagatcttacccattttttttgaattgttttattccttgcaatttcaatgatgtttaatcactaaatcactacaacatataataaatacaagttaatcacattgaataatcaaaagtctaataaatgaaataggttaaaacaaactagtattttcttataaaaaatcaataaaatactatattaaataataagaagtgtaattaaaaggatagaaaataacaaaaaaatataaaacatacaaataaggataaaataatataatttgagatgattgagagattttcttaacaaaatgtaggagtagagtgtggaatgcacatttagaccgaagaatagaggaaatattgaaaatgtctaattaagagaatggaaaaaaaatatcactcattaagttgtgtattctaatttataatatataaatagataaataaaaatttccaacaaaattaattcttcataaagtttggcatattaatcaacatcatcttgatttttttttcttgcttaaattatatatacctatccatctttataaaatgattgtcagcttttggttgattttagaggtggcatgggttatgggtacatatgagccttggttttcggctttgcccatttaacatataaccgaccaataaattattgttagtcctttttaaaaaagatattattgttacgtattttataactcaattaattcttcattttattttctttataaactaattgattatattccagttttattcttcattttcttacccatattttccccttgatctcttcctatttctttccctcgaaatcccaaacacacacttaactccaaatatcacaccctataaagacaaggatatacaattattttgaaattatagtaggaaataattttgctacaacagttaaacatatgtataaaatatagaggaagtatattattatttgcaataaagtggtccctacagaaattttgcaccagaaaaagaattgattaaacatgatgtgagcaaatgcatgaagggccaagcagaacattcatagtgtgtggattgtcggtagtactaaaccccattggccactggatggtgaaaggccaaaagtatgactttgttgctctgaaagaaaggcatgcatgttgtttgaaatatattaattatatagatatgtgtatgaagaggacgacgtagttgtgaggagaaccatatgtcttcttctgtcttagtctcaaatgggtagtaaagtcaattctcatggatctaccgagcaacgaccatatctttattccttgctagccctagattttgaaaaagcaaatgtgaataatggttatatgcaaaattagaaagcaacctagcctaccccaccgttgtaaggtatttattgattaatataacattacgtgggattttcagttttgcttgtgcatgacgagtaaataacaaccctagttcaagttcaactcacacacgtacttgttgttttcatccatatttcattgcatgctgcaacctatacatgaggtgtctgtgagggaaatgatattcttcacgatggaaatgccacatttgtctttcatttcaatatgattttgagtaatgttttcatttccatttcgggtatgttgtgaaagaagaaagaggacgaaaaggaattgttttctctagcttcaatgttttattcctctggtcctcagtttgcataaactttccttattttggtttgacttgtatataaactttaccccactaattgtggaacatattgtcaactaaagaacaaaacgcatcccactttggttgatttttgggctttaatttattctagctttcaggatcttatctcgaagaattaaatatttgacattaaaatcaatatcttaaatatcaacatattgttaatattatttgtataaatatactttatttaagagataaaataagtataaagtgaatgaatgaaattataaataaataaagaattattattctaattcatgagtatctaatttttaacatctttatgcattacttgaattcctgttttcttccccaaattaaagcttgaggtggtaaactaactgtttctaatgacaatgagctcgtggtaaactttacttaattggtccatttttttctcttcttgtcaatcttttcatattttttttacatatttagcttgatttattttaaaaataaccatttttttgtcaatttcatgagattttaaaaaaaaaatccttcgtgaaattattcattttcaaacacgttagtttacactgtttttcctaaagtgacatgttgtttgtaagatcttgatcatctatagttgaattgtatgaaagtccagtgaaaaattgtattcatacaagaaaactaaataatttttttattatcagccgccaaaggtaaaaaattatacaacgttttcttttctctctatcacttatctcatttttttattgtctcttcatttcttatttctctcttatttataaataaaagttgcataagttaatttattgtataaatataatttctcagcacaactcacatgtgacaaataaaaagaaggattagaatcacatgttgtctttaaacaacacatgcgtccaaggaacaaattaatctcctctaccaattaaagcagttaggtgaagtttgaaaattgattgttttttaatatctttaaagagttcaattatagaggattcaaatctaagtttcttgtatatggaccttttaatatgccagaaggaaaaagaaaaatatttatgtgnnnnnnnnnnagttaaattttcaaattgttgtgtgcagcgcatatgtgagaaaaattattagataattttaaattattatttatttatggtctcaatcaatatttatattcatataacatgtatttaatttttcgaatttaagaaaaaataatcagtaatatttaattaagtgtcatatagaaattaatcatgattatgaactaattaaatgatgatcctaaattatctaataatttctcaagaataagattattacaaattatctttatagtttagaagtcgatctatttgtttggaaatatactttttgtttatctcaatacaagggctgaatacaggtagcgtcctagaaaaattaagatcaaagaaaatagaagaacacacatataaacttaaaaaaaatagattatttaggttttgctaaaagtttagtcatctatatatgagcgatcaccaatgcatatagtcaagaattagttcaatggagaagcttacgtagtaatattttttttattaataaatagatcatatatataaatataacgtctcaacttaattaactttttttactttattcataaaaccaaataaactaatataagtccataaaatattaaaaaatttctttctgtttttttcttcttatttccatattcatttataaacgtttatctcaaataataaaactgtgttgagatctctctgttatatttgtttttcttatcttaattcatatcatctacttgaacactttgttactactattataatttactgtatatatctaaattataaataactattacaaaggagggacatatcaacaaccacaatctccttttgtaaaggcaccctatgcctatgggctatgggatagggaacttcttgtgcatttcccttcccgggatcttcgactactgtaaaagagcaatgatacagtatatatatacataccacaccacatggttgggtccattattatagccccacctttgcatcatccccttcccggttgtacttcctttatgcatgatagatgtaattaattatgatctctgaataatcctcagttactaaaactaatttaattaaaattaatgatattaattacaatgacaatatgtgtctcacaagtctcttaattatcattatcctccattccttatcaacgactcactttctatgttgtatacgtatcttctattgtctataactaattgactttaataattatttaactttcttaggagcattatttaattttaataattatttccatggaaattatgtcaaaaaataacttttaatttagctatattttattttatcatatttgcttgtttttatttattactagataaaaataaattctactttatttcatttcatatttcaaaaattaaattaaagtaaatcattttaataatttattatgatatctaaactaaaacacacttatttatgtatcaagatttctgtcacaatatttattacgcactggaaactcctgccaaaacttgagatggaataaaataatttccaaaaagaagaaagtgacaaatatccatccctatttctgtatgatatagcttttagccatagggatatttttagatcacaaaattatgaggtactgtaattttattttattcttgtcgggtttatatgtgatctatggatttttttttatatcatttacatataaattgagtttaattaacaagatagcaatttaattcaactcattcttaattatatgatgcgtgctacgttttttagtaactatctttgaatttttactactattagattgttatttaatctatactaagtattgtttattgatttataattaagagaacttgtttatcaccaccataaatttctctgtattcactagatgcatgtattgttaagtttaagaaattcatgcctataagtaacaaaaaaagagattttgtaaagaatctatgcacgagttgcaccaaagtatatcacgtaactttctctgtcttttgaaaacaatctatttgtctgaaacctaagtagaaaccaactattgtaattaaaagtttaacgccgttttttgagttctgttatgtcggtagggactatggacaaatatattttttttgttagttaatttatttatttatttatttattggtgattcactctctttcgcttttaatttcttgggttaaagcagaaaatggcaggaatgtggggaaaaaattggaggacagcgacccgattttctctcacagcaaattgagaaatgagaatagtttgccctcgcatctgatgcaaattacataattatcaaattatgttatgttcctcattctttgaggtactggcaaatgaaaagaataacaacaatgctatatatgtatctttataatccaatcacatggtgtgttagtgggggttgcggcactgaactggtgaagcacgatatattatttagataattttacatttatttatgaaattaatgagaatagactttcactttaattatataatagtacgtaatataatgctgctctaaaatgacaaaactatttgattttttcggtggaaattgtttgaatatggaaaagtgactgactatcgttaccatcgatgcagattttgaaagtgaaaatcaacagcaaaagtacttttaggtgtgcaacgtactttttgggaaaaaaaattccttgaaataataaaatagaacgataacaaataaacaaaataaactctatgtgttagaattttcaagtactaagtactaccaaacaaacatgcatgcttttaaaacaaaatatgaaattacacattgaggacattttaaggaatatgttttcaataatatgccaaaattatatgatataatcttaaattcagtttgtctgatttaatagatcttaggtgtccaagttcttcaaaaaaggtagtttgtgttttatttccataaacaaccatatgtctatatgaagagttgataagataagtgatcgccaatagttaaaactatgtagaggaatactaataaaaacttcaagtaaaaatatatgaaaaacgatttagatcctaaatagcatttttgaagaattggttttttgacaaaacacgatgatatcttttgattcatgtaactgattccacctagtggaaacgggcttttgttgttgttattgttttaaactactatatgattgcataatttagtagcatcatcaggtacattttaaacaaaagtatatatatagatatatatatatatatatggaatcatagaagccaattagttaccttaaacatgattatgctggcaaagatggtgaatgatgtaaacatgacatannnnnnnnnnnnnnnnnnnnnnnnnnnnnnnnnnnnnnnnnnnnnnnnnntatatatatatatatatatatatatatatatatggaatcatagaaggcaattagttaccttaaacatgattatgctggcaaagatggtgaatgatgtaaacatgacatagtaaattggtgatacaactgcagttttaaaggtgtccaaagcctgaaacatgattccaaaataaataaaatagcattacaatataattggtaggtgataagcatattgtcttaaacaactaacccggcacacttatttgaatgattctaacattattggttttatttattaaagaaagtctaaaaaccaatactaaaatgaagttcaattgtaagttagttggaaatccctactgtaaaaaatatggcatgccatttctgaaatattgcatgttacgtattactcatgtataacggcaaaggaaaggaaatgaaatagctcaatgccaattaagaaaagcaatacaaaatcttttgtttataacttttccaaatgccacgaactagattagaaatgcaaacatggtcatttagataatgatagaagtctcaaagattgcaaaagcatagttaaatttcttgagcattacaaattaccacctaatcactaaggtcagaaaaatcaaaatactgttttcaacattagcactccaataaccaataaaaaaaattaaaaatatatttaactttgacataattattttaagttgtactttggaagacaaattacaatgactgccaacagtaaatgtactaatataagtaagtcaaagtttaccttgttcaagtagttaatctgcaaaagacaaacatcctattacaataatcataaagaaccaggtctgaaagtaaatgaattggttgttgccttcaaatgttaacttcatagctattgacactgctttaacactcacgacctatgcaacaaggaacaacattaggtttatagagggtagttttattgtgacctacatgacacatatgagcactgaacacataatcgatataccgtaattgagcctgtgagagagcatattccgacatatataaccagataggttggcccatatcgagaacacaatagaaaataaggatgcaaaccaaccacaactatacacatgtagattagaaagcctgttgatgaaggaaagaactcaatgtcagtttcattaaccataaatgaatgccttgaatctattaagatcttaatatgcatcccactcatcttgtatcctcctactttgattttttacaagattcaatggtaaaagatatgttgaaaccaaacaatcaggaattgaaaattacctggttctgtagcaagttgccacacttctttaacagagtcaataactcttacatggggagcatgcaacacaatatttgtagatcccaccatacaaagagcacatcaaatatgtgcaacctctcttttaagataaagtgagctaatattgcactgcatcatgatattagtttgtaactttccaaaatgcaagccgcatccaaattaaaatttaatggatgaagatgtgcatccacatttgtgtcaaagaaagcagaaacatcctaataattaatgttatgaagaatagcatgttccttacctgaaaatgatacttaaagctcccaaaggagttacaagtagtgcaggagcaaatgcataagctgcaaaattggctacttctccaacaatcactacaaaaatgaaagcatacatatagaattagttgatgaaattttcataagattgtcggggacattagcaaattagttatttatagttacagattactaagagttaattgaaaatttgctctatgaaatttatatgtagcacaaaatttatatctatgaaatttatatgtatgtactaagacatttgaatccaaagtcaaaggaaacattgtcaaagtagtagaacttaaaattaaaagtaataaaaataattttgtcttagaagaattaaacttaaatcagttgggttcaagaatttttggtagtccactagacttgaaatgtgatagaaattattctgcatcactttatcttttttcaccctccattataatcctaattgtaaaatgtcaaattagctgataaagacaacaaatgagacgccttttcaacacaacagaaaaaaccatatatcatgaagtaatacaataaatacaaacagataattaaagatgaattagatcaaacatgcaatacaattggtcacaagaaatcccctttaaataaaaataggtagcttatgattaggccttgtcaaatgtgttttgcaggtaaaatgctacatgatatattataatttagtaaatgcagaaccaaaataatttttaaaaatcacacactagagatcattccaaaccacttccaaggttcatatatatatgcatgccctcccgcacctgatcaaattaaaacaaaataaatatatatatatatatatatatatatatatatatatcaatgattaaagaaagggtaattaacacctagcaaaccaaaaacaaaaatgtgaggaaacatgaacctgctctcgacgcgccgttgctcgccaagctcttcgacgtcgtttctctcccacgtcctccacctcgcagcacaagcgggcgtccgctacgccatgcagaacccccaatcctcggcttcgtctcccttctagaagcttccaaaaactccaatccccatccctccatcgtttgggcctcctccagttccgtctatgggctcaataatgaaagcccattctccgaactccaccgtacagaccagcccaactttcacatttcatataatatgtggcaatataatattctttcttgtgtaggcacatgcaactttaacattttcatttttacatttctcacatccctttctctcctaatgttcctttcttgtgttgaacttgcatgcttctcattgccggtaacccgatcatggataacagtttctatacaacataaccaaaccaaacgaatatgttcatactattaaaataggaccacaacttcggttaaggacaggcatgagatctcacatcttttaatgcttagcacacttcaaaattctgcctctaaaaacaagagaaatgaaccagtcacttggatacacaggctcaaattatacatcatgacctcaagaaagaaaattaatgactcctcatattaaaacagaccacaacttccgttaaggacaaacatgagatctcacatcttttaatgcttatatcccacttcaaaatgctgcctctaaaaacaagtgatatgaaccaatcacaactcaaattatacattatgacctcgagaaagaaaaaaaaaatcatgactcttgcacattaaaacagactacaatatctgctaccattaaagaatcatatccatgatgaaattccaaaaatagaatggcggcaaaacaactttgtattatgtcaagaaatatctttaataaagcattagctattaagaagataggttaagaaaatattttacagaagaatgtgtgaattgatattattgataataaaactttgaactaataggttacaaagtataacaaactagataagatgaaaccaaaacaactagataagattaagtgtaacaaactaacaacttgcctatatttaaaatacataacaaacaaatttaaaatacaaagatataaataagattaatctcccataacattagcatctaaactcaaccaaagaaaattgttttatacaatgtctcgtcatcacaatattcaaatccactcatttctaaggagtcgtgttgtttgatggatcccctgaaaattgctgcagaatcaatttcagctgttgttgtatttcattcacctgttcttgaattttttgcattccatgaacttgttgatatgcactatcagaattttcaaatcccctcatttgatgagtcaagctgttttgtggattcagcggcaacatttgttgtttttgttgcatttcgtgaacttgtcgaatttcaggaagagaaattgaattttgtaaatcaatgatgtaaggaactccaattttataatgtaaggatatgtcatgaatgctctttctttttttctgtgtgagtgaggcattttggcgaagaaagtatttttgagcgtgactagcgatttgaataggagattttgttttcacaaggcttgaaatttttgtccattgtcccttcccatatttttggagtccaactaaaaaagacctgccattaaaaaaacaaatatgagatgagaatttgataagttttcattcatttactgcattaaaataatacaacgttaaaagtctacatgtgttcttcttcagtccatgcctcccctctccctctcttgcgccgaaccgatgaacctgcagcattctgcatcatggaaccaccaccaccgttatgcaccagcgcctcaactgggtggctgggcaactcgaccggagccgagacagtctggttcacgtggtgttgggtgtcctccgccagcgacatgggaggaaccggagtagcaaggttccgcgtcgaccagtcatagagggtctgccacggctcggtctcgaaatcaaataagcgagtgtagtcatcaaacccagacattgttttcttctttcgttttcagagttgaagtttcaaactttcaagtcaatgcctttcttttcgttgacacgggcttcttattcaacgccctgacgctggtttctttgaaaatttggcggcgcaaagtggcggttctttaaaaaaaaaaaattaaaaattaaagaattgtgttatggcattttaaaaaataaaggacgattgaagctttccaaaataataaataaattataaatcttctttgaatttgaaaatatttcctatgaaaatcttatcattttaaaacttttttgaatttaatatgcaaacttaataatttttttcaatttgatattcagttgaaagtcagttgaaatttgatattcagttgaaatttttttaatttgatattcagttgaaaacctttactatgaaaatcttatcatttccaatataatttgatattcagttgaactttttatcattttttgtctttcaaattgcttattcaaagataaaaaaaggtttatcttaataaatttacttatttaaataagcaataaatgatcaattatttagaatgcttaattaagccattttattttcaaaagcctccgttaagttctttatttttttaaatgatgtctcaatgtgatattttattatttaaaaatacttttatattattcttatggttcaattcaggatgagatgttaagttacaatttttgatgagttttaatgtatgaaaatttaatcggcattatatttatcatgttttaaaaaaataaaaaattatactaaaattgtagatttgcatgtcaaaatcaagaaaatcagagaggcggaaattaaaaatatttgcatctacatatgcttgttaaggaaaagagtaaaaagaagtttcactccctattgaatttactcgcaaacaattttcgcatctagatgtaaatgccttagcaaacacttgtttattcataaaaacattcacctctcaaatgttcctagggatggtaaaatgggtctggctcggtgggctggcccgtttaacccacaaaaaaatgtgggctgggttgagactttgagcccacattcattaaacgggcgcgggccaacccggcccacaaaaatgtgggccaaatgtgggctaggggtgggccagcccaccgggccagcagcccaccaataaaaaataataaaatatttaataggtaattaaatgagtgacttagagggagagtgactaaaaagaagttaatgattttgaatccttaaccctaatacatttttatttggaacctaataatgagctatactacatatacaattatgttttgattgtctgcatcattgtgaaccaaatttctaagaatttgttaagacttaggagttaattgaaaaccattgttaaacatgtattttgtgcttgcttttacttctattaggcatgtattatatattaaaaatcattgttataggattaagttagtacattattaatttttagtataaataattacatttgaatttttttaataatttattttacctttttaaaaaatatattttttttttattttttaagtgggctggcccgctggcccactaacccactttaaagtggggcgggctagtattttcagcccactttgcaaaagtgggccagccggcccgacccacttttttagtgggttgggccagcccggcccgtttttgggtgggctggcccactttgccatccctaaatgttccatcataaatcatataccatagatgaagtattgacccttaaaacacttgtctggtgtcgttggtgctggtttagttttatttttcaaaataagaaataaagtggctgttttttatagtttaatttgattaaaactattgaaattttcacttaatgccttcatgctaaattgaaccgaaagaatcacattaaaataaataaataaacaaagaatcgtgttatggcattttaaaaaataaaagacttgatagaaactttccgaaatagaaaatccttattaaacattataaataagtgttataaaaatcgattcacacccttacctctaacaaaaatcaaaatgttctttctttcattaatcctcttaattatgtaaagattagacaaattacattgattataattagttacattacaaatttattactagtatattttcaagcatatagattatattataagtttatgataaatgataataaaatgttatttttaatattaataatttattctaaaaatattgaaattcaatttaaaaataaagataaaaataacggattgaaagagataagacaatattaataaaccgttgaagaaattttttatatcataatatgaattatttatcataaatctaaaatgtaatttatatgttactatctactaattaaaaactaataaattctaaattatttttattaaaaaagaataatcattataaatatttaatataaatattttaatattatctagagatcgacatggaattnnnnnnnnnnnnnnnnnnnnnnnnnnnnnnnnnnnnnnnnnnnnnnnnnnnnntcaagcatatagattatattataagtttatgataaatgataataaaatgttatttttaatattgataattcattctaaaaatattgaaattcaatttaaaaataacggattgaaagagataagacattaataaaccgttgaagaaattgtttatatcataatatgaattatttatcataaatctaaaatgtaatttatatgttactatctattaattaaaaactaataaattttaaagtatttttattaaaatagaataatcattataaatattttaatattatctagagatcgacatggaattttattataactgagtgagaacaaaaatcttgaccattaaatcaaatcatgaaatattacaactaaaaaaataaaagttatgttattttattttaagtggtgccgtaattattaaatttttaatattaatcattgatgtataattgtatatttttaatttactcttttactctcttatagaatacaagcactactcatttaattaacttgatgtatcatgaatatattgagaaaggggagagagatattaaactaaaaaaataagataaatattaaccagtgacctaaagaaaaagataaaaggattttcttattaggatacctagaaatatattttcctacaaattttaaatgagttttcatataatttttaataaaaaaatttccttttaaattcataatcagtaccggaaagtaagatcgaaaaattaataaaggccctgcaaaaaagaggaggccaacagcatcttttggtaacctcttccttgaaccaacggtggcctcatgcaattttattaaaaggaaatccattctcatttatttcaaagctttagtggcttgaaagttgaaatcactataaaacaaactaagcatataaaatgaatatatacacacccgtgcacacaaaagaacaaaattgtcgtgcttgaataatgagaatgttcaccactacccattaacttctcatgggtcatggcgtacgtccccgttagattttaattcaatccaatcataatttccaaaaagtgattatatgtgctttatgcctttatcctatagtatatcaacataaatggttaaatgttggataaattatggaggacgtgcaagactcttgtccactaaaaaaaagtcatctcatcctagtgtactacaaggttaaggttagggcctcgtacaatccaacccacctatcttaaattcatttatcttttgaatggatttatttgattgttcatacaggaacaagagaatgcgtgcaagctatattaacactcccttttgggattcaactttggaagcttcctctaactatttgtagtaacttaaatggacaagaaaattaattgatgggcttctaccactggttaagctaagttggattttttgaacatgggagctgcaatgggttatagcattacatgcttttttgcctcatatataaaagagagggggtgtgtgaatgttacatgtatatagttgcttcagtgacaacgattaattgtatatatatagctgctttatgacaacgtacgtttttcatgttcattttccttatgagaggttaccatcctttgactgagatgaacaacctaaaacataattcttcaatggtttaggacatgatgaacacaatagatactgcatgcagcttgagctttccgatcgtgagatggagagattcttgacttttgaagatttatacagttagctagttctacatgaggaatgtcttaacgggatgatttcataacaagttggctaaactacccatttgagcacaaagcacgaggtctcaaaatatttttccatgatttcaaaaataaaaatagtatttataatttgaaaaccatcaataattttgtaataaaaaaactacattgtcaataattttggcatcagcggagtaatttcatatgactaaaaactgactagtgtaggacatcatgggtattgaaggcaacacttaaacatgtagtattatattagtttaacaccgttaattaattgaaagttgaaaccacggttagattcaattaataatggttttcatttcagtagggatggcaaacgggccggcccgcaaaaaaacggggcgggccggcctggcccgcgaaaaatgcggggcgggctggcccggcccgcttttggaaagtgggctacaaatgctagcccgccccgcttttatgcgggccagcgggctagcgggccagcccgcaaaaaaattaaaaaaaataaaataagtcaatttaaaaataancaaagttaaataaaaataaataatttaaaattaatgttaaataaatgatgtcatgtgataattcacaaaattataccatttgtaaatgaaatttacgattataaacggttcaaaagtgtaatatgctagtaataaaagactatttgaaagtatcattatcataatcattttaatattaaaacttagaagttaattatgagagtgcaaaagagtataaatttaaagaatatacctatttcaaaacatgttaaatatatttatttaattttaatatttaatatttaaataatataggccctgcgggctggcccgccccgacccgcgtttggcccgcaattttgcggggcgggccagcccggcccgtttttgatttgcggattgaaattatcaacccagcccgcgtttttttgcgggctacgcgggccggcccggcgggccaagcccgttttgccatccctacatttcagatattaaaatgatgatgatcagatacaactgtataatagaagttaaaaattgacatctcgagaaaatttcacttgtaagtccacacaaacaaccgctcaatcagcttcctccattgataagtccaagtgttggattcacaggtcctaatgaaaagacaaaaaatccaaattaaaaatattaacagatacgttttcttttagaatatgtaacaattaacgatgaaacaaaattttgaatttataatgttatgtgaagtactgaaaaatgataataaaataaaataaaatataaatattttacaaaccgtgtctcactagaaatttgacacgtatgtggataggtagcagtagtgacaagctggggtaacgccacctggaattgtcgcagtggtaatgggaaccaaccaatgcacatgacttggcttttcatgcatttttcttcttaactctgtaatacacttgttcacttggcgcgtgttttcacgttagactaactttactggctctgggagtgtgattagtttaatctgataataatttatttcgagtctaaaattatatttagatgattttttatatatttaattttatgttggacaagaatttaaaattaattcatgtttataatttattttaattaaaataaattatacatctctctcataagagaatataatacatattttttctttttacaaaacttatacatatttttcatgaaatttaatatgtgtttggatgatatatttaaatcggataattcattttgtaaagggaatttaaattcttttgagggaattgacttgtttgtataaaacatttaaaagcaaattcaaatgcgtatttttatctaacaatttaattatattaaatcagtcaacattaaaatactcccaaaaaatagagtttgaaattttttccagagatactctaactcaactctcaccctctgtctagtgactccacatttgggagagagagagagaacgatgctgatagtgatgtcacacacggtggagagagagaacgaaagttacagtggtatcacacacaaaagagaacaatagagaacagcaacaatactgtcacacgcgaaggagagagagatcgatgggtatgttgcacacagaggagagggaaatagtgatgtcgcgcggaggagagaaagaatgacggtgatgtcggtggcgggacgcgacagtggcaatgctgattggaggtggcagcgtgaaggtagtcagtgatgacgattttgattggtgagttggtgtaggttataaggaaggaggaaccaagaaagaaaggttatcaaaattttttattattttttttatttttgaaaaactattatgaaaacttattttaaaaaatatatgattttcattttgatcgatgaatatagtaaaaagtaaatctccattttgtcactatttaagaaaataaatttgtatttatcttcatattcttgaaaaattataaatttaaaaataaattgttacatatgaaggtattgaattatttcatcataattaaaaatttgaattgatttatccaaacaaatcatatacaaaattaaataattttaaataagagcaattcaaatatatggtatttcaaattctttagaatttgaaaatccctcatccaaacataatattaaggaaattgcacatgcctctcttttattttttaaatttatacaaattttctaaatgttgtttaaatattttttgacattgacaagcatgtgcattgataattttgataaaaaatgactaaaatgtatttttcattttcataaatatggaaatgttctgagacaatttttcgagaaaatcgttttagaaattggatcttctaagacgatttctcccataaatagtcttagaagcatccatccttttttagataacaatttataagataattctcataaaaaatcgtcttaaaatgtagacttttaaagatgattttttgtaacaaccgtcttataaatacctttttttaagaacactttctaagatgatttcatgataaaactgtcttaaaaattatacccttctaatagtttaaaaatcgtcgtccaaaatatgggtgttcgcgggtcggttcggatcggttttggccaaatttaggacccaacccaatcaaatttgatcggttcgattcggttcaattttcagaaaaaaaagtttgaaacccaactcaacccaacccgttcatgaatagttcggttcggttcggatcaccaggttacccatttaatttaattttataactattattttatatcacgattgtttcaaatatctcatacaattaatacaatattatcaaatgtataaaagtagtaaaattgattcatttaataccatcaacataatattataaaatagacttataatataaattaaaacaaaagatttgtgaacaatatttactataatagtctgaatcataattatttcttacaaaccaagctttgttataaccaattttgttgcaaccatatttgctgaatcaaacaaataaacaaaaatataaatgaagtaacatggaccttgttcatttgaacagcagaagcaataatattgaaataagagataaagaagacacaatcaattttaacgtgaaaaacccaattgggtaaaaaatcacgacttccaaattggataatcaatccaatggataactccactatgataattttgtgtacaagagttcttagtatcctagtttcctaatctacccttacacaacaattatcccatttggtatccttgtttcccatcaaaaagctctagtctcaatttaccaagaatagagatacactgatatccttgtttcccaaccaaattggtatcctagtttcccagccataagttgcatgtctcaattcatcaagaatacagacaaaattggtatcctagttcccaactgcgaccttttttccaaagtcaagaaaaagaatacaataaaatagtacatctacgcttatattccttaagcaaataggtacctttaaatcctgattgagagttgaagaatcaaacttgtcaaacgcttctatatgatctcacaacaattctcttaatgatgcagacataaactctctaatactctaatattatttggaatggaatgcatacatgaacaccaaaatatgtttctatttatactaatttaaagatatgattttaaccaatttttgaatgcaatcctaaatatatcctatcatattatccaatgcaatcttaaagatattctattatattatgcaatgcaatcttaaaaatattttatcctactttttaatgcaatattaaaaaatatcttatcttatttttgaatgtaatcttaaacatttacaatatcatacctttttttattatcaaattatttttaaatttttaatatatacatataaataataaaatttatattattattacgggttcacggatcgggtcatcggatcaacggatctgtaaatctaaacccttgacccaacccgtacatgaacggttttgatcggttcgattcggttttgacccaaatatataaatgacccaacccaaactgttcaaatcggttcggatcagttcggattcacaggtgacccgtacccgtgaacacccctagtccaaaaatattaacttttataacggcgactttaaagataatagtaacatatcaccgttaaaaacttttaaagtcatagtaaaaagtcaatttttaaatgtatacatttgtcaaattgactaagttgatctcaaatttgatttcaggataaattgaataaatgtttggctggtaagtttatacttattcaagatccttcaaagttatttttattaattttataaaattaattgtctaataatcaaatcaaatttggttattcattcttgtttattagctagttgagtaaggtacaagatttgtgataaactttcattatttatattcaattcttatgaaaaaaaattatggtcttaatcgaataaaaaatataatattttgacttatatataatacatattattcttatcaagttcacttgttaacaaatctgatcttctcggttgtctaatattattgatataatctcttatctttttctttggtgtgcaataaaatacctattaaaaggacttcaacaatcaaatcagttaagttgaagatatttatatgttttggataagggaatacgtaatttcctttttgtttcttggatatgtattgagggagagagaagttacttcttcccattaaccatcctttgctgaatgatcctgtttttcattgtggagattgtgcctagacgtgcacgaacatgggacatgtgtctgcatggagaatactagctagtctaattatataccaagctcttgtttaagctatgctgttgagtatacacagagttcatcaccgtactgtacacaaattgttcactaaagctaattaaatgttgctagcttacgagagctatgaagaggatttgactattagttcacgtactatcattttgaatttgaaggaaataaatagagatttgaaatcgaaatacaaatcaaacttacaaatcctcgaaacaaaatccactctcaataaaatataaataaaaaacaagagaataaattatagttatagtacatgtctggatattagttggagaactcaaaaatacttttatttccgaaaagacattttcttcttttcttattttgtgacctgaactgtaaaaatgtgcattagaatcatcaaaatcatgttttcaacttttatccaaatataaccgtaaatttttgtctaacgaatttataaactaggcaaataaatgaaaaattatctattacttgacatttttttaatgcaaggtatcgcatattagagttagcacttaatctcttagggtgtgtttgatataatttatgagaatcataattcttaaaaataagaaaaatatgtttgattgagattcttttttatataatatttatatatatttcttaagagcaaaagattttcacgttaatttttaatagaaatttataaactttaattatttatcacgatataataaaaataatatgatatttttatcacaataattattttttcagcataggaaacttagggtctgtttgtttttattattttttgttttcattttcaatgaaaataaaaaataattgaaaaaatatgtttggttagatgttttcattttcaattttagaaaacaaattcagtattttagaaaattccgaaaacgaaaaaaattcattttctgcattttcactaatcatgcatgacactcatgaaattttttagatcttcttttcatttgcatcatactttctttctcttggaacctagtaacagtcaacaataacatgaccgtgcactcaaaacttgcaatctctcccatctagtgaatgccattggataaattttctaagtaatgagtggaaaacaattattgaagaaaatcagaaaatgaaaatgaaaaccaacaaacatatttttctaaatgatgaaaatttgaaaatgaaaataattttcataaaataaaaaagaaaataaaaaaagaaaatattttctcaaaccaaacatacccttaattttctaactttcccatgaaaataattttatggaaaacctgtgtagaaacatcattggaaaacaatgtttattgaaaatgttattttttaaatagtaaaccaaacacaaaaattaaacatctccaagttcaaattcttagaaatttttaaaaaattcttatagcaaatgtgctcttaaaagtttcatataaatccaatcaatataactcaattaacaacaagaggaggatttatattcaattttcacattatatacatcttggaaataatgaattttaagtgtgactaaatccttcatctaggattagtcctataattgactcaaaaaatcaaaacttgtaaaaatatatcagatccaattgagaaataaaaagttctaattactatattaaaaaatattcatttaagaaattatatctcaaacaaataatattcatacaaatggacttgagattggaatccttatccacttgacatgttaaatacactagtacatacattcagtgttgtgaaattcgatccgatcaggtcggttggacatgttggaccaagatccggtggtctaaccggaccgatttcattattggattgattatgtagttgatctggtcaaactcgatcagttagtttattgatcttggttgaatcggttcgacctgactaattttacaattttttatataaaaattttgattttttaaaaaaaatcgaattttgaaatataaatgaatttttcttactcaaataatgttagttatatatttatataatatatataattttgaatgtttaatatgttcctgatcaaattggatcaattattaatccaccgattaaattactgattcattatttcaagtcaataatcaaatcagatttcacaactatacatcaagtgtgatggacaataaacacgtggctttgcttggcattccattgttgcccttcctttttgttctggtttcggcatttgggttttcaattatttttcagcctcgcgtgtgacttccgaacggaaaaacagcacatgagcccccttacttaggaatatagagaaagaacagagaaagtgagaaaataaaaaataaaaaataatgaaaaagaaacacatgaccaataatgatgagatatatattagggacaacacacaacttaagcacagaaaggcaaacaaatacgcataaccagagagagaaagaaatagaagaaaagaaaagaagcagagtggtaaacaaagagaaacaaaacccagaatctagagagcaataacggctctagctttgtgaatagcataccatagcaacaacaacaacaacacacagaacacacaaagaaaaagtacttcccccaaaaccatatattatattattatatgtacatatagatatacatattcatatttttgtgtatattgagatgagattgttgttctctctttcttctgtttattcatgagagagagagagagagatcttgtcctcctactatggtcgctttgtagcagattaggtgatcttatgcaacaaatttcacttgggctctccttcatcaatcgatgtttcacttttttttcccgtcaacgcttcgaatcagagcttcttttcccccttttgatcgatacccattattgcttaggtttcaaaaagtgtttgattctctttatcctcttcaattttgctgctttatgctctctcttttttgggtgtttaatcaacaaaattttcggaattgggattagggttttcattctttgtgggtattttccgggtatgtgtactcagcttgtttgtgttttttttagggtttcattggatcgtaaccggggggcacttgtccaaattgcaaatttcctgagtgattagggttttgatcggagggtgtgattgaaaggaagactgtgcttgttcattctctgcgtggggttgcgtgaaatgggcatggtctgtggtcttttcaggggttcatattttggatttagagttacggtggttgagcatttgcacttggagattgcttaagatggtgtttaacattgcttctttgaacatggaagaagattgtctatattaataacagtgaatcagtgatcaggatttggataaccgtttctggacacactacaaaaagctgggccttctgggtcttcatttttggtgtttttcttctctgtctttttgtctttgttgggggatcattttggtttagggatttgacacaaagaaaaagctgttgattcttagttggctcacaaggaaactagagtatctgatttcagtggtcctttttagtttctgaagcagccctttgaattgatataattagtctgagcttaacactagtgtaggaaacatatactgattggaattgtgttgaaccatttgccgactttaagtagttagaacaagtggttgctgtgctgtgcgttgattttgcatcagtttttagtagtatagtttgagctgtttgaatattttggtgaagggtagtaaaccttggtggtttccacaatttgtgtttgtagtaagaggcttatggaggaatattaaagctggaaatgaatgcagtgacatggtgcatggacaggagcatagttgctggttcgttccctttctggaacagggctactggaaactaattcaagcactctcaaatttagaagaattttacactaggcgtatttggattttgtgcaatgtcgcgctgttttccatttccaccaccaggatatagaaagaaggctataacagatgaagtggacttattaaaaaaggttaatacacttttcctacactcacattgtacatataatttgacatagatttaactgtgatgcaaaatggagttttttgtgaattgcataacgttaaatgtatattgatagacgtcattttctgaatggaacatataaagtgctgaattcattcatgtttgaattaattttgtactccttaatttttcatctgtttcttcttaataatataaattcaatttgtttgaagttcattgtaaaattcttgcttgaaacattttaatcggcatcttttgaactatcacaagtcatgaaagtatcagatattattctgtatgggtgcaattgaagatgattggaggcttacatatttacattacagtatctgttttggcctacagttattagtaggggttctgcactttgttgatggaagttggttcacttgatttgctggagtttatctgtcttatatgtctataagatgttaggtttcctgtggtgtgtccaaaattttgatttttggactgttatgatatgtactcctgaatatataagtttcaagaggattgagtggagaaataatgtcattactggtgtgatcagtgttatcaatggcagatggtgggaggccataattccgccatataaacacgccattgtgccttatggtctgccatggcgggcgtcccttcacaaattgaatatggcagttggcaaaaaatctgccacgccatttctccatggccgctatttaacaacactgctggtgatgaggaagggatattatgatgattaaaagtgtatatgctctgcttgttctatgcctgttgttggcaatattatttttttacgagtccttttgttgtaaaatgatgaactttgtgcttgatggtatgccttggcaccttaggtattgaagcaaaaagttagtattagtagagattgtccatttatatttgggttttggagattcttctaatattcgttgtaatacttactgattttttttttttggaagcaacatctttgaatatccttgatcttgtcagtcatagaacaaagcatttcacctcatctaaaatggatttagagtaaggttataggaattataatcatttttggggttcaaattgacttaagcaagttgtgggaaattgctagttctatgtctttgttgaaataatagctgtgaagaataaggacagtccagggttaaatatattatgcttgtatactcaatgggaatcagatgcatactcttaagttaattacactggtgaaaattggttctagatattcttggcccaacccaaccaattgattttacacaagtgggactgactcgactgagaagatgaagaccaagaattcacattgatttgattgtaaatagttgggtgtatggttttgtataaataattctgactattttagtttcttgttttggcttttctacctgaacatactttgttgtgattaccaaggaaaatttaagtaaaaccattacaaaataccatgatctaaaaatagccttggcaaaagctgggtttttgacgtagtacaatggcatggtttgattcttgtagcagattccaactattgggaaaaggcttttgtggttgtattcttcttagatgatcttataggaaattttgagggtttgatatatctaaaatatattaactgtttaatctctggtttattggctaccatgacttcttgaatcaaacatgagttttgttcccctttttttgagctcctttatactgtttttattcaaatcttttgttttaagctgtctatctgcacaattcagtagacttctcattctttctgttcaaagaagaaagagaaaaagggaaaaaatattctattactcaacattagtttttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatactgtttttattcaaatcttttgttttaagctgtctatctgcacaattcagtagacttctaattctttctgttcaaagaagaaagagaaaaaggaaaaaaatattctattactcaatgttagttttttttaattattattattttttttatttttttgccttttttctcctgtgattttaatggattttactcaatcatgaaccatttattgaatggtagcagattttccgctataagttcagtgaaattgtgctagtttattttccccaaacatgtaaaagtgttcaagtttattttgtggtgaaactagaggttgctacaatgtggtgatcaaggtgggagattttgtataatgttcttgtataaattcttctggttacatcaatttatgtgccccttgagttcgtgttatgtttaccttgattagattaataagttatatattttcagggccaactatgatttgctaatgaaataatcatataataagttatggatggcaatcaactacttcaggttgattttatattagaaagaaatgaactaattaatgttttgtcaagtatatgcattaaattctcaatttgactagcaatgatgctagtcaactctttcccttgtatcattcttcttgttaggtgacattcaaaattgttagtgtagcttttctttttggttgatatggtgtatgtttttaccatgtcataacattattgattatcctgtcttgtcaattcaggatcatagttttttatagtgagctagctacagtgctctcaagatacttcttctctactattgtattgcaagttttatgaagtggtactatataaaaagacaatgggtaccctaaaatttctgattgtgtattgatgtgatccccccttctcccttctccccttgtccccttttttatttttttgtctgtgatgcttctctgtgttcagcagcgacctctgggcctcttcatgggtagtgactgtctctttggtccatgctttttctcctgttcccccataatgcctctcttttccttgctggactggacttccaccaacccattgatatttgactatctagagagactggctagtggccatatctctttttctgataattttttatttgtttctttctattagaccatttctttgtttcaacttttaattggattccgttaccagtagcatctcttatagatagctgagctttcctataagatggaatttggaatttgaaaattttgaggagaaagagaaaataataaagcaacatctgttatgttggataaggatgtttgagtatagaggttgaagttatgtagatcagctagatttattgcattggatgattcattaaagggagtacattatgcagtagatttacttttgtggagcaggctgttagcttatatttttagttgatgggagttttaagtatgattaagcctttaaggtgttgcgtgataggaactaacttgaactacataatatgaattgcatgataataattactgcatgactaaggtattgcatgataataattactttagcattttggtttgataattggtcctctatttttctaatttttgtaatttcttcattttgttattgaaacctcaaccaaccaccattgtaaataggaagtttgtgaaaaaaaagtgaggaaaatccagggaagataatgtgggcagttttcaagttggtatgtgtacattgcagggacatttgtatgcattttgaaatagaatggattatggaggttaaagtgtttcactttttacaaatattttccttatcgttctaatatttggagaattgcaagtttctcctcatttacaaagaccaaacctgctatgctttgttcccattttgttcagatcctgtttcaatatcgatttaatgcttatataaaaatttttggtgataaaattgattgtttaatggatacaaaaagtggatttaatgaagttttaaacattttgcatgtgggagatcatgactgcatttagttgcaacccattccttatttaaatgattacatttcaatagttttatttagtctttcctattactttttctaaagtctctccttttactaagcattataattatttttgaatgcatggcttgtcccaagccaggataaaggaagagagttggtatcaggtgttgcgaatcgaccataaaaaaaatatctatttttatgagatgacccataatgatattttgttggagtgtacccttcatagtgacgcgttacatcggatcccgggtgtagcgaaaaatgtgctagagcccttgccgcaaggcaaggcgctgcatcggtcccgggatgcagtgataagtgagctagggtccttgtctcaaggcaaggcgtcaagtcttcaacccggatttggtgataagttggtcagggtcccaacatgcagatgggcgagggtggtaggtgaataccgcccaagggttatggatgcaattgggaagctgaaatataggaaccttaatgggtaaactgaaagagttagctgatgtttttgccagaaggaaagtgaatattgtttgcttgcaagaaattaagtgggttggagaaaaggccaagaaagtggatgacaccagtttcaagttgtggtacacaggtataaacaagagtcgaaatggtattgaaattatgatcgatagaagtttcagagataaagtcgttgacgtcaaaaggaaaggcaacaagattattctgattaagcttgtagtgggtgatttaattttaaatatcctcagtgtgtatgcaacccaaattggactgcaatcaaatgataagaactaattttgggaagacttgacggaggttttgagagggataccatgagaggagaaaattttcctaggagaagacctaaatggtcatgttggtaaaagaagtggaggttttgactatgggacaagaagtgagactgaagaagatatcttgaacgttgcactagcctacaatttgatgcttgcgacaccttccaaaaaaaggagtctcattttatcacctatcatagtaaccaaaattgtagccaaattgatttctttatggttagacgataagatagaaattcttgtatcgactacaaggtctacactgtagactgtgccgctaggcaacataagctgatagttctagaggttcggttcaataaagtacttaatatgaggaagatggttcaaaccccaaagataagatggtggaagctaaaggaggaaaaacaaatagagttcaagaaaaacatgttgtgtgaaggactgtaggagcctatggggggagcaaatgaaatatgaaataagatggttaaatgtatccaaaatgtgggaaggaaggtgacgggagaagcaaaggaaacaaatttcttacaaaggaaacatggtggtggaatggagaggtgcaggagacaattaaacagaaaaaggaatgctttagatctttgcataaaagttccaatgatgagaacttgcaaaggtttagattagcgaggaaaaatgcaaagaaagcagtgtgggaagttagaggcaaggtttttgccgatttgtataaaaatcttgggagcaagaatggtgaaaaagttatatacaaacttgcaaaaatgagggataagaagagtaaagacctcacaaattagatgcattaaggatgaaaatcaaaattttttggtaacagatgaagatgtaaatggaatatggatgaactattttaacaaactttttaatgtggatgacaataaaagtgaggtggatttggatgacgcttatgatgatctgaatagaagatttgtgcataaaattaatacatatgaagttaacaagactttaaagagaatgaaaaataataaagctttgagatctgatgacgtcctgaagtgtggagaggcctgggggatgtggcaataaaatggctaaccaatctatttaataagttcttcaaacaaataagattctatctgatgcttggaggaaaattatgcttgtgtctatttataaaaataaggaagattattcataattgttctaattataaagacattaagtttatgagtcatatatgaagttgtgggagagagttattgaacatcacttgaggagagagaccaaggtttttgtaaattaattttgatttatgtcaggaagatgtaccataaaagttattttcttgatgcaacaattaatggaaagatatcgagaaaagaagaaagacttacatatagtgtttatagatcttgagaaagcatatggtagagtctcaataaaagttttatgtgggctcgagaagaaaaaagtactgttaaaatatgtaaatgcaattaaggatatatatgatggggctatcatgtgtgtgaaagcttgtactgaaatttaaagttattttcttatcacggtaggtgtacaccaaggttcgacttttagtccttatctctttttcttagtgatgaatgaactaacaaaatatattcaagagaaagtgtcgtggtgtatgctttttgcagatgatattgtgcttactgatgagatctaagatggtgttaatagaaaacttgaattgtggagaaacactttagagtctaaaggactcacgttaagctggaccaagactgagtatatgaaatgtgagttttcactggtaagagatgatgatcaagatccctgcatctacttggtcaagaggtatccaagaaagatgtttttagatacttgagatcaattttgcacaaaggtggagagattgatgaggatgtaaatcataaaattagagcatggtagatgaaatggcggagtgcatctgagttattgtgtaaaatttcctttatgctaaaaggaaaattctatagaacaactatatgactgacaatgttatatagaactgaatgttggccagcatataggcaacatgaacataaaataaggatagcagaaatgaggatattaaggtgaatgtgtggttatacgaagatggataagataagaaatgaagatattcgacgaaaggtaacagtagtattggtgagtgaaaagatgaatgaacatagattgagacacataatgagacgcccttggatgctcctgtaagaacagaagtttgttaccaagagctcgacgcaaagagaggtagaggtagattgtaacttatctagaaaaaggtagttaaacaagatttaatgaaatgtgatatagattggcgaacggtgtgtcttaggaaaaatggagaaaagttataagcttggtggagggttagatccgttgttatctctatgttctagattatccctttttagtcctttgttcttcatctcccctttccttcttttccccttctttacttttaccgtctttgttttttcaaccttctcgtatttattattgggttcatctaccatcgatcccaattaatttggattaaaggtgcttttgatgttgatgttgattagcagtttgttgctaatattaagttcatcaaatccaccatgtaggggttggcctctagagcatattcttgaatcatgtcaatgtttttaaaatcaaattggaggttgagctactgagacctggtgtagattaataagcctagagtactctgtgtagagtgatgagccggggtttaactcctttaaagtgaggtgtaaaatgagaaagttaatgtgtatccactcttgatttgaattatccatttcaaatcaagggtggacagactcttgctttctctctttagaggagtcatcagagtacttctaagtccttactagaatttcatatgttctagtgacaggaagtgtctatattacaatgatgcataaggtcaaaataacgttaagtcaactaaagggcacttataaccaaagataataaaaatcttagatgaattataatttctaagaaaataaactttaattaagtataaaatcttattaataaggttttgaaagtgtttgaattacagacatagttggttcatggtcagatcagttcaagtgatcaatcccgtctgtttattcaaacatttcatgacactgcattgtaatgggtgttcaaaaactaaatggggataatttcacacaagaggaagatcctagagtctcatctgttttgctttggatgctcctctacaaggagtatcctaatggagctcagtatagttatgactttggtcctgtttggtatactattgtattgactatgatgtattggattacttcttgttaattagaagatcaaaagcagtggctttgttgtttgttctttgccttcattttttttcaggaataaaatgatcaaggtttgttctattttgcattcattttgattcaactacaggaacatagaagggtattttccttggtatcattgaagtttcctggttgttcatctatgggttataactggacatgcatattttattttgtggagtttcttgtttctagtccttaataaaacatgtcagttgcacttttttgatctttttatttcaatgtgaggcgtagaatacagaacttccgttaaaagtgtcgtagcatatcttatttgtaatatgtgccaaaagccataaaagaaagaaaatagggatctgaatggccggcagtataagaatgaaattgtttctgttgggtttaaagaatctaatcattgggaatgtttaataaggcatcaaattgaattgctatacttttatttttgacttttatggatttgtcttttccctcttagtatggttatagttggctgaaatgtgctctcctagaatctagaatactttgtcggtagacaatgtgtattgatggactttgatcctgttgttattgttgcggcttcttccttggatatatatgattgccaaggagacaggagccttttttttcttttttgcatgttttactattgatattctttttttctctttggttgctcctgggtgaagagattttgaagccattttggtttattccttatttgattattattcttaaaatctcttctcaccatatgacttgcaggaaaagcagaaagaaaaaaaacataagaaagataagaaggacaaagagaagagggagagcaaggaaaagagagagaaagaaggaagagatggaaagcataaggaaaagaaggacaaaaaggaaaaacacagagagaaaaagaaagataaggataaagacaaggacaagagcaaagatagagataaaagtaaaagcagttctgctgatgacaaagggttcccaagacaagctgagggtctcaacggaggtaaaccccatcaaaaggaaattaagcaagatgataagaagggtatcttgtttgagaacagtctcaccaaccagtatgctggtaacaatggggagaaggcaagagagaaaaatcatctggctgaagagagcaaggattcaaagttcctcctggagttggaccggaggattagggatgatgatggaggagctgacaatcaatgggttcataaatttaccaatacaaaccatagaaaagatgaggggactgttaggttggtggctaaaggtccaggtggcacaaggtctgatggtaatgaaaaactcaaggatatgggtcttcatgttaagaagattgatgggcgaggaatacaggatgaggtccggccaattggaaatgcaccaccagttcagaatcatgttggaaattttcatcctggagttggtggaatacccaaacttttgggaaagtattttgaaaggaatatggaagcaactgttgaaggtaaagaaaaggttaaggaaaagaaagatgaaaaagaaaaggccaaggaaaagacagaagaaaggaaggttaaggaaaagaaagatgaaggaaagaaaaaggttaaagaaaaaaaagatgataaacgaagagataaaaggaaagatagagagaaggagaagaaagggcatgggaaggacaaagacagggacaaagagaagaaaaaggaggagaaagctaaggagcatagtgaacttaaaacaacagagcaaaataaattaaaagaaagcaacaaagttggacttataaattcaaattctttcacacagccttttaggaacagccatgggaacgctgtcagtggagaaaatctcaagaagcggaaggacattgagtcaaatggagttccacatggtgagtgttacttatgatgagtcttgttctcatttctactcaatgatcctgttaagttgtatttaaaaaagaataagatgtttctcttactggatttggactagtatattgctgacctaataagctaataccagatactacgtcctgtgagataacggtgggttttccctgatgtcacatgcttatattgatatttcaattattggtatttttcagtcatattgacaagttttctcaagtttgtacgcatttttttgctgttgaatagacaggttataattttttttttttaattttgttacagtcaatgacagtttgcccaaaaagtttccgaaatcgtcttcctctcatccactcactgaaaacggaagggtattggaaccttgccaagtttccattccaaatgcttcagataggccacgagaagccaccagtgttaaggtagtaaagaaagaaagcaagatgaatggcatcattgaaagtcagccatttgcagcttcttcaaacaagactcacactgccaatgtgccagctgatttggtaactgaagcaactgcaaagccaccacatccagataccaagtacctaggccaggtatattcagtacctaaggtggagcagtggtctgattttgacgatcaagcgtggctatttggcagcaatgtttcgcaagaaagaaaatctgtggtgaaatcttcagaggttggggagacacctcaggtatgggcagaagctctgcacatagagccagcagatgtttttgctcttccatatgtcattccgtactgattgattatttaattgtcacacgatgctcttcaaacaattatgatgtgtgcacaaggaaccctcctttgacactccgtgtgggaggaactgaagcatggaccggaaaatgtttccaaatttcttgatgcattcttttgttgcttgcacactggcagcaaataatgagtgactcattggttgccttgatcttaaactgtttggatggtgactcgtgctgcaactgattgtcttgattttttactgattggaaagggaacatctgtcacaagttgcatgcttggtactgccagattgggggtgcagctctcaccttgtgcatcatagtaattcatttagacaacagagaatttgtacaggttgtggagagggggaggggagaggtacaagattttgcaacttgtttttctttttttgctgagagctgagctgctctttttaattgagaatgagaatttgcaagtgaatgtggtctttgcaactccaccacaattttgatttgtaacatagaactctgattttacgagaatatgtatgatagagaaggggaaaaagaagtaatcggattcatttattcagtttcctgtaaattttattggtcattgaatcattttgctttagtgttaatgattattgaatggaattatatcgtaggggataatataacaagatggttttaaattgagtaggaggggtatggatggtttgaatctttttaatagatggtggggttcactcgtgtaaatcaaagatgtgaaaggtgactttcgttttgtaaatttgctttgaatatttttctttttaaaccacttgcaaaatatcgtctcaaatgactttaacagcttttcttattaaccatatttcattaaggagaagacaagtcaatgctatcccagtgtcgtccaagggatattgcaactaagtggtaccgtttatggtctttctgggttgttgcattagatttccaacattttttttacggtggggccgtgggggtggaggttcataactgtgggtcagttacaaagtccatctatgcattaaattatcgaacatgtcatagttaaggaggaatctaaccttgtgattgcatgccaattttgatgctaggattcagcatcaaaaagaagttataagttattgactaccgagtctttttcaatgttcagctaagtttctatcacaccagagaaatcaaaataacaccaccacctgagcccaaaatatctatgcaaaacgttgagaacaattgactaatcctaaaatatacttaacggatgtttcattttatttatatttattttttgtatgtaacactttagctgaaagcaatatcgccttgctttgtgagacacaaacctggtagagagggtatggttccatatcctaagttaattatgctacattatttatttatttattttttaaaaatctaagctttcaacaaaattaaaatagtggagcctacaacaattatacagagggacctgctacgtacgtacacactcagaattttgaacctaaatattatataagtgtagataacatagtaaaccccaatttgatttgaatcaatttttatgcaaaaagttgctgataatgtttttttatctaattaaattataaaagtgaattacggtttaatttgaataaatgatttggtttttatatttttatttctaaaacattcagttaatatttaataagtttacaagtacattgtaatcattataacattgataccgtaataagacattcaagtcagcaaaaaataaaacgataatggagataatgaaattataaagaaaataaataaattgataatggaattttataaaattttatttatacaactaaggtcctagttagttttataaatgaaactctttatgtttggttgtgggaattttttttgtcttaaccttttgattcattataaaaatgaactttaattaatttaaaatttggtaggaagataactaaaatctaatcaaaatttatttttgtcaatgattaaacttacatattacccaaataattcaatcttaatttcagtacattaatcatttaagtccaatcatttggttgattgtgtggtttaacattgcttttaaaaaaaactctatggtattatagtaacttatcattagtaagtcccatgtttaggtaagagagaaaggtggtgtactggtgttacaccttcaagtcttccacaaacaaggtaaagtttattgatatatcaaactatgtataagtacggtttgatttggttttaattgtttttcaaaattggattcaaaattcagcctaactaatgaaaactttacttttttagtcaacttgtttaattttttgtaatctgttatgatttaggattttcttcatctcaaaaaancctgttatctaggatagtgaaattgttgtttaagatctgtttccgtatttttagttgtagatgtttcttatcttccgtttatttcttttttatattctgacattatctctgcacaaatttcgcagttccctccaattgttaaacattaatttttgtatcagtatcaaccaccaattgtgttttttaatccttccaataaaggaccggttttcaaaactatggtatcagcctctaaatgtgtttttttttttcttccaacaacagatcggtcttcaaaactatggtatcagcctccaattatatatttttttttctcccaacaattgttaaacatacctctttcccattttctgttagtaattttacataaatatcatttcccccttttcttactcttttaacccattcaaatattctacacttctgcttctttctttcagttctttacctttcatattctttgacaatgcctttgtttttctttcctcttctctgacgacttttgcaataaaaaattacaaatgtattccttttataatgttttgtatatgtgtctaatcccaaaataataaggacaaattcatagttgaaacaacagtatcgaacaaaaaaaaatatggccttaccacaaacaccaaaggataatctctggcagccactttaataatttaatttctaaacttagtagaaacgaacatgattcaaacagaacatgaaatatctttctatataatataacctttcatattaagaatatgagctttcaatgtgttcttttacagctaaggggtagtttgtgctaaccgaataaatagcattgttggaagaggatgactcaagcgatcgaaggcatagagaaagaaaataaagtaatagccagaaaatggactaggaatgaagaggtagtatttgtaaggagaagccaaaggaagaaagaaggtgagatatatttgaaaagagggagaaaagtagaaaaaaaatgtatataagcaaagttattaaaaaaaaaaaaggaggagggatacatttagcaacaataagatggatacatttaacaattactttacttttccaatggctatctgagttttttctttctttcttcatcatcatgggaatcctcatttcttgacctgatgctttctagagataaaacattgaacaacatgtttatgactaaaacttcctatactcattattgtttccagctgtgtcccattgcattttgtaaagctcaatctgaaatgaaccaacatcccatgtttatcatattagttttgggctttggcccagtatagctatgttcagcttccgtcgttgttttcgttgattaaggagggccaagcctagaactaaaaacccgaggaaagattacaaagctaatgaactgaataaaaaaaaatcattcttttgtcaaccgagaatctttatgacgaaaaagacatgaacattaatttttttttctcagccgacatgaactttatgataaattatctagtcattatatcttacccaaaaaaagttttagtatttatatgaaaatgtttttttcgtaaatatttttttagtaatttgtcaccgtcagaaagtttttataacaattttatatcactttaaaattaaagtattctccaatgttaacgacaggaaacatagaagcaaaactaaaattttatgcatttgtaggaactaaaaaatcacaatttttttttatgagaacaaacttaaaatgataacagttcagtgatcaagtgaatagtttacgcttatggccaaaactatgatagaaggagaaaatttaattaggaggctaaaaagaaagttatttcatggataaaatttaaaacaattatacatagtaatattttaaaaaaataattaaggacatggtttggtcccttacaagtaacaatgaatgacgtcccattccatggttagaagatagtacatgggcacctccaatgctagaagcttatatggatttcttattgagttttggtgaaactctcttgaaatactgcattggagatggtcttatatatctatcatggttatgttgtcagatacaacatgccacttggctagaaagtctgatgcagaacacaaaagtggtgatgaagtcttcagtgttcattattcagtctgaaatgatggtatatataaaatccgataaaagaaaagtttatttaaatttagtttttatacactatttatatttactagttaattaaaaattactttcaaattaatttttaaaatgactattacaaagttaactatcttacaatacataagatttcattgttaaataatggtataaaatatttgttttatttatatgtatgctaatatgtattaatctttcacagtgcatataaattttttgactagttagtgtttggtagtattttttaacacagtttttaaacacattattttaattttttaaaatttattgaaaattataaaatttgttaacaaatcttaataaaaattatttttattcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttcaaattaatttttaaaatgactattacaaagttaactatcttacaatacataagatttaattgttaaataatggtataaaatatttgttttatttatatgtatgcttatataacctttcacagtgtatataaattttttgactagttagtgtttggtagtattttttaacacacgtttttaaacacattatttttaatttattagaacttattgaaaattataaaatttgttaacaaatcttaataaaaattatttttattcttaaagcaataaaattttctttcttatacattagaatttaaaaatgctcatccatatcatatgtaattttttttttttttgaatgtatatagttttaattacggactcaaactttcagcaaattaagttggtcactaagatataaaataatagatacataattgataatgtatttaatagagagtatattggatcttgccttgcatattatttattcatatcttttattaacggaatttagtttagttaatttaataaagtgcgtaaattattataaactttttagaatttgattttaatttcaacggaaaaaaatcataaaaaattatgagggatgaaaccttttgtctgtttttttgtttaaaaaaaagaccaagaataaaatcagtaaaacacaatctaaaggatagtttacacagtagaatcttgaatataaatagtactaatgtagttgtcatgtgaagtagaaccaatgctataaattctgctagtaatcttgaatatatatagttagacaagtgacagcgcagctgcatgcatgcaccaccaaagcacatgttcaaagttaaaacaaccttcccgtctcgccctattaattataccctcagacctaatagtctaagagcatctttagtggtagatttcaaattggaatcttagatcactttttggtagatcccatagtgtcatgtaggattgaagatctctcaagatccctcctattttattttttaatggtagatcttattttgagttcttagggagagagaaagaggaaaaaaatttatttttttttgaacaatgtgcagatcttaagggttcttctacaagaactcattctccatgttggagatttctctacctcctttattgggagatctagtaaagaccagatcttgagctcaagatccttactcaagatcttgcactaaagttgctctaatacgcttcttgtgtaacttttttttatcaatgaatatataaataataaaaatctcttattttttatattaaatataaacaaatttcaattcttatgttttatttaatgagactcttttaatatttgtagtggttagtggttacctatgcaatcacacgttaaattgtttgagtgatttttgtcctgtaacttattaatgaaaaaataatgaacattatgattattggacagggtcaaacgactcaaatcaaacaaaatacaaaatactgaaattttaagaaaaaataaataaactaatgtctctctctctatgaatgactcgaattgataagaaggagaagaaaaaaaaagtataaatgaattgacatcataattattgaaggatcaaatcaagagaatttttatggtgcctcaagaattgtgagggttttggtattgttatttttttaaccaacgaaattatcatgtcatacatcttctcattaattaaagatttttttgtttttttcaaattagtttttaaaatcaaaattaaaactattttaaattttaaaaatttgattaaacataagtttaaaatatgaatcctaatctctttcaccaatattaatacagaatcacaattttatttttcttgaggtaatagttactctaatttatatttaatcaaatttttaattaaaataattgtaattttatattttaaataatcaagaactaatttgaaaaaaataaaaaattatttaattaataagacgacaaataacataataattttatcggttaaaaaaacaaacagtgtcaaaactctcataattttttgggaaccgtagaaactctctcaaattaaacaaaagccgaaatattgaaactaaaaaagattgaagccatgtgtctctcactatgaatgacgcaccatgcatgcatgaaaaggagaaggaaaaaaaaagtagaaaatgatttgtgtgagttttacaatttaaagaaaaatcaaataggtaaaaattaaagacatataatttttattgaagaaagtaagggggtgaaaaagactatggaaaattattttactttgataaataatttttttaatctattatataagaatagttgcagtatattataagtatttaatttaataataaatatcaatttttcattggagaaagcaaatgaaccaacatggtgagttgggaccattcagatttgagggtcgatctccatatatgacaacagaattgggataagtgtgtgatttcagataaatttcttctgacagtagaatacacggcttgtttagattacaccaaaaaagtgatatatatcaccattctagttaattatagattacagagaaactcctagctagaaagcttctgtcttattgaacatgcactatattataaaatataaatagaagagagtatcaggggtaccccacccatattacaccactgtgtgtattttgcctgctgttgagctgttccactactcccctatttataatgtctcctttgctgctatttatagtttatttaccccaacacgtggatcatttatttatagccttctagtgggtcatttatgtatcactcttaagtcttaactacatttttatgctaaagagtaagaaactctccttactctttttttattatagaaattctccttaattactttcaatagtacaaagttaagaatcccttatttatttagtataaggtatgttcggataactttttccaaaaaatacttttagaagaaaaataaaataaaataagttttcataaattaaaaatcacgttttagaaaaactcatgttttttttacaaattagttcgtgcataagttaattttagtttatgtaaaatatattacttttatttttttaaagtgtttttagagaagtaaatgaatatatccaaaattctaaatagacgtattttcttcttcgtttatatcccagaagttggttttggaaggctatttggttatttcctaatcatgtggtttggtgtatgaatgatgaagctgcaaacgtgtagccattagttaatagaagagttagctaagctatcataattaattatgacttagacatttatatataataactagctaagacacatatctaaccctgccggtactcttcctgtataatattctttgtttgctgataaataaaaaaataaaaaatctgaccctcctctagcggcttggaaaacgtttgtggggattctataacaaggttagcaaaacctggtttgctgagttaggttcatgtcattctccctgttagttgtagaagaatatttgtattatagaaaatgacttaaatgaatttttaatctttgaaaatatgtcattattttaaaatcttactgaattttttaatcttttttaggttttatatttaacaaaaaaagcgcattttcaccttgcaacatttgacacggaaaactttttttttatctcatgatcttggtttcatataatattaatattaaagaatatattaacttaattataggcctggaaactgacttagggaataatccgataactttactgggacactagctgaaattgaatatcattttcataagaagaagacggttctaaaatattactaataaaaaaagtaattgaagaaattaaatctgttctatattttccttttaagaatttaaataaacactaaaagggaaataaaaactaaaattaaaatattaggatctaatttcacttgattttgaattcggattcataaattaaacaactttttccttgcccttatccttgtttttcatatcccaatttcttattgatggtgaaattcccaaaattagttacaaccaaaatttatttggggaaaatttacctgaactttattaattaacaagcttatttctttaagtcaaattaacaaaatgagattgattatgaagttctatgaaatttaagcaaaggctaaataacaaagttatttatttctatacataacttcattcgtggcagcaaatgcaactatgcaagaagcgcgtagttatatatctcattattcttaacataaatgagtcaaaacatttaataaatggtgataaacattcataagtataaagcaattgatgctcaaatcagggaaatgcatgtttatagaaaaaactttaatcaaggttaaaacatttttaacatgaaaaacttgagttcaggagctttcatcataatattaattggcgaattgaagatctgattacaaagaagtggggatgatctatatgtcttttcttaaaaccaaaagcttttgctcctttgatgaattagtaacaacgaattcgtagaatggggaatcaagaaaaggatagggagggtaatgacctttccataatgggtagacccacccttgaattgaaccggtcagaagctctcaattgggagtttaactaggttcaggggaaagatgattgaggggaccaagagacttctctattctatggtggaaggtttattttgtatactgacaaattggattgagaggcgatgcttacttattcctactaaatgttgaagctaagaggataaagctaagagaattaactcatgggataaagtatgcccactacttatattgaagagaaattctgaatgtcatgtcaccgagagtaattaatccacgcccatgcttaatttcactgctatattctggcattatttttgtaagctaatttgtttgattaaaaagtgctggggaatgaagcaaaaagaatgctcagccaagcaccctatgagtgtacaaaattcattattgtgtgcattgaatcatgcttatcttacctaaacaacctaataaatatattgaaaatctaactataatgataaaacatactaataaaaactaaaaaataagaattaaaaaaaaaaacaccacaagcacaatataattaaataacaaaagtttagataaaactaattacaaaacttgaaaaagcatctttaaacctatttattacacgtaagatgaccaaaccttttaacttttttttggataagccaaattaaaatcaaagtcattgtaactgagcattcaaaacttttaacttgacagagacttcgatctatggacaaaaactaataagcatgtcctgcacaaagttattagttttaccttgagctcaatggacaaaatgaattgtctaggtgtcagctataaaccaataaaactacatcgaatttaagactttgatggcatattaacttagcaacccggatttagttatcaacatcaacatgaaatgtatgtaggactattatcttcacttcaactactttctctgacattatatattcatttctatcaataggcagttgacacctgtttaaattcgatgaaggttgatgaacatgaaagtgatcgatgcatgtgagatgagttggatacttgcatgttgcatcagtaacacgaacggcaaaaaggttggggaatggggacaatggaaataccttttcggctgatttagagccttgatattttattttgatccgaagatatttatttgcaagaatgggggagttgaaattcttgaattagcaaggttagatcccgaaattttgataaaatggagtattgacagcttgtaaatgcaaatatatatatatatatatatatatttttgttgacaaatactaacatggcttgttcaaaaataaaacaactaattaaatctcgagttttaggcttccagacagaaattttgtaattattattaacattttaaaagtaaaaaatatctaatatgttggttaaaaggtttcaaaattgaaaaaaaatatttgaattgttataaatctctcaaaacttcttccattcctatatataaacaaaaaaaagttccagatatcattttttaaaggaaaaaagatcgttctcaatttttatttttggtctcactttttattagatcaatcatatattagttgatagtttgctaatttttattcattaataaactcaaatccattacctccattctttattctttattcaattactaaatcaatcttataactcaatagatacaatatctataagaagtggtactttcatttttcattatatgcattatatcgtgtttattaattagttgcatcttttactttcctatatgtaaattttcacgtgtactttatttattccaattaattatcatatgttcattatagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatacatgaaaagaaaaagagtaaaattaaaaaatattgacaaaagaaaataaattaataaatagaaggttgagtaaatgtatgctttttttttggtacaatgcttaatttcttttagtagtagatcgattttggttttaattttacacataaaactgataataaatattttttaaatatatttattaaataattatcaatgagaaattagatacttaaataaaagtataaaagttgaaccttcttttaatgtctttctggattcgttccggtgatatatggtacaaactacaaaggttggatatatcactttattttcacaaattaagcgtgtgcttgcaattaaattatacttatcgagtattaattacataaatttaaactcaaattaaattgaaatgatttgtaaaaagtgagggaaggcgcaggaaaggtcagtgttggtccaacatagattactagcttgcatgtttcattaataacataaagtttatagtttagcttaattataatttttattactaattttttagtttttaatttttttaattcgacacattttatcatcaatttataaaaaagttcaaaatttattcccaatcattaaattcgccaataannnnnnnnnnnnnnnnnnnnnnnnnnnnnnnnnnnnnnnnnnnnnnnnnnnnnnnnnnnnnnnnnnnnnnnnnnnnnnnnnnnnnnnttgttccaacaacctagatcattcccctaaaaaaacaacttagatatactttctttaaaaacaaaaaaactattttacaattgtttcattttttatacattaaattttaaaagttttattttgattttttatattttcaaaatgtatgattttgatactttttgtcaatttttctttagaaatattagagttatcttaacttttaaattttaaaataatttaatgttattttttatttattatatttcacatttgtttctcttttgtatattatgttttaaaaattttattataatattttatatttttaaaatgtatcattttttattcttttttcaattttttattagaaacttaatgtctatgagtattttaaattttagaatagttaaattaatataataacgactaaaaatcattattatttttttatttaaaaaattaaaaatcattaaataaattagaaaaatatagatatgaaactacggacaacaactatcacttttatattattattattattttattcatttaatttaatcatttaataacaataataatttcatttatcaattattttcaaaaatataacatttaatttgattattttaaaattttaaaaattaatagaacactaacatttctattaacattgaaaaaagaatcaaaacgatacgtttaaaaatataaaagatcaaaataaaacttttaaaatttaatatattaaaataaaataattataaaatataatgaatcaaaataaagaatacgcgtaattaatagtacctataaatgagtggagtggattgagataataaataacttgcattgtgattttttagatgaaacgtaagatcgaatgtcaaaaattagtaaatgattaaaaaaaaattatatgtattaatggaattcgttggccctccacatcgaagtacatcttgtgagcaaaataatggacattaattaattgtagttggcctcgccatgctttgggttgggcatgcatggtattgtgcattccgaaagcatgctcccccattctgaaagcatgttccccgttattcagccatactaattttgacactcaaacatgaaaactcactttaatcaagattgaggttggagttgagtttttttcttcaatttcttaaagtggatacaaccctctactcttccctccatatatttaaaatataataattatttaatagttaaataataaaataacaataataatttaataaaaaggtaaatttatatatttatttaaaatgtaatttaattgttaattttttttaaaaaaatagttattatttattgattatatatattatttgagttaaaatgtaattagtattttttatatatatattttttttaaaaaatatgtaagataggctatcattagatttcttgaatctgatgagaatgaaaactattcatgcgacaacacttgtttagtgtaagaaataagaacaataaatatggaccatatcatatgaatggtcaagattataagtagttgtccgattcccaagtaacaaagtcacgtacattttctttaaaccttgataatataaatatgatttagtagtctatatatacattactcgaatttaaagtgcgagtacacacctatcttacaggacaattcaatatgatatatgggcctaaaacagttttaaaaaaaaaacattattttaaataaaagttatatatcaggtttaaaatatacgaactgtatttgctttagttttcgatcaagtctgatgtcttatataaatgattaagcttaaataacataaattatgcacaattttaaaaaagttacataactcttttgagtaataatgagattttaaattttatccattcaaatatgattatatgaattagatgatttattttttcattcttacatggaaactcataatcacaatgtacatttgaaacattggtagtgtgataatttaaaaaaaaaatcattaggagtaaccaactaactggnaccaagctaataatataatttgggtagtaaataaaataatttaaaatttataatattgatttttaaaaaatcacagtttgagtgtttatatacttattccttctgaatttttgtaaatacttcctactaacatccaaaccgtacatagtctgagtcaagaagttgttgatatgagttatatattgattatcagaaaaatcgataaatattttatattaataatatggtatatatatatatatatatatatatatatataagttttagccggttcaaacgttattgaaagttgaaacacctaattcatagaaattattgaagttattttcttatttaggattataaatatcctttacgacagactataaatacgcagctgcaaagcgtaacaaaccaatgtggatgacatcgatctattttcctctataaatcggtgagatgtcaccactcaccagactataatattaattgccatgtgaatgtggggaacaatgtaaaattgatcgcattattagtaaatgagtccgggtataaaagggaaagcaagaatcgtaaaagaaattatatgagaatgtatttaacaatcaaagaaaacatgattttacgtattttattaaaaagcttccttcttttattttttttaatcagtgttcttaatgtttgtctaaaaaataatttattcattttttttatctatcttttaaggtttctatataaacacaaaatgtaataattttttttattcaaatgacattcgtgtggacttttctattatatcctcttcatttccattctataaataaatgcataagtgtaaaataattaaaaattaagtgaaaaataagagtataattgataaaataataattaacattatcttttttaaaaaaaataacagttagatagtaaccaatttttgtaaaagaactcaacaattaaaaagaaatagaagaatatccttaaaaaaatagaggaagtatacggaaaatgataacgaaaagtggaaagtttttaatcagaaatggaatattactacttctgaatcataataaatgttctgtaagagaaaaaaatcaaaataaatattgtggaagaatatattctttcaggatttctagtacaaatttaatatatatcttatttattaatttctttagcaagtatctttaagatatttactactctctctgtcctaaaataataatcattctagcttannnnnnnnnnaaataaataagagaataataattttataaaattaaatttatattatcaatataatttatttataaattttgttattcattaatattacaaaaaatataagtaaaaaaggtaattaatattacataaaaaaattaatatgacattattttgaatttttttcttacacaacaataataatgggatggagaaagtaataatattttacttcattcgtctttataatataagacacttataactaatttaaatatatatttaaaaagttagttaatttaagtgctaacattaaatttgtttgtaaatgtaattttatctaaaattactcttaaaaatatttggactaattatgttacttttttcagttaattactttttatctaaataattaatatatggagagaataataacagtgagtttcagtttttaaacctaatttcttcaactcttcaatcctcgcaagaaaaagaaaaaaagatgatttatagcatttattatttatggactaaaatagttaacagtattttaataaaaataattaatatgaagaaaatttaaaaaaaaaatagttttgtaaatgatcaataatgtttcaaaaaataatatttatatttggcatttccaaccgcttatttcgtacgacccaatgggaatgaaacgcatagtaagtttccattaaatctccaaccagccactccatggtccttcacttatgacaccactccatcactctatatatgctcgtaggcaaaaactcactttagtacaacaatcaaagcctcttttccagttttcccttgtgatctctctctctctctcttttgttaagcaaaaaaaaatcccaccaaccaaagagtttgctttcaatttctaggatcaagccaaaatggtcttagaagagtgtgtagtgcatgatgttaggctatcctcagttgggccaggccgggccaccgggtcagatgtgttccataaccctagtgggttggatttggctatgaagcttcactaccttagagtggtgtacttctttgataatgaagctgcacaagacctaaccatcatgaaaattaaagatggcatgttcactttgttcaaccattacttcatcacatgtggccggtttcggcgatcggattcaggtaggcccttaatcaagtgcaatgattgtggagcaagattcattgaggccaagtgcaacaaaaccctagatgagtggctagccatgaaggattggcccttgtacaagttgctcgtctctcaccaagtcattggcccagaattatctttttctcctcctgttttgttgcaggtgcttaataatttccctatagatactatactaatttatatattatgcatcactcgtgacacacacttattagttattattcattttttatgtatgacaaaacctagtactactttcataggaattttttagtgtttttttaatcatgaaatggaatatttcatttctataattttcacactcgaaatcaaaatacaaccaattcaaactaatggagataaaaggttttttaattgttaatatttaactgatgaataaagttaaaggaaaatagacaccgaaaggccacaatgaaattagaggaagattttcttattaatctttatatttcttttgaatgttgagtattggttattccacatccgatgtgttgcaattaacaaaaaaattatttcaaaataagtattgtatttgactttttaatgtaacattaattctctttttcatcaagagaaatgttagtgacgttatttttaatactctctttttcaacactttttagttattggttgaaacnnnnnnnnnnnnnnnnnnnnnnnnnnnnnnnnnnnnnnnnaagttttgatggatctcacttatcatttaatgactctcttttataatttagatataaaatttatcaaaattgataattttaaaaaataattaatcacaaagagagtgttagaaagagaatgactttccaccaataactctaataaatatcactttaattttttgaaagactattattttccttcatttatttattatttttgtaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcctttaatggtagatctcaatttgagatcttagggagagaaaaagagagagaaaatttattcttttttaaacaatacacagattttgaaaatttttgtataagaacttattctccatgttggagatctcttcatttcttttattgggagatctagtgaagatcaaatcttgaattcaagatctttgctcaagatataacattaaagatgctctaagaatgtgtttatttcaggaaatgatgttttatcacattttcatattaatgtgtttgtctaatattactaaaaatattactaaaattttaaattaaaataaaaaataagagttgaaatggaagttataattgggcaagaacatgtatagcttcctacaaccccatagaaatataactatttcacctcttatcacatgaatagaaatgaattaaatgnnnnnnnnnnnnnnnnnnnnnnnnnnnnnnnnnnnnnnnnnnnnnnnnnnnnnnnnnnnnnnnnnnnnnnnnnnnataaaattataaaaaaaggaaaaaacattcattatttgtacaaatacattttttatattgattgaaaaatatattaaaaataagtatgttaaaaggaaaagaaataggagaaaaatgaagttgtagacttatagtgtccaactacatgatagaaaaataaaatagtagaaacaaaaatataaaattataattaaaccgactttaaaatcgtttaaaattaatcacaattttaaagtggtgaaaaatttattatataaatatttttaaaaaataaagtcgttgaattttttatgatttcattattaaaaaaaaatcaaaatcataatttttttaagactttatactcaaaaatcgtaaaaattcttattacttactttttatttaagaattaattaaagaatactttcatttgattcataatgaagttattttctcttggtgaaaaccccctctttatcgtgtcctggtttggttgaaatagtgacctgttaattagtcgcaatgtttttctggtagagatgttaataccatcctatcttcataagttgcccttacattaattcagaacgcagtatagtatggtatggtggacaattcctttcataagagggataaggtagatcctaactattcaacnnnnnnnnnnnnnnnnnnnnnnnnnnnnnnnnnnnnnnnnnnnnnnnnattacttgttttttatatataaataattccgaggtaatattttgatttttagtaatgtttaatcttcttataaattttttaacatttaataaataaatattatatgaaaaaataaatacaattaatgtcttataaataaaagcatttaatatttaatactacctactacatagagtaacaaagtggatattgtaggagtatttaaacctatctttaaatcttatcatacacatatttttggtatacaatgaagttttaatttactnnnnnnnnnnnnnnnnnnnnnnnnnnnnnnnnnnctctttctatatagatacgccgatattgatcagaatcgagtttatcaggctcatatttttggtatacaatgaagtttatcattaacacgttttttttaaggaatcattaacacgtttaaattcgataaagactgttttcctggggacatttaatataattttacatattatatacaacaaattgtcgaattaaacacaagtcatcaaaaataataatacggtaaaattattattgtttttattttttaatgcttaatacacgaacaagggaatgaaaagttcagaaagatgttttcctaatttgcataataaaaaaatgttttttaaaaaattaattaagagagatgtcgtcttaggtgagaggagtaatttttaatcattaaatataatcgaaaattatttaaaagacaattacattaatatcattgatgtcttatctccatttttaaaatgttccatccttactacaataatagtaaaagaagcaaaattttacataagaaaattagaagcaaaaatttgaaaatctcatttagataaaagagtataaatacgtttaatgtttctttttacttggtaaagacgaaatataaaaaaaaaaatctgaaaatttatttctagatggttattccttctatcactgtaaatcatacaacttggcttttgcaggtaactcaattttcgtttgatcaatatgcaggtaactaaatttaagtgcggtggaatttcattgggtcttagttgggcccatgtattgggggacccgctttcggcttcaggattcattaactcatggggcctaataatgaaaaatggcctaacaaagctttttaacatcccaagatccgtcccaacactcagacaacccgagccggaaaaggatccagtttcagcaaaacggtttgacccggtgggggatcattggatcccagccaacaacaaaaaaatggacacattctccttccacctaactagctcccggttgaactacttgcaagcacgaatttggggtccaagtcttgaccaaactcctccttttgaatccctatgtgccatgatttggcattgcgtggctcgggttcgatcaggatctgaacttaaaaccgtgaccgtgtgtagaaccgacccgtataagagggcaaatgatatcataggtaacaaccaagtgatatgcaaggttgaggctggaagtgaatgctcaattgttgacactgatttgacaatcttagctagcatgcttgcagatcaaggtgtggatgagaggaagcaaattgaggaagcagttgagagagaccaaggtgtgagtgatttctttgtgtatggtgtcaatttgacatttctagacttggaagaaaccaatgtgtatgacctacaattgaagggacaaacaccaaagtttgtttactacacccttcaaggggttggagatgaaggggttgttttggtgtatccgtggccaaaaggttctatcaagaatggagttgatgggaagtttgtgaccatgattatgccggaggatgaaatggtgaagcttaaatttgagctcaagataatcgatcttctgcttgaggataattaagttttaatgagattaagtatttttcaacaaattaattttttttatttgttatgtttgtgagcatggaaaacttttagattgtagtacataatttattactttaaagtcatgtgtatctcacgttaaactttaaagtcatatttgtctcacgttaaacatagatatgatgtggtgtgtttcttcttcctgcttttttattaaataaattatttccttttaaaaaaaagaacttaattgctttgctttacacaaagaattaatatttcacaaacacacattttaatataaaaaactaaactaaaattcagacatattttattttacagcaaaattaagagacacgtcatagttttaaaaatatctctattaaaataaattctaactttaaactaaatagagcttattaataatacagtttggttctctttttttgaatgtcaagcatgtcatttaatttgcttgaaaggactgttttaattttggtgatgctatttgatttgtatcgcgggtgaggtctctcctcatagggacaccaccgtcgatggaaatcggtacacgggataaggtctttggggttcttacttattatgctaggaatgcctcgtagggatttgttggggtattcggttttccatgtaacttcctacggttgtttttttggttgatgcagattcaatttcacagcttgtgatttggatgtctgcacctcttgtttattcacccctttatataatatacttccttttggccttaaatttctgtcaaaaaaagtaaattttaaacaattataacaaaaaaaaaaaaaagaacatgtatttgttcaccctcaatagtcaattcttcaagaaaaaaacataaaattaatataatgaaaagacaattcattaaaatggttgttaggagttcgagataaaataatatgccaagttctagattgcaattaaaaagcacaaatctgcatataaaaaattataaagcacaaatcaagggtcaatggtgcaattaaatgttttcagcctaaggctatctttgaagtttcctttcattttccatatattatatgtttatttataggcattgaagattgagtttaagtcaaatttcaaatcttaaattgacttggaaggatgtaatttgaaggtataaatcagctagagtttaatttctttatttggatttcattttaatactaattgacttaaatattatggtggctagctgctatgaatttatccttatgatcgagacaatgataaacaaagacaacctcaattacttcagccacacaatcatacttgtgtcacctaatgatgagttaagacggtgagttcttaaaatgttaactatttgattaattaaaataaatataatattgaaactttgttaaattaaaagaattaaatgtaattttgttccacctatttttgttcattcagtaactttgatttctctattttaaaattgagacatttgatcttcttatttaaaaaatttgtaattttaattttctcatttcaaaatagaaacatttagtccttctattttaaaaaaaaatcacaatttaatttttctattttaaaaaatttgtaactgtggtcaaattctcacttttgtctaattttatttcttttattttgatttaattgaatcataaatctaaaatattcatttaaggtatcattaataaataatttaattaattacagaaataaaaaaaatgaaacattgacaaaattaaagatttaactaaaattataaatttctaaaatataaaatacagaaataaaattacatattttttaaaatatgaagatcaaatgtttgtatttttgaaattggagaacaaaattatgaattttttaaaataaaagaaataaatatctcaattttaaaatagaaaaatcaaaattacatattaaataaaatagatgatgaaaaattacatttaatccaaattaaaattatttacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggtagatctcaatttgagatcttagagagagagaaagagagagaaaatttattcttttttaaataatgtgcagattttgagagatcttgtacaagaactcattctccatgttagagatctttccattttttttattgggagatctagtgaagatcaaatcttgaactcaagatctttactcaagatctagcactaaagatgctctaagaatgtgtttatttcacgaaatgatgttgtatcacattttcataaatattaatgtgtttgtctatttttaatattactaaaatttaaaattaaaataaaaataagagttgaaatggaagttataattgggtaagaacatatatagcttcctacaaccccatagaaatataactatttcacctcttatcacatgaataaaaatgaattaaatgatggtataactattattttaatgtggataaacaatactcaagaatatttttcaaaattcttaacaaacatgaaaaattcacatttctggctgtgaaacaaatagcccgtaatcatttaagtatattcttgagatatttaaaagtgtgtttgactaaattttaatattttcaaaattaaaataattaaaataaaaaaacaagaattaaaatgtaagttataattggattagaacataatttcctacaatttcatggaaatatatctttgtcactcttcatgaaaataaaagttaattaaatcattataactattttcctttaaggaataatattttttttccaaattcataacatacataagaatattatattctcataaattcattttaatccgtgaaacaaacacgccacaagtcactttatcaccacacgtcgttctaatacacttgataaagataaataagcacacctagccaggttatcatatagtttttattgatggccaagttaggatgttgggtgataaggactggggattaagcaaagatcatttgctcttttgacagttaggccaaaagacttggtcatgtctaattcttggtgtattgctccatttggcagctcccaaacaaaatggtaaagcaaattagccagtgacagcaacatgtaaggcatggaaaatgcagctccaggacaaattctccttccagccccaaaggggatgtattcaaagtttgtgccactgaaatcataataagagttatctacaaacctctctgcttcattccaatactttgattctctcccaatggcccgagcattgataatgactttgctctttgcagggatttcatatccattgatcacacatgtctcactgttttctcttgagactaataatgcctcacagggggtgtagcctcattgtttcttttatgactgaatttaagtattgacaatgtctaaggcctgtttcatccatataacctttcacattgaagacctttcttacctcagtctctgccttttccataaccttaggatttttcatgagttctgacattgcccatactgtaactgccgttggtgcagctgtcccgccaacaaacatgtcctgaaattaattaaccatcaatctaatttagaacattattaatagagtaaattagattaatatctatgacattttgtatacttgtcaaactcctttctaatgtttacaacaatttttcttatggaaaacatgatcacaattaaggagttagtgtaatatataaaaattatcaaggtaatatttttcaaacaatcgaaagagttattgatgaaataaagaaaaaaaataggagagatttcaccaggaatagtataatttactcttgataataaagctaaatatgtggtgtagcacaatccaaagctggtacatctttccgaaaaaattaattacaactagtattaacatttcaaataaaaaagggtcaaataatattttaatttattaatttttaaatttttataggatgagcaagaagctgccgtgtgagaaaaataagaatacagaggacaaaagttggcgtgagagatgtgggaacattgtcatgaacaaacgtgcggtgagagacgtagaatgtaacgaaaaatattttgacaatattttaactttgtataaatattttaaaaaataatatcataatttagtaacatttggttttataaatgttacaaaatggtcttattcataacattaagtagttaaatgttgctaaaaacatatgtagtagtggcttatacgacatcgcatcgcaattcccaaaaaataaaaacaacgtagacctcactcacgtctttgggaaagaagcaaagcaaaatgggcatggggtatgggcacccaggcagttgaagacttctccaagaaggcaataatttagggacccctttcgaaattggccaaggaataaaaatgtagccaattagcaacagggggagtgatgaggtggacccaagggattaaggtatagccgtatagtttgttctgtttttcctgctattaattggtaagctcatttagatatttaaggatgacccaagggattggtatagtttgttctgtttttcattaaaatagaaccaaataaatgaaatgaaaaatattatttaattatttcataataggataaaataaaaatcctattccaatccatatggaacagaaaaaagaagaataaaagaaaatgaaatataatctatttaataaagaaagaaaggaaaagagagagttgttatccacttattttatagataaagtattttaactggtaaaattttaattttcttgatcataaagtatatataaaagagagattattttcagattcaaccttatcaccaacaaataatcaaaatacaattttattattttatcagaacttatcatctaataaacgaagtatatcttctcaagaaaacaagtatagtacaatcacttattttgcatagaaagaatattttaataacttgctacttcaattatatatatatatatatatatatatatatatatattataagtgtaatttattatgttagtaaatttcatatctatgtatatagttgtatatatggaaatcttcaaaagtaatcctaaagaataatgcataccgacccacatgagtgctttgctgttgttgtgggtcaagggaatttccaagtcatctctcttttgagttttgagaagaatatcaataaaatcctcgtgcgtcactccatgcttgttcctattttccttgtgatccttgaccatattttctaggatcttgtcattctctctgtgctctttcaagtttagttttcattcctgtgagccaaggaagcactttgattgaagggcagatatcagcaattgagaaacctcccaacagcagtagcatttgctccatcgttgacacgaaagcttcttggtctttgcattttgtaccattagctgcccttgcaattatagcaattgtcactgactcagtaataagattgataattgacccttcatttgcacagacatttctaacaagtttataatcgtttcttctcttatgtgccttagtgattgaacatgctttgcattcaacaactctgaaatgcaacttttttttagttgcctccaagctcttccgtaagaagagagggctatgtcgctgctatcatagacaatgaatttggaagcaagaagatggggcctatttgcaaagatggcatcatgagttttcataatctctttgtcaatatctgctgaagagactattatgtgtggcttttcaccaagttgtaggtgcatcaagggtccatgttggttagccaagtttgccaaagtttggtggggaagtggccccagaaattggtgaatcttacctagaagagttagtttccattgtccaagtggcaagtttttggaatttgaacgattcagagtgttgaacaatgcaagcaaaggtgaataggaagagggaataagaagctcactccatgttaagaaataaaatgttgtatatgcatgactggaatggtaagttcttcgggcttataaataaacgagtggtttatcacgtactggaacaaactcaacgtaggggcagattcataattttggatggaccgacacacacaaaaaaaaaaaatgaacggacatccatcatatcattagacacctagtgactgaaaaaaataatataaatattatacaacttatgatatgatcaaaaaaatattagatattagaaaggtgtttaaaataaataaataaaaatgtttctttttgcaatttgaagcaacgcttggaaaaccacttacaacacaaacaattttgtaccacatgcttaccgttgacaagattaatggagatcaaaatggaacatggtaaaaaaaatggtggaaaaggtagatgcatcaaaaaagtcttttggtggaaaattgtggtacttcaagagatgttgagacgtcaagagttaccgttttcgatgtatattttcttttgtcattttttgaagtttatttatttgatttaaaaatatataatattttttataaaaaaaaataacctattcacaattatttttaatcaaactatgtgagtttttagttctttaaaattaaaattatttttctcttatttatgttaaaataagaaaacaaatatttgtacaatcaattggcatgggtgattttttcatcaaaaaaattgggatgggtgatttagagaagacgttggatttaatttctacctttccaatgcacatgcgactcttaaattttaagatttttcattttttccatatttcaataaaattagtggtgactccactaaagaaaattgcgaagatcaagcccattaaattaattgtgacaatcatttttatctttaatttgttgatttgttaatatttgtgttgtcttttaatttcttttaaatccatagtgttgaattggtaacttggggctatttttaagaaagttcttgtcataaaaaaggtaaataaacgtggagcgatggtagggaccaacacccttgggaccttctctcacttgggactattttttaaggataccctggatacgtaattctatacataacaattaaatttgaactcgtaaatacttatctgattccgatttgatgttgatgagaaaacctattttaaccatggttgagttcaggcttttcctattttatagaaacaccaacgcttatagtgttgatgcttttgactttaatacacatatttattatagggtataagtatgaatgaaatgctgtatatgcatgaatggaatggtaagttctgcatgctctatagatagataaataagtgctgtgtggtttatcatattttggaacaaactcaacttagggatagattcataattttgagcggaaacgatttagtgccatttatgcaacaattgtacaagacaatcaattttgtacattgtaccgcttagtgtagacaacattggaaatcaaaatgaaccgaccgtgggagaatgcatccatcaattatcagtctaaactctaaacatttaaaaagagtttatgtttgatatagtatgatcttgacatttttatagtctaaataaagagttgtaacacaaaatgacggggatttatagattttccatatttcaaacccaaacaagattgtttgcaataaaaatattttacgtgttgttcatctgttttttgtcagaaggattgttaatgaccaatttggtggcagatgcttttggttaagaaggctttgtcctgcactagctctttgagtttatttgctgcatgctgatgtagcaagtttttgggttgcttagtcttacttagtttgttgggcttgagtcccttttaaaaattaaactccatatattttaaaaattaatttgagttattcttacttcatctgttttaaattataagatataattgataaattcatgattaataaaaaatttaatcaatttagttattaacattaaatttgtctatatttattatatttttttaatataaaaatcttaattttattgaaaatttattcattttttccaattttcataggtgaagaaaaagataatttaaagtaatttagttaaaaataatttatacatgaaatgaaatcttataataataaaaaaaaaacttgttgagtatgtcttatatttgatgaccagttagtttatgcatgttcctctgatgttagtttaaagattttgcgttggaccggttcaacctacttcaccgtgagtttttaccggtttgtacggtttttgactagtcttaccggtttttgaacggttctttatccaatagttttaagagtgtgacggaccgaataataggacgatatttatttgaaccagccggtttgatttaaaaaactgtgattacatttcatattgtctcaactcgatgtaatattttattatttttagaacatacaaaaaatcctaacactatataaataatactttgtatgacacgaatttatattttatattggtatgttttagtacattctgggcttttgatatttattctgtctattggtattattatattcacataacaattactctctaacagaacattataattttgcccaacaagaacggattgaaaaatatgtttgtgactttaaaaaatgaaaacaacattttatcaatattcttctcactttgaagaaattacacattactcgcttagctcttaaaatatacactgtattattctctcgagtgatcaatatatatacacaatactcctgtttcttttgaaaattacacttgattctctttgatagagaaatatatattatactaatttattttgatgtaaatcttaaaggactattttcgttctctgcaacactcaacatcattactcagaaaaaagaagacacaacaaacaggatacaaagtgccacaataagctgtcgatcgtacacaagagtgcctcgttcacttgtttcaatgattttggtgaaagttattcttgcagtagcaaccatgattattgttatattttcagatgctgtgagcagccaacagatctgtattggatcatgcgaagacactccaagctgtgatgcccactgcaagttcataggctttgggaaagggacatgcttcatagcctcacctgcatattccaagtgctgttgctcctaagatggtagacaatatttttgaccaagagttttcttcatatatagggttgcaagtaagtaatgtattttttttaataattattagtttcattgttggaaataacaaagaggattgtaaggggggccatctcactagattgaccttttgttgttgaaaaacatactttgaaactattacatgtgatcagaaattagaatcaaattcttcttttcccattccctgtcccccaactgaaattattagttgtcctaacttatgactcttaaatgggaagaatccccactcaccctttacttcacggttatcttatagaaagttatcacaagttacaaatttgcaacactttggcattacaacttttattgataaatgcaaattaatcctcctctttatttctctctctttggtcgggagaatgacatgtggcgtaggtatggatatgggaacgggaaggacaacggtgcctcatgggaaatcaatctcataccctctttttacaagacaacatggtatgtaccattgacaatgtcaagttaatggaaaatcaaattccataccctccttttacaagacaacttggtatgtaccattgacaatgtcaatttagttttaatttaaagttaaattaatcaatgtcaagaacaattattggtccaagtaaaattagattcaattttttttatatgtaagatttcaaatttaaattttataaacaaaaaatatatatataattaaaaaaaataccacactaaagataattaataaaattttctgacataaattagttatcagtcaaaatagtaaaacatgtataatgttaaccaatatttaatcaacgtcacgatttactaccaaaacttacacgtgtcagacactaaaccaagcaaccgcaatgctcacaactcatcacctgatgtaacttttatgcatcaatttattcacaacatcttgaaatatgctcagatgcatattaccttattcgtattcatatccattagcttccgaatcataatgcttcattttctgtatgttattttgctcattcaatttggccaatttcggccagtttccttttgattcctacttccaaccactgcataattaatcaaaccaatactttttttcatttatcactgttggggtaaatgtgtgtatatatccaacatccaatttattatattatcaatttttgtaaagaattattttttattttattattataattatttttattaaattattaatttgataaatctttgattaaagttaaagatttattatcatgatacagaatatgataatgagaaaaaattcatttataattttaatctaaattgttcttgatagtaggattattctaaataggacattaataattcagatagatcaatatatatgtgatggtatttattgaataaaaattaatgaatctcatttattaaattacatatatagaagataatttacatgtgaatatcattatttaactgactcaattgagaattcctaataattaatattactttgacatgccaataggaagttcttaagaagaaatataataattttctttaatttgagattatcatagtaattaataaattatttgttatattttaattttggacacctaatgccttatgatactagttaaatgaatattggatatgattaaatacttgtagaattaatgattaattaagaagaaaatcatcaactctaggtaatgagtttgagttctataatagaattaagaccttgactagaacaattaaatgaaaggagaaaagagtttcttaagtcatccattgattaaatataatatgttaacttattagaatttgatagtaataatatactctagagttaactttgagctgtaaatgatggaaaaaattattacgttattctcctattggttcttgaaggtaaaaaaaaaagttacttcatgttatccggaccttaagaagtgttgttagacgcctatcttgattagtaaattaattgtgattaatttactatcggtctagtgttgaacctactagatcacacacaaacgagtgttccaatttttgcaaaaaaaaattatttcataattaaattaaagaatttaatttaatcaaataaatattttagtagaatattattatattcttcattagtaccaagaatataattaatataaataaagagtattattatataaaatgtggtagttgtctataaataagaataaatttttattgctacatatcaagattagatcatgtgacaagttatcgtaattaatcatgattatttgataattatttttcttatattaggaaacttcttagcataaaaaagatatgagatgttttttattttcaaatataaaaatagagatacgaaattattttaaataaaatctctctttttaaaagtctcaaatccatatatatttaatattataaattccatatatatttaatattataaattgaaacatttacatgaaatcagagtgtactagatcaaagtagaaattcaattttaatttttagacttgaaaagtagaaaaagatgttgttctttagagtttctcttattaaaaaattgatagcagaaattaatttcaatatagatatatttagagttttcacattattaaaaaaaattattgtttcaacaactcacaatcggatacacaaatttatttatttttaattaccattactgtatattttaaatataaaatagatcctaatttttcgagaaatgttaaaactaacaatcaattggcgaataacatcacccctaaagtcatacacattttttcttaatataacacgtttcatgaggtgctttcaaattgtataatttgtggagtttaattcaatcatatttgacccttgacaaacgaaagttcctaatgaccaaagtccaaaacattccggaaaaaaaaaaaaaacaaagtccgaaattatatttctctctcccaccttacacataaataggcacccagaaaatcttctcaccgcccaaataactaccatatgacacgtttcataaggggctttcaagttgtataatttgtggagattaattcgatcatatttgacccttgatattaaaccaaacttcctaaagctactggttggtaaccaaaacagaaattttttccaccttacacataaataggcaacccaaaaatcttctcagccgaaacaaatttgttggtaaccaaaacagaaatttttttccaccttccaaattgtgtaatttgtggagtttaattcgatcaattttgccggatcaaaaagaaaattcaatcatatttgacccttgatactcgtccatttaaatgcataaacgaaaaccaaagttcctaatcccacttgctggcaacctaggtccaaactatttttctccctcccaccttacacatcagtaggcaccccaaaatcttctcacagccaaaataacaaccacacagaacaatccataaataaagtattaaaaaaattgtcaagacatcgttacatgtcagttgaacagtttttcaagaacaattttttaagtttttattttattttactcttttttattctcccttcctctttagttttttttcttagaattttttttgcaatacacaggtctagctgctagttacactaatagtgtgtctagtttaaaatcacttttagcataattgattaaaaaatctaaagtgaagctataaatagttaagtactagcttcaacttatttataaagttaccatgattttatggactagactcaaatctcactttattatataaacactatttgagttccccttagaatatccaaaattacaattgaaataccaacgaacataattttcaattaatattcacatatttaattttccattaagaagttaattcttaatctaatcaattgagttaaagtaattataaataatttttgcattaaataaaaaatttatcctaaattttattactaacttgcttttagaataaaatcatctaatgatctaaatataaatccattaacttcaaaagccattttatctaaaaccaattttgcaaatgctaaccaaaacacactaaaatggcctagagacgttaattcagccgactattagttagcacgcttaaaactgtgagtagagcaatgggccaagggcacgttttctcaacatcaactttatatctgatttgatctcgagtacgaagatgtacacattatctattgtctatatatacaactagttacattaaatatagagaactaaggaaaatcctggtcatgattcatttgacaattcatccttctgctggcgcattcgtgctgcccatgacatattccctccaacatccttgctgttacttcttctcttcagctctgacagttgagatttccacctagctttccattcacttttttgttcaaccacctgattcaaaaccaacagcttagaatcagtgagcaaaccaattagtgttctagccaaacacctttacccgcttttcttcaatttaaaattagaaggggaaaaaaagtgaattagacaactgaacaagcaaatacagtaaattaagaaatccctatctctttaggatgcatgatttatgaattcccacttactcattaccacgataaaaagaaatttccgaacagtagtatatgaataaagaaataattaagatcacactcaatctcattcgcagacacgtttcatcatcattattattgttattgttaataatactaatatttatatcctttcacactgttagcttgcacagacttttaatacgttgaagagccatttatacatgttacagcaacaacacacttattcagtttttaattttttatggtggtggctgggattgaagttgacatattcaaaaagatttaaattttttttggaaaaagaacaaaagccgtaatagaaatccagaaacaatgtattcctaccaggaaacgtcataaggaagtatctgccgaaagccctcataatttatgaaaatagaatgattgggtgtaggtacagtgcagaagttaatagatattgcataaaataacacaagctcacagcaggaagaatctgttataccatcatgaaaaagaaatttaacttgtaaacagattttcatgtgctgaagaggcaactacaacacacttgttcagattttgtggcggagaggctgggattcaagtcgacatattcgaaaaggaaaaaaatggaaaaagaacaaaagccagaatagtcctcataaattataaaaatatcaattatgtataggtgcagagcagaagtcaaattctgtaatagacacattaaatattaatataagttcacaaacagcaggaggattctgtgataccatcatgaaaaagaattccaatagaagcaaggtgaccgctacaactgtaatttttggaaaacaaaaaacatagaacagagaaagaatcaagttcctattactaacttataaaaagcacccagaaatataaaatatcagaactcaaacgtgcatgatgaagcaattcccattccaggtcaaagttacagtcaattgctttgtttgctgactgagataggtgaacaaatcagtagtaagacaatatttcagattagattaaattcaaatcaaattttgaatcaccaagctaatttttcaattgtgaatcctaactcacatcaaatcataagtttagacacaaagtgaaaaacagccctagtatatcagataaacgatgtatagagctcaatgtataattttaaactaggaattgaaaaaaaaatacatattatccataagtttcacgaaacattataagccatatgtaatatgtcgtaagttaaaacaaaaacaaaaataagggcacatggattgggtgggttagtgtaagtgtgcaaaccctttgtcatctcagaattaagagaaaaaaaaaaaaaaaaacagaanntagcatgcacagagcgagagactgtgcaaatggaatcaaagtaaaagaacaaccaaacaacattcactaagcagcactatacctaattccctattcctttttatttcacaatttaaacttatttaaattttcaatatctttaacgaggactgttaaaagaaaagccacccaaaaaattagaaaacacaacaaattattgaatcatatcatacatcgaacaattcaaagcaatttgcaattcatcctacacttgccaaatcatacaattcaaatggcgacaaatgataatggttagtttgttagcagcttcccttttttcttaaccacccatgacccaaccaaccttatatctcctgaaatggcgaatcatgtgattcaaataaaatgaatggaataattaaaaagccctaagttggctggcgaacctgatcgtggtaattatagcgtcgacgagcgttgaaggcgaagttgatgcccctggccatgtccttatcgtacatagctcttcgggaaggatcagataaggtttcgtaggcctcctgcacctgaataaacctcttcgtgtactcttcgacccgacccggtggtgacacgtccgggtggtactttcgggcgagttgcttgtaggcgttcttgatctccgttaccgaacccgattcgggtatgcccagaagctcgtagaagctcagctccaccacgaaaccctcgttcttattcagggtcgcctttggaaacgcgattcgggtcgtgataatgggtttgttgggcctcaagaacactggagatacggtggggacgcagaagcgctggtcgcttcccggtacgattaaaccataacaccgcattatctctcaccctttcttcttctcttctctctatcacactctcgctcttactacttcatttgctttgcgtgtgttttggtattactctttatgacttatcgattttatatggttctcatttcgttttttatttatttttgcgtgattggatttcaccaaaaaaataataagttttacgagattggtttgtactttgtggttagctgtcgttttagccttaagtaaacgtctgggaggccaaggtgtggcctttgttcattgggtgggttatacacatctagatttttttttaagttgtttttacaaaaataattcttaaacatctatcacatatattttacaccaaagaaatataaatatgacaaataatacatatgattaataataggaagagggagactgagaaaacttatgtgccaatggagtttactggtgtaaaattgtgaagtgtccaaaatcatagacattattttacagcgtgtttaaatcatcatccctgaataataaatgtgtaagacttatgtatttattttaccatgtgtttcgaaggcaatccttttaccacattgtagaaaattattagtcccttttctaaaacctaatttgctgatatataaaggcttttatattattattttgttatatacgaaaagaaaaaaaaggttcatatgtatatagaagacctatccattctaaagaaatcagagaaacaatgtaacccaacaatttattattcctatttcattactattactgtattatctgatatttaaaattaatatattttttccagtaaaaaaagaaatgatataattttttatttatatctaatatatatatatatatatatattcatcatttaaagtattccaactattattttcattaactaaattactctannnnnnnnnnnnnnnnnnnnnnnnnnnnnnnnnnnnnnnnnnnnnnnnnnnntcacgtgaaaaagtctaaatcatataatttcactcctaatctcttaagaattaaactaagtaatttgctttaagaataaatatgcatagataagggtaaataacatcattttatttatagacatgaattacctagaagctcctttaagttcttagggtaaaaatatttttcaatgattaaaatcgtataatatacatatgaatgggtgatcaaatcataaataagacaataaacttaaatagaaagcaataatattgaaataacattaaatggatagtaaaattcactacatcaaagagtatttggtattcaaaccccaacaatggataatttagtatctcataatcattatgagagactaaaaaacaaaagatgaaacaaaggaaatggaagaagagctcccaagtgactcttttgctctattttgtgcccttgctgactaactccctttaaaagcacattgtcacatttttataatcttcgaaatgttgcataatcatatttttcaaaaatgactttgcgctaagtatgcatgtgtgcgctgagcacacatccaaagtacaattgtcttaagtgaccatgcactaaatcctaagcatgcgcttagcgtgcattggcatggtgagcatataatgcacattaaattcagtgttctaattttttcaataacttccatacctcataaagaagttaaattcctaattttttaagtaagaaaaaacattaaaaagaagaaattaaataattgtcatgtaatttaaatgtacaaattaaatattctagtaattattacctattaaaaatattatcatatattaaatatgaaaagatttcccaaaatctttagttgttggttaagggggatttaattgttctcaaataaaaatgcaacaataattgatttataatacaataagtttactcctctaaaaaaacaatacaataagtttactaaagatacatttgttttagagattcgctaaatagttaataacatagttgacaagtgactgtgatatcatgctcaataaaaatattagtatcatatattgttttaagtgcataagttatacgtacatcaacgaaatgaaaaagtgcatagtttatacgtgaattctacattttaaaaacgaaaaaaaaatgcaaataaaataatgggatttgatttaggtaacgtaaaaagtcagtctagcaaattaagatttaaattcttatacatttaatacttatcatttttggatttaaactttaaattttccctcaggatatgcttgcaacgataattttaggaaaaaaaaatataatcagatttttaataaaagtataaaccttttttaattctttatgaaatattatattttattttaaaatatgcatgttaatacttaatattaattatagtatattcgaaaggataaaacagattttttttattcagttaaagataaaacttagatgtggtgcttcaatttggttttttgtattatttttattttaatttgaaattaatctttgataacctatgttgactcttcatataaatctttattatatattacatccattttttttttatccgtcgtttacgattgtttttgtagaaaccaataaataaaataatttttttattatgataaaatagttgttaaattttctatttcactcttttatctttttactccacaataaatatatgtgtaaattaattaaagataaaaaacaattaaggatataattgataaactcataaaagtacgtataattaatataattttgaactccgcaaactacatataaacatgaaaaaaaaatctttaaaaatttaacaaataaaaaaggaacgannnnnnnnnntcacacactattgcaattaataaactctttcgataattgtcctttttgggaggtttgaactttaagagttttcctatgaggatatgctatggaagataacgttagagggggaaaccttacatgatcaatttttcgataaaatataatccaattttaacttttatgaaatattttttattttaaatacgtatatttatttatttacgtttcacatgtcaaatttaatattttgaattttttttcattgacaccaaagtcataaataattgatccactgttaattttaatataatcttttttagcatgtaaccttcaggataaattaaaaattaaataaataaataaaatatcatgtagtaattgtaattgaagattgttaacattagatataaataaaaatatagataaataaaacacaaatagatagtgttcctacattagtattttttttccttctatattagccctatatattttagatttacaacattcaaatgagactgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattaacatgtttaagcccacttttttttttcttataattattaaaaaattgttgttttaataatcatagaaaaaaccagttctataagtaacatcttttattattcttaaaagttgttataactaattttctatatgtaattctattttgacgtgtagattatacttcagacagttgacaaataccatttggcccactttattaacatgtttaagctaacttgtattttttaatagttattattgaatattatccttctttttaggagtcattgaaccttgtgcttaaatatacttctcaaatctacatcactattcactaacatgttgcacacggtttaaaatctcccaaattgcatccttacaaacaataaagaacatacgtaactaaaaaccttcaccgttattttttataagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgaggtattatttatgattgaattaggacaaaactcacattttaattaaaaatatttttaaattcaatttcagactatattaaaatatagtgattaaattaccattgagtgaaatgtcaaaattaattggttattaaactttaattaacgatttgccaatcaaaaagttagaagaataaagtaaaaattgataaattatatagtgttgcttctcatgtgcaacttaacttcataagtttcgtcttttttcttttgtcactcatttttgaattcatattagattatccaaatccacattgacatactagctagcacgtaagtatttacatgtttgacattacgttaaggaattgattttatataaaaattgatcaagttaaatcgattttaagtttcacagtcaataacaaaatttacactgaactttattactgacatagttttgaaataaaaacatcaaacataatttttaacttaaaaatcagttttacagacattcgtcatggccatcattatgcatatgtcatcaattgttttcattacttagaaaggctgctgctgaaaaaagaatacaaaaacttgcttagattagtacaccaattaacttgacgacaaaacgggaccaagaaacaaaataattagcagttgtacgcttgatagtctgttttttcttgcttagctggtatggtagactaaatttgatcaggacaccatttctatccaacgacgatgacgtgtacatgcaatatatatatatataaaactccatcctatattaataataggtaaagaaaaaataatcttaaaataattatcattttaacaaggaaacataaaatttataaatgaattaattttataaaattattattctcttttatatatttattattattttttaatttatgtaatacctagtgtaaatacctagaacaacaaatattacgaaacgaaaggagtattgcgcttgtagtaattgtatttctgtattaacaatcatcctcacatgcacttgataaatgtaaattgagtctattatgaaagaggggtactaaaaaacactgacactttcaaaatactctatctttaataaggaaaaaaatcattaaatgatataagactcgcaaattgtcatttcttataaatatcaatcaataaaaaataatatatttaaaagaatcatagctaaagcgaggttccaataaccagataacatagtatgtagaaaaaagaaaaacaaacttcaatttaagtgttggaatatttatattagatttgacgcactttggaatttccattaataaacttccacttcaaaatcaaaacattagtttcaccaattttaacttggttttgtgcagcaagagatacatagaacgacgtgatttcactcgatgatgatgattagctacaactgagtaggttggtcatacagcttaaattaggattattttcgaggaaaaaggggaccaacatttaatcaaatattcctcaagagcctaagtcatcaacgctcaatacttccccctcagttagccactagttatttgtatatgttgaagggcacgcatcaacatgttaagaggtcaacaataacctagaatagtattacccatttcttttattaaaccgtgcagaactatgaacaaacactgtggtaaaagccctaagcgccaaccggagaaggcataacatcagtgtgactagaccaggtggtgaagagacaacaaaaaaaaggaaactaaaacaccaacagaacttccaagaacaaacttcacacaatcatctggtgaagagaatttgcagctgctcataagatcatcatatccaatgcttaacctaaccaaaaaaaaaaggggagatgggagcagaaggggaaaaaagaaaacggggctggggacagaaaaaaagagagcataaaacaaggggataaacttagttgtgacccaccaacaggagaaaaaaaacataatttctttagcacctctcagcaacaagctcatttttcaaacccataatttaagttgtgacaacaaataaaatcaacacaacaaaaactcaactcaatcattacgatgacactgaaaatggctcgatatgcaaataattgtaaagaatgtgatgcaaaaacatcaatgtcagcaggacaacatacagaactacgtaaagcatgggacaagacagacaaaataaaattgaagatcctacacaaatagaagaaccacccgatagtttcacggagaattacctgttgaaatcatttgcattacagcatttacttaagtaaaaactgtaactcagccagttgctcaaatgcaacatgatgaaactcattgcagcaacatccaggttcagttgacctttatatagaagctttacctaaccatgacaatttgttggggggaaaaaagaaaaaaacaaaatgaaaaatgtggggggggggggnnnnnnnnnnnnnnnnnnnnnnnnnnnnnnnnnnnnnnnnaatgcattcgcacataatacaaagctaagcagcctaccatattgctctcaacacttactaaaagaaaaacaaatatgctctaaaccatagagcatcagaatctaaccgcataccttccattacacaagagaaaatcaacccagcataactgtatctcaaagctccaacagatttcaatgagaataacctgcatttgttttggatataacatgcccaccatatcacaaaacatgagtaaacgaaacggagcctatgggtggtcacatcaaataatgatgctttcaactaaacaagatcatactacaaaaattggccacatcaactatagaatctagatatgacagaccaatgaggagataaacttaaatagtcaccgaaagttcagtttaacatattattgctatctaaggtccaataagttttagatgcataaaatcgaacactggctaagagggtttctccctctgaactatcatttttgaagaactagaaaccaataatattcagacaccatcaacaacacctttaacccaagttaattgggaaataatatacttaaaaataaatatcaagaccgaaacatagcaaaaattaccttcaataaaaataatagtatacttaaaataacattccaacatacatcaatcaagcagtaaaagaagcatgatataagcgctgcatggttgatcatgagaaaagcaggactcctcttgaaaacttaaaccacaccaacagctgtgggattctacacctgatctttaccaacccaacctgcaaaagaaataaacaatggaagatgttcataagagaacagagaatattctggggaccaatcaaatagtggaggcatcatcctctgagaattgcggtcctcctaagaagaaacagtatattccttggaaagaacttgtcaggaaacctaaatgagaatcctgaattagaatatgctctttatcccataatcattgacaggtgcagaaatcttcaaccacaaaaaaccatggtgcaatgcttttgaaataaatctacactatggtgacaagaaatggtagtagccttgagtgacaccacgtccgattcaagattgaataacagaaatctacactcatagctatgttctttgatataatttagaaccaccactcctgtaagcacagaaagtaaccaagcattaataatcatataatacaagtggatactctttttttctatattcaagttagtcattaccaagccatgtttgcttaatattttccacttcccactttttccactgatatccatcctgcatcaaagaggattctcagatttgtaacatccaactaaaacataattaacaacaatgattgagaataggacttcccatacctgggttatcatcagctcctgcattttcacttgacccttctgatttgtagttaccattcactgaagtcagtgtcccattatcattcaggattgctgagtcctttgcatttataattggttcctgaaacacatctccaaagagtttagaattttcttcactggtagcattttctccatcattcaaatgatgcttttcttcaacagatccagaatcagatggtgattttccttttgaatcatcctccttgtaatttcctcgtaagggcccactcccatcaaattgttctgattttgatttagatggggttttcttttgaggctctgatttttcacctctatttcgatatttatcactggagtgattcttgccttcaggggactttgtcagttcaaaatttctcttatccaagtttaaattgggtgaagtgcctcctttgtcatgcttatcttctaatgatattgaccttgaacgccttctatcacgatgctttgatttcttatctctattttcccctgatttatctttagaacgacgcttcccttcaacagattttgacctgcaccttttaatatcacgatgttttgacttttcatttttactttcatcctctctgacattagtttgatccctattttctgtagatcttgatctggagtgccttttatcactatgcctcgatcttctatttctgttttcatccaatctctcaggagaatcatgcctatcatccacagattttgacctcgattttttgtgcctggatctactttcatccacttttctttgggatgaccggctccttctgtgaggcttctcatccacagataatgacttggatcgccttctctctctgtgtttagactttccatgcaagactttttcatttttgctagagtgaagcctatcatctgaagatcttgaccttgagcgccttctgtttcttagttttttgtcatcaatctttggagaagacctacttcctctgtgacgatttggagagccagaatcagcacgtgactgtttccttcctctatgaggtgaagtttctctatgatgttttggagaaacagatgatttccttgtataaggacttacactcctacttctgtttcttcttgaagcagatgaacgatgatcaagtgatctatctgaatctcgtcttctgtatctatcactatgttccctaatatctctataggaccgcctttccctatcatagcttgagtaatgatgggacctcaatggtgacctagagcgatgatccttagaatgatgagcaggtgaataagagcgagacctcctccttctccgataactgataggagatcttgactttgatcgaaatcttccacgaggaggagagggcgatctgcgaaaggaaattaaattttagattagacagagaactttgtacagaaaagcagaaaatgataatgagtggtagaaaaaattaaaaaaaaaaaaaacattacaacaagatttttcccaatttaattcaaaataaccacgaatccatgataaacaatagacttgccaattgccaggccacccacaatatatttcttccatgttagacaccagttaattctaaatacaaataatttattcagcccaattcttcttaccttttttagcatctacatgcacatacatagccctaccacatctagctagaaatatagaaacttcatatgattcaaatatttcaaactttctatgttgaaacctataataatccagaacagcaggttgattcagttaagtcatgacaacggcatcaattgaaattcatatacaattataacttctctaatgaaaatctccctttctaaaggatctgcacaaacaaggaaagcagaccaatcaacaaggaattctcccaagtatgtcaattcatactctattattgctgcgtcacccaaatgacctccaatactgcaggagggcacaagtccccataactcagcaactttgcaaagcaaaagtggggaggttcctcaactacaatgtacctactattccttatgcacagagggggctaaataaccacagtccaacaaccccctcctcaacccatgaaccacaactatccagtctgttactgccatgcaaatttaaaaactaaaatgatctaagacaagttgcttttccataccaagcccctgggcaaataatctggaattccatgcaagccgctaagaaaatatgttgattgaaagcatgccattcttgcacatatcacagtttactttatcatctttactagcattaagagggtaaaccttggcacaacggtaatgttgtgtctactgtctaggtgacttgtcggtcatgggttcaaatccggaaatagcctctttacatatgtaagggtaaagctacgtacaatatccttcctccttaccttcacatagcaaggagcctctgggcaatggggtacatagttttatctttattagcattaacattccatatatcattcagatttatgacacatcttattaaagcagagaaactcaattcttatttaattcagtaattggaaaacttttatgctagtgatgatggtgcataaaaagaacatgcactttttttttatcaaaaaccttattttctatcaagacctcattaactaatgtgtagctataaatttgttgatacacacatttgatatttcaagtgtgtttgaataaatatataatcctatataatattgggcctgcgcattgtagaagtggacctgcacaggggccaaacttagattgttcaggtggctgccagctgataggtctgtcaggaccagctggctggtttcacttaggatagttggtagagtgtcacatcagttgcaagtttgacctaattacaactgttctgtaacaacataaaagtattgtatcttccattatcccgaacataataagaaatacagaaacacttctcagttttctctctatttttcgcaccatttgttcaaacattatatgagttcatgtctcctacttcctatttaggacataccagaactacccagaacaaaaatcaaagtggttgaagcaatcaaaaatttgaaataaaatcaggacaataagcatatattatcctctaaacaattgacaacagtaatcaaacctggacttttgctttgtctctttctcttcacttccaactccatcaggatttaatttcttacttatttctgcagctcgggctgctgctaactccgtggcagatttcatggttgcagcccgggtagcagcctgctgtgcagccatagattgttgcataagcagtgcttgctggaattgcatctgttgcatcgcaacagcttgctgcatcatcagaggaagagatgatgaagcaagtgaagaattctcaacagatggtttctgtggaagtgattttgccatttcaacatttaaagggcgccccccaacatctatgttgtttaatgccagagcagcagttgcctcttcagcctttgagtattctatataggcaaaatgctttgaatcagtgattgcacattcaacaacagtgccacagaatccaaagagttgttttagctgttccacagtgagaagagggctaagattgctaacttgaagggttttcttcactgcatcatccttactagccttttcaggtgaacctattgtggtagcaaatacaattagaagaaaaaactaggaaacagtaaaacacaacaacaaaaataacatcacagtcaaatatagtgcaaaattaaggagagagctttcatcatattagaaatttagaattgtgaaatgataaacgtaccactaaaacaaaaacaaaattaagataatagcataccaatggaatcttttgcagactgagcttgcacctgagctgcatgtgcttgaagggcttgagcagcaactattgcctgagctgcagccattgcagcagcagaaggtgccataggagcttggctaagtgttcccattgaggttgtcgcagccaaggcagtcattaacaaattatgaggtgggtgattcaacttgcaatcaacttttgcacaacgcccattaaggtaatcacgacaaacttccccaagtgaggccccaattccaggcaaaatagcaccgccagaagctccagcaacaacccctggaatcattcccaacaatccagggaatgcccctgaaactgacccagagtaattcggcatgttgggcatagtttgattaacaagatttggaaatgaagatgcaggagctaaacccagcggccctccagtactattacctacaaaacaaatcaaagcattggaaattgaccaccacgaagatcattcaaaccaaaatacacgcatatagacagcgacaaggttatcaacacaacactccgcctatgcatagccaatctcaagccaatgtaatgggagagggttatgttaaacctttggcagccaacacaaaactcattgatattagatatactaaacacagatcactcactacaggtaaccatggtgtcattgatccatgtagccaatctcacttggtgggataaggcttttgttattgtttgttttatcactactcataattacatcctagtcaaaccaacttattattatacatataaaaggcaaccaagtgaaactgctaactaaccaaaccaaaaacaactcaaaacaaccacatttgaggcaaatgcatatactaaattaaaaaaaaaaagaaaaaaagaaaaagcaaaaaccgtaaagcatatgtagtacctgctgcactgaaaaacacaggaaatgggctccccatgataggcctcccattacactcaacactgaccatataattccctctcttaggcaccacataagtcacagtatatgttccatcccccatatccttcaccatcccctcttgctcagtccctccaacacccaacccgggagtcaccctcacctttatttgcgcaccaccgccggaaaccttcctctcatcggcgtccttagtcaccaccacaaacgaggacggagcgcacgcggttccgccagcgatcccggtccccgcagcggtgcacttggcgggctccacggggccaatgggcttgtgggccaggtcctcgtactcctcctcggagtcgctgtccgattcagcaacgctccctcctcccttgtcgtgtttattctccaaagccttgaaggtggcctcgaaagccgccttcgccgccgcggccttctccgcctcgctcttcagcttcgcctcctccgcctgcttcatccaaatcggcttcgcagcgcccgaaccgcgatcacccattgaaccctaccttcgaaaaattaccaccaatcgctgatagataaatactagtaaaacctaatttcggggggattttcgataaattagtgcgggaaggaccctttcaataataataatttccaagatttggaagattaaagagagagatacagagaaaaggcgttgaagtgaatggattttgagggcattgaaatgattgttagggggattgacggaggatggagggtagattgggaaagagaaaaaatgggaggtgtattgtacctgttcgttgttgtgacggctaagtttggtgctggagcgttgggcttgggcttgggcttcgccttctaacgtctgatggtatgggaaatggagtcttgcttcctacatcagcactttttctaatacattcaacatatttttttattttcaactttattcttatagaaatcgacaattcgtaagaatcatatgaattgtcaatccatatgatccgtatgagtcatacggattgacaatccatatgaatcatacggattgacaatccgtaagaatcatatgaattgacggattgacaatccgtatgactcatacggatcaacgatccgtaagaaatcgaatggtgtatgttaatatgcaacttacggattttaagaaagacaaaatcgatattacactgtacatgttgggtgtattaaaaaaataactagtgtagaaagttaaactctcaagaatgaataagggaaataagatgtataaggaacatgctttacaacatgttataaataagactcattatattttcagaacccaaaattttaaacacaatgaataattattttttattttttttattttcctattacattacattatgaatcaaatcaatcacttgtctctcatctcttccttcctttcttaagttgtaaacaactcaaaattgcccaataaataaataattattttttataagtggggaaatgttgtaaattaaccctatattacacattaaattgttgattgggaatttaaattataattcatgtattcatataattcttcttctaatttataatttaaattatattatctagtgtgaatttattcatagaaaaatatcaaataagaagttttcttattatgagtaatgagaactacaaatataatataaaccattagattatatttgaacggttgggattaaacaaaaatgcacatgatatttttaaaatagttataagattagaatctaatattttattttgatcatctatatatgggatagttgtgaaatctggtccagtcattgatccagacgagatagtggatcagtaggttagtgggtcagcggtccaactggtgggccagtaattggaaaaattgaaaaaactctgtcgggtcaaaccgattcaaccaaaaaccaagtcggattttaccaggtcaacctgagtcggttccatttccggtccaaacatggaaacgacccaatttggccaccgagttacgatccggaccgtttttacaacactaatgtatggttataaattttaaaaaattatagttattacttctcataataagaaacgtttttactttttcacagttgtgataaaagtcgttgtgtgtgtttattcaagcatttgagatagaaaaagtctcttgtaggtaaaggagacataaaaaggataggtgcatgaaactcctttggatagtttgagaaagttaagaatgaaaaggtgataaagcaatttgaaaattcatcttcactatattgatattttttaaaacatcttagtgccttaattatgtttgtcattgttttagttcttttccatcaaatacgatttttatgtgatgatgtgataatcatgtgacttttcatgtaaattactagtttgatataatagtcatgtgataaaacattgttggtttggaatatttttccataaggcattataatttttttggccatataaaaccaccagcaaaaaagtttgaagaattgaaaaacataaataaaaaagatatgtagtaagcaaacgcagcaaccctcaatacacaatttagtgatccattgaaccatatttaaaacacaaaatcaacaactcacactaagtaaaatcagctaaaataagcaaaatcactaatcattgaatccatgaatcaaaaccctaagctccataactagataatccataatatttgaacccttcaaaccctgattccctaattcacttcttaagcaaacactaaacccttccattttaattttgcttgcacaaaccatttcttgatatagtttacaaaaaaaattacacgtgaatatcacattacttgataacaaggagcaaaaatgttaatagagaaataattcaggaattagaaatgatcaaaagtttgattaaggactacaagcaaaaaattgaaaagtttagaaaccaaaaagatattaaaccctatatatgatttatttaaattgaatgtactttattaaaaaaaaatacataattaaaataccaccagacataaataagagttacatattgatttttatgatatgaaaccaacataagataatatcaaaatgatataaatttatcaacttttatacattatttgaatatacatctgagtttttctattttaaaataagttttataaaatattttttagtaaaaaaataaaaaaaatgtttgatgtagattttattatataagtttggataataaattttgtaataataagtttatatgtaaaatttattatattttaaattttgctactataaagtatgttttatgtataattcattaataatattatatattatattaataattgttttcaagtctatttgttttctttcttttaactacttttaaatatatttatgtaaaactaataataattattgaaaataagcatatttatatatattagtcaaaatttaaaataattcataataatacattttataattattgtataatctaccttttctatttttttcagcctttccattataacgcccgagacttgggagttgtatatcctcatgttgtcattaggccaaccataagattaataatggaccttttatactctatctaacttcatcgcactaacgtgcttgatcacgtgaatcccttgttctcgtgcttgatcacgttattatctaatcatatcttatcatgtttaattagtctttctcggaacaattatataatatatttattaaatataataaatatgccatgtttaataaacacaatatttagtaagattattaatgttatttatattttatatttaataaaaacaacaataaatattatataaggaaattcccattcaaaaatatgtttctataaattagattttttaaacaataacaagaataatatcacacacacacacacatatatatatacatatagataactgttatactaataaatttaaataacagttaaatattatatttaaattccaccactcctgttataaataaaagttcatgctgcattgaataaaagtataatatatttaaatgccattacaaataattatatacaaataaatttaataactgttataactaatactatatgagaaaaaaaatacttacattttaatattataataataacactaaatattatattaattaatatttattcacaagtttaattcatacacacgcataagcacgcgcatgcacatacttacccacgtgtgtttatatagaatacattatttgatcatatatttacatatacaataaaattgacttttgtattaatttagttattaggaatgatttttaatcaattgacccacagttaaaaacaatttcttcatatatatatatatatatgtgtgtgtgtgtgattgtgaaacatgatatactttttaagttattattaagatacatgactattagtattgattattctttaacaaatactattcttataagattcactattactacatgtaggggtggaaacaggccaggccaggccaggcttgattaggcctggccttggcctaatttaaaaatataaagcctggcctagcctttttatctatcataggctttttttttaggcctggcctagcctatttaaaagcctggcttggcctacgagcctattaaaaagcctactttaaaataaatattatatattaaaaaaaatctaatgactatatagtaaaacttcgagaattcgcataatacttttgtaaatttaatataaaaaagacacatattcccttttaatttgtgcgtgaaaaaaaataaaattaattagagcactctaatatgaaattaaaatttactaatcacaacaacccaattaataattataattggaatactttaagtattcaacaaaatattgtaaacaaaataaacaagctgagtaaaataccataagtttaatatataagagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaaaagattgatttatatctttttagttttaatatatatatatatatatacttttatttttttacaaatctattatagtgtttcaaatcttctattttatttttatcttttaagtagattaggttatttagattttttcttttttaaaaagattgatttatatcttttaattatatatatatatatatattaaataggccagcctgataggcctaacaggctttttttaaagtctaagcccggcctttttatttaaataggcttttcaaaaagcctaagcctgacctttataataaacaggccaggccaggccaggccttaaataggccaggccaaaggcccctgataggcggcctggcccatttccatccctaactacatgctactgactctgaataaataaaaaagccacacacaacccagcacaaaatcgtaataactattactaatacaaaaggtctcagaaaacgtgagttgcggagaggcctaatttgaggtaattgtttctgcaacgcatgcgtgacacccatacagttgcgtctcgtgcctccattcgatcccaattccatgatctcttcctccctcacctttgacatcaacaattaaggcttcaattttcatgcacagacaacccttctctttagttttgtgcgagtcatgattttctagccataaagttgtatgtaaggtgcccaataaggtaaatagcataccccttctaatgtttggatgtttctatgtctatatatgcatatttcatgttatacaattcattcaattaattttcttgttaatgcatttgtacgttgaatcaatggcttatagggtcaagggattgaattggacatcttggccctgcaattgttcgtatcatcaaaggatatttttttggatatcatttacatgatagtgacaaatgggggcgtcttctgacaacgtaactgggtttgttttggctgtctcttccagcattttcattggctctagcttcataataaaaaagatgggccttaaaaaggctggtgccacagggaaaagagcaggttcatgtttcctcacatttttgtttttggtttgctaggtgttaattaccctttctttaatcattgatatatatatatatatatatatatatatatattgttttaatttgatcaggtgcgggaggacatgcatacctatatgaaccttggtggtggtttggaatgatctctagtatgtgatttttagttttttcttaaaaattattttggtgctgcaattactaaattataatatatcatgtggcattttacctgctaaacacatttgacaaggcctaatcataagctacctattttaatttaaaagggatttcttgtgacccattgtattgcatgtttgatctaattcatctttaattttctgtttgtatttattgtattacttcatgatataggcttgtgttgaaaaggtgtctcgtttgttgtctttatcagctaatttgacattttacaattaagattataatggagagtgaaaaaagataaagtgatgcagaataatttctatcacatttcaagtctagtggactaccaaaaattcttgaacccaactgatttaagtttaattcttctaagacaaagaatttttttttattacttttaacttttaagttctaatactttgactatgtttccttgactttggattcaaatgtctttgtacatacatataaatttcatagatataaattttgtgctacatataaatttcatagagcaaattttcaattataactcttagaactctgtaactataaataacaacttgctaatgtccccgacaatcttatgaaaatttcatcaactaattctatatgtatgcttacatttttgtagtgattgttggagaagtagccaattttgcagcttatgcatttgctcctgcactacttgtaactcctttgggagctttaagtatcattttcaggtaaggaacatggtattcttcataacattaattattaggatgtttctgctttctttgacacagatgtagatgcacatcttcattcatcaaattttaatttgggtgctgcttgcattttagaaagttacaaactaatatcatgatgcagtgcaatactagctcactttatcttaaaagagaggttgcacatatttggtgtgcttggatgtgctctttgtatggtgggatctacaactattgtgttgcatgctccccatgaaagagttattcactctgttaaggaagtgtggcaacttgctacagaaccaggtaatattcaattcctgattgcttggtttcaacatatcttttaccattgaatcttgcaaaaaatcaaagtaggaggatacaagatgagtgggatgcatattaaggtcttaatagattcaaggcattcatttatggttaacgaagctgacattgagttctttccttcatcaacaggctttctaatctacatgtgtatagttgtggttgtggtttgcatccttattttctattgtgctcctcgatatgggccaacctatctggttatatatgttggaatatgctctctcacaggctcaattacggtatatcgattatgtgttcaatgctcatatgtgtcatgtaggtcacaataaaactaccctcgataaacctaatgttgttccttgttgcataggtcatgagtgtgaaagcagtgtcaatagctatgaagttaacatttgaaggcaacaaccaattcatttactttcagacctggttctttacgattattgtgataggatgttgtcttttgcagattaactacttgaacaaggtaaactttgacttacatatattagtacatttactgttggcagtcattgtaatatgtcttccaaagtacaacttaaaataattatgtcaaagttaaatatatttttaattttttttattggttattggagtgcaaaagttgaaaacactattttgatttttctctgaccttagtgattaggtggtaatttgtaatgcttaagaaatttaactatgcttttgcaatctttgggacttctatcattatctaaatgaccatgtttgcatttctaatctagttcgtggcatttcgaaaagttataaacaaaagattttgtattgtttttcttaattggcattgaactatttcatttcctttcctttgccgttatagatgagtaatacttaacatgcaatattttagaaatggcatgccatattttttacattagggatttccaactaacttacaactgaacttcattttagtattcgctttagactttctttaatagttaaaaccaataatgttagaatcattgaaataagtgtgctgaattagtaatatgcttatcagttatcaattatattgtaatgctattttatttattttggaatcatgtttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatatatatatatatatatatatatatatacttttgtttaaaatgtacctgatgatgctactaaactatgcaatcatatagtagtttaaaacaataacaacaacaaaagcctgtttccactaggtggaatcagttacatgaatcaaaagatatcattgtgttttgtcaaaaaaccaattcttcaaaaatgctatttaggatctaaatcattttaatatatttttacttggagtttctattagtattcctctacttagttttaactattggcgatcacttatcttatcaactcttcatatagacatatggttgtttatggaaataaaacacaaactacctcttttcttgttgtgcagggaaaagtaaaactgaaatgagaaacatgaaagtgtgagaaacttagtcatccatagtattggaccaatcataacaagaatttaacttgcataataatatcaagttgaatacaagttttgaagaacttggacacctaagatctattaaatcagacaaactgaatttaagattatatcaatgtgtaatttcatattttgttttaaaagcatgcgtgtttgtttgctagtacttaatagctgaaaattctaacacataaagtttattttgtttatttgttattgttctattttattattttaaggaattttttttaagaaaaaacgaaatgacatttaattctcacagtatatttcatggcatgattaacgtctacaattgtcaattgatcaattatcattattgctattgtcttgttagactcatctgtattattatgagtcttaaataatatcttcgtcggaagtttgcaattggattgcaagtcattatctgcttttctgctttatttatttgctacaggaatgggacacacaagatgcatctcaaattgctactgaggtttgtggctttgtcacaattttatctgggacctttcttcttcacaaaaccaaagatatgggaaatagacccatagagtctcctgtttttatgagtactccacaacattctagtagtcactcagggacttaatagccatgcctttttttttaactctggcctggacgacaatgttatttcacctatgttcccaagctaagcagacagctttcaaatccaatgaagattaagctatggtatttcaaggagaagaaggtcagtgaatgagtggtattggatggttctaacaagcttgtaatgtcagaaaaggcaaaacagaaatatgaagcgtaaaagattacaagaagcatttcagacaatattagagaataatgccgcaatttagtttcttgtaatatttttttccctttaacaatttctgagcagcttatttttatgtgaaattgtgaatagctaatactctaaagttagtcttcattaatatgagatcacaatttgcaggtcctattatggtcttcatatacctcaatgttgtcctgattcacgagtaaaagaaaaaaaaatgaaatatttatttgagtgagagtacatgtatatttagatctttaaaaaagaataaagtcaatttaagaatttctcttctagctaggccaaatttaatttgattcaagagtgaaatagaaacttagaaaataatagcaaattactattgagtaagataatttgttactcattttcattatactatgatatagttatgtatgcttatagcaagatcatatactaatagaatctgagctgagataacatagtaattgacagttttcagatatctaatacagcaactatcagataaagagtttaaaattcttaagacactagaaagttctttactcttaacattccgccctcaaattcaagggggacttgagctaaagaaaaaggatcaaccactctaagtttggtgtacaattcacgaaatcgagtactttccaaagctttggtaagaatgcacacaatctgaccaaggcgcaatctttcttcagcacactttctatgacaaaaaggagattgaactccatttgcttagatctcaatgacaggatacgagtcaaggacactatcctaagattgtcgtggtaaacaaacgtagggggttgtaataggaaggtaaagttcatgcagaagagactgtatccaagaatttctaatgtggtgttggccagatttcaattttcagcctatacgtttgagaaagcaacaaaggctgtttgtttgtccaccaagagaccatgtttgggccaaaataaatgtagaacacaaagatgtggaacgatgatcatcttaagcgcaatctgcatcataaaaaccaaaaatgaccagctgaggggagtctgggacttgaaacaagttgcaatattagcccatggtgaagggtccctagcagatataggtttgaccactttccaatgacctagtggtcgagagagaaattgacatattttgttcacaatatagctaatttcaccaaagatggacctatagaggtgagggttttggagaaaatcaggtacaaattgttagagtttgcactttgcagcctttaggcatagggtgaaggtaactttagctgaggacatattagctttgtccaaaaatgtctctaatatatcttccttaagatagaaacatagaatcattttcgagatacatgacatccatacccaagaagcagtccaaagtatcccagtatttgagagcaaatatggagcttagtttggttatatactgttgaatcagatcaggagaatttccagtaattaaaatatgatcatcatacactagaatttatgtgcaatgttggggaagtggttagtataaaaagaaaagatggatcacacttgcatgagttgaatcaagtcctagtaatttagaagcaaagttagtaaacctttaaaaccacgccatgtgtgcctgtttcaggtcatctaatgccttatgtagcttgcatgcaagcagtctcaaagcccagtgcctaagccctatagacttcttcaacaagaaatccatttaggaatgcatcatcaagttgctgaattgtccacttgtcagtgaaaacaagagtgatcatgatcttaatcgtgacaagatttacaacaggtgagaatgtttcagtgtggtcaaaactatgctgttagtggaagccttttgcaacaacatgggccttgtactttttaattgacccaatagggttttctttgacttgaaagatacatttacaacctacaacttgtcagtgaggatgaagaggaaccagggaccaagtctttttaacagtaagtgtagaatattcatcctacatagcctatttgattgaagaaggtttaatgagagtggttaacagcgtgggcttgtgaatgccttacttagaccttgtttgcataggaaggatgttttgacttttgagccccaatggaggaggattagcaacaaatctgagaaagtagaataagatgaaggcatagaaagagatgatgatgtatcttaagataaaggttgaggtggaaaaaaaggctattgtatgtgaaggatgaaaacgagggtgagatgaagtggtgaaaagattgtatgtatgggagaggtaaagagaatgcggatgatggggtagtggtagttgaaaaataaggactgataggaaaattttagattcgctgaatattacatcttttgatatgtagttatgtactatgtagaatttgctatcaagagagacacttacagcctttacgtagtgcaaaataccccagaaaaatgcattcagttgagtgaaaagataatttatgtgcatcatagggcctcatgaatggataacatgcacaacctaagaccctaactaaaatgatagtctggagcagacttgaataacactgtatggtattgcatcgttaagttaggaaaaaggaagatgattcattagacaggtggggtttagaaaagcatgatttcttctacagaggaccaccacacaagcctcttgtaactgctaacactatgcttggatttatgttctgaggtcccaaacctacgtttataaaagaaaaacatattttcatacagatctaattaatggttcatttcatacactaagaaaatattaaattatttctaattaaattaatggcaacaaatctaatctgtcaattcagaaaataactctatatactgatttaaccaaatatttaatttgtcaaggaccagtccatacatctcaggaaataactctactaattctaaccttggataaagtggtgaagcagttaactatggtaagctcaataatgcaaggtgctgtccgtacattttgtgtcgactatgatttagttctttcagtaatcaagttattggaactacattttcttagctattatgtctttaatacttatcgaaccattatgtataattttctctctcagccagatagatatataacgatacacaaaactttaaggcaaagctgaccaagttaagtggcacaactctctttacacaattaagtcataaatcagattcacacagttctacagttcaaattatagtaagtaacaaacaacatttcaatgaagatgaaattggacaaaactattcactttgcaactgtataaatcaattatatgacatgttcttatttacttgtatacaaaaaaaaaacaagcatgtgactgaggaaggcaggcagggatgaacaaaggaaaagaaagaataaatttttcaatctgaaaagataaaaataattaaataaataaataaaagaatttgtggtttgattagacagtgtggagcacgacagtctcaagtgagtccgggacaaaaccaaaaccaaagagcacaccccattcaatgccttcaagaagtccattttccgtagatttcttcctcgtctaatccaagatgaataacacatgcacttgacattattaccatactagctgagcacatgtttagtagcttccattttttcaggcttcaagcctaacttagcctggtctaaaattggcgatacatcacgtgtgcaattcagaagataaagttgtaatcagagattcccaagggttggaaggcttcaactatggccttatcgatattcttagagatgaatccaggaaaggagacaaaaagtgagtccaacttcgcgatggccaataatagccccttcagtgtaaggatagtttgtgcagtccagaaaagctgaaacaaaggcttttcaattggtaaggggtctgatccaacaatgacaagctgcaccatctccaaacaaggcttgacccacaaggctatcaatatgggtgttgggccgcaagatgtgactgcggtgatcttagaacaaacgaaaagcaagctagcaccctagttgttttcggcaaggtctttggccagaagaagcaccgtgccattggcaaagcagccttgttggtacatcatgtaaatgcttgacggagggacgaaggccttgtagtttggtgagctggtaatcaacatttcctttactaaatccaaattcttttgagttccaaaacatctcaagtcttcaatctacaagctccatatcaccaacgtgttggtggctataacaatggtatggcaataatcatctgatgtggttgagaagattgtgttagttgtagtgaatatcttgatgtatattaaaattttaaaatatttaaaatttttatttggtaaatcttatataaattttataattagatgaggttttaatttgaattttaaatattttaatattaacttttaattttaatctaactgataatttgatgataaattggtgtagtagattaaaaaatcttcaatccaattgatccaactctaccaaaccttgcttttccctctctatcttttaataatattggtgactttttaatatttcatttatcttttaaataacttctaaaatattttttgtttaaaaattaaaaaaattctatccaattacttaattaaatcaatctaatttttttggaccgattaattttgaaatatctaattgatttaaatctattttttttgtcaattttgagattttcaaataaaaataggtgatgtaaatataatgtaattagcatacaatataatgtaaatataatgtaaacatcatatgttaatttgaaataaaataattggtttaaatataatttacataaaaataggtgatgtaaatataattgataaaagttacattatatttcaacaagttccatatacctagttagcatacatgattttgataatatataaatataattcaacggttggatcaataaaaatcatattctatatcaagttataaatataatatgataattgtcaaaattacatcaatataatttgatttctcattattataaatatatttaaaaaaaactagtttgtaaatagcattttggaaaagagctgaaattgtaattaactttcaaaataaaagatgtttttaatagatataattacataaaagtggttttatacaaatatttttttgtatacaatcttagagtcccttcttctaaaagtttaaaccattgaattcttagatgggacatacatggtgatacaagtggttgatgagatgtgttctgtgaaagtgatttttgaaatgattgcaaatcagtgcatgggataagactaaccaaagaataaaaactaaaaaggtattttcatgactttattgatgactacaataaagtagcaataccttgaatgaatgtggtcttattcacacaaagcatacccataacagagtagtggattgtagagaaaaattaacattcacttttcatgacatgggttggatatatgagttaatctcatgaattttgatgtacagttcttgaccaacatttagtatatcatgtaattcattctttaaataaataaaaaaattattttctcaaataattttttaatatgtgctcaataagaatcaaactaacaaaattcaaatattaacaaaatggaagaaactaagaaacaattaatttaaaatcattaatgtatcatcaaaacattctctttgcatatgataagaatgcatacaatatctctctcttatatgtgtataaagtggagcttatggacaatgggttatgtaatttttttaatgtatcaaggtaattgtccaatctcaaaatagaagataaaactcaatcataatagaaaaaaaaatcacaaaaaagaaacaagaacattcaaatcgaaaaggaaaaagaaagatatatgaatcctcctcaatctctatccttgtgttgttgcttcttcctcaattttccttaattatggattctttgaaataaattgtgaaagtctattttaactcaggatctaaaagggactaagcccataacaattaaaacacagaaaataaaccgaaatagagtgtaactttattagaaaaaatgagaaggagaagtaggggtgaaaatagatcagattagacttgcttagacatgatttaaatacataaacctgacttgacttatttacttgttataggtttctttagactttgtctgacgtatttaaaagtctagttctaatcttttttactttcccttcttttcttttctttttcattttatcatctttctttccttttttttctttttctattatcttcctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataatattgcaaaagccaaatggtgggtgtttttggattggatttttagtatggacatctgctatctgttttcattttttatttttagtcaatcttattcaaatagactatgatcattatgaattggatcaaactagttttaaggagaaaatttatttgaattggatcaatctaaaattatagttttactttctttataaatatatattgaatataataaatgaattgattttcaaaataaactctgaaatctaatccaatctaataaataattttgctttctttatttttttctgttttaatttgattagattgaactgctttatgaatattctatgaaaatgtcccannnnnnnnnnatgtagaatgtttaataaggttttctattttggaaagcttcaatcaagccctttatttttttaaatgccataacacgattctttagttttttttttaaaattttttaatgtgattctttctgttcaatttaacatgaaggcattacgtgaaaattttaatagttttaatcaaattaaattataaaaaaccgccactttatttatttatttattatttatataagtaaatttattaagataaacctttttgttatctttggataagcaatttgaatgacaaaaaaaattaaattttcaactgaatatcaatttatctagttgcatattaaattcaaaaaagttttaaaatgataagattttcataggaaatattttcaaattcaaaaagagaagataaattatttatctattatatcaatagacgttggctcctaaaaacactaattaaatgaaatgcgacttggcggcaaattttcaaagaaaccagcgtaagggctctgaataagaagcccgtgtttacgaaaagaaatgccattgacttgagagtttgaagctgataaaagtaaaaaacaatgtctgggtttcctcagcaacataataacgatgggagtaatgatgaggtttatgaatacactcagttctttgatttcgacaccgagccgtggcagaacctcgatgatgcgtggtggacgccgaacgttgctacccaggttcctctgacggaggacacccaacaccaccaggaatcgccgaacgttgctacccaggttcctctgacggaggacacccaacaccaccaggaatcgccgaacgttgctacccaggttcctctggcggaggacacccaacaccaccagaaatcgctgaacgttgctacccaggttcctctggtggaggacacccaacaccaccagaaatcgctgaacgttgctacccaggttcctctggtggaggacacccaacaccaccagaaatcgctgaacgttgctacccaggttcctctggcggaggacacccagcaccatcacacattggcccaccacgtgaaccagtttgtgtcggctccggtcgagttgcccagccacccagttgaggcgctggtgcataacggtggtggtggttccatgatgcagaatgatgcaggttcatcggttcggcgcaagagagggagaggggaggcatggactgaagaagaacacaggtagacttttaacgttgttgtaatttttggataatattgcaaaagccaaatggtgggtgtttttggattggatttttagtatggacatctgctnnnnnnnnnnaataataataataataataataataataataataataataataataataataataatatcatagtgaaagttattattgttcgtgattttaagtatatcttttcttcatttacttagtgattcttatttttaaataaaaaaaaaacagtgtcaatttttagtcatcacatattaacttaactgttttaaaatttaaaacattgacaaacactaacatttttaacgaaaaattaaaaaaatatatttttaaaacataaaacaccataatgaaattttaaaaacataatatataaaagtgaaataattattaaacataatatactaaaaatcactttaaactaatttaaaaattcatggtctcaaagtggggcttttagtatgcataattgttctcaaataagaatacatggtctcaaagtaaagctcccacgaacaacaatttgatcggaaattggagagttggtataattttattattttatcatgttaccatgatgtaagtctactttcagaagaaattgtgaacatcaatgaatcattttttcctgtaagtttaaagtattgtatccctgaactttttctctcatctaacttctccaaaaattaaaattaaggtgtataaattcactttannnnnnnnnnataatattgcaaaagccaaatggtgggtgtttttggattggatttttagtatggacatctgctatctgttttcattttttatttttagtcaatcttattcaaatagactatgatcattatgaattggatcaaactagttttaaggagaaaatttatttgaattggatcaatctaaaattatagttttactttctttataaatatatattgaatataataaatgaattgattttcaaaataaactctgaaatctaatccaatctaataaataattttgctttctttatttttttctgttttaatttgattagattgaactgctttatgaatattctatgaaaatgtcccacattgtctacttgagcatattgttttcattggttatatatcaacttttttttaacgattcgtagttttcactagcctccaattggatcataagtgttctcagtattgaagaatacaaatattacattgtttggatttttaatattttatttttctgttatatgttgtattctcaatttgctgttacttttcaactaattctggtgaaatgtttagacgtgcacagaacaaattttgttcctaataaatttatagagaaagaccaaaatcccttgtgaaaaatcttgcttatcaaacatttggattgtattattttaatgtattttatagaactcaaatgaactaaaacttatcaaattttcatctcatatttgttttttaatggtaggttgtttttacttgggcttcaaacatataagaagggagcatggacaaaaatttcaaggcatgttgttaaaacaaaatcttcaactcaaattgccagtcatgctcaaaaatacttcaatcgtcaaaatgcctcatcgtcaacaaaaacaagaaaaagcattcatgacataaccttagatgacacaaatagcgctcctcatcacattgatccacataattcaattcctcatccagatcaagacattcaacaagttcacgaaatgcaacaaatgttgccgctgaatccaccaaacagcatgcctcatcaaatgagtggatttgaatattctgatattgccaaccaacatgttcacgaaatacatcaaatgttgcggctgaatccaccaaacaacatgattcatcaaacaaggggatttgaaaattctaatattgcatatcaacaaattcatgtaatgcaacaaatgccactgaatccaccaaatagcatgactcatcaaatgagtggatttgattctgatattgcatatcaacaagttcatgaaatgcaacaaatattactagtgaatccatcaaacagcatgactcatcaaatgagtggagtgaatccatcaaacaacatgactcatcaaatgagtggatttgaaaattctgatattgcatatcaacaaattcatgaaatgcaacaaatgccgctgaatccaccaaatagcatgactcatcaaatgaggggatttgattctgatattgcatatcaacaagttcatgaaatgcaacaaatattaccagtgaatccatcaaacaacatgactcatcaaatgagtggagtgaatccatcaaacaacatcatgactcatcaaatgagtggagtgaatccatcaaacaacatgactcatcaaatgagtggacgcggatattttcacccctaaattgtgattaattctttactcttagcatatattgtggtctgtcctaaggtgtagcagtagtgaacttataaagtaattagggattttgataattgcattattggtgcaaattatatttatattcatttgtcattttaggatgtgagatgcgaataaatataaattatctttatatgcattttttttagtttgatataatttgagtttctttaattcaactaagtaatattattgccatagattttatgaaaatgtgtatgacttttctttgaaaaataaataatatgtttcttttatctcttaatctgcaacttgatctgatttaaaattattcttggacttgtgggatttagtagtaagtagagcaattatattcggtgtcattgcgtttagatgctaatgctctattagagatattgcttgacataatacaaagttgttttgccaccattctatttttggaatttcatcatggatatgattctttaatggtagtagagattgtggtctgttttaatgtgcaagagtcatgaattttctttcttgaggtcatgatgtatagtttgagcttgtgtatccaaatgactggttcatttttcttgtttttagagccagcattttgaagtgggataaacattcaaagatgtgagatctcatgactttgataacgtttagtaataatgttacaattcatttcattcttaaaaggaaagataaacttctattttttataataaattttaaagatcgacttaaatatattttagttcctaaaaattaaaattaatttttggactttatatttagtttctaataaaaaagttcttgacttctggtcctcaattgtatatatagataaattgtctgtaagcttaattgaattaataataatatgatacgttcttatttactgatataaaaaagaagcatgaggaaagaaagaatacattttttaaactctaacaagaaagaaagtaaggatttgtggttggtctttctaaatacaatatatatgattagacaatgacacaaagagcacaacagtctcaatagtgcgtccagggccaaaaccaaatagcataccccgttcaagaccttcaacagttgtgccaagtccattttctatggagttgttactcatctgatccaagatgaatagcacacatgcacttgacatattaccatattcagcacatgtctagtagcttttcaggtcgacaccgctggtggtgcaaaagatgagatgggtaatcttggacttgggttgaccccattccttgattgccttagttgcagtctctcttcccaactttggtacctccacaaccaccgtgtcttgccttgcatccaatgaaggtgccatataagcacaaacactcggattctccatcaggatctcttggtttaattacatgcatcgcttcttaatcattgacttatcatgtattattagtatgtattactaatcaaatcaaagatgtatgttgaaaataaacaatatacatattatataatgaaataaagataggctaaatgagagagagatataccttacacatgcgcttgaacttttcttttgagttcggtcatgtgtgctcactgttggtgatgcggaaataatagtcaggataggtactctgatcgacgcagttgggaggagtggcggtgccaatagtcatgacagtggcagggccttcaacactcaccaaccaaatgaattggaaagggaaggtacattaaggtagatgcagggcatgcttccttcctctgactgggcttgtggtgtgcacccaccgcatgtctaagtagactgctgactctccccttatagttatacttataccaacccattttttctgtttttttctttcctaatgatcagcaaataactgtttttttttttttttctttctccgtacgtctttgcaattgctagtcataattttggaattacttttctattgctgctttttaaaaagagtttttagaaaaataattattttcaatcacggtgttgtttttcgtttcccctttagtttattatgttataaattatttttgctttcacaattaagttttgaaaattttatttttgtcttttatgtttttgaaatgtatcattttgatttttttttcaatttttcgttagaaatgttagtatttcgataatttttaaatttaaaaggatcaaaatgatacattaaaaaacataaaggacaagaatgaaattttaaaattgtgtcaaagtaaaacaattataaaatataatgaatcaaaagtagcattaaacattttaagataattaattttacactatggaggctaaaaattgccacggtctttgttttattcttaaaaaacaaataactaaaaaaattatcatcttcttcaacctcttctagatctaaaaaggtaaaaaaaaaagtgcagcatcacatatatggaatgacgtcaacacataatcttgttagaaccaccgaaaatttgtatactcctcactagaaaccaaacctttcacacaattatgctataggaaacataagcaaggtagatcggagcaagagttctcttcggcgaaagacaaaaacatggtcctaactccccaattaatccatatttgaatgaggaagtcaccatgtggttctttgtgagatctgcgagcaaaacctccactattgtacacgtttgagttggacaagtagaggatttctcagttgacatctacaatcgggttgagcgaagacaagtagcacaaagagggcccaaacggtgtatttttttggaagatgattatatctaacttgactgatcaaacctcatctacaactggatgttgtcagtattcttcttcgccttcatcaacgcgctactgccatcatggtaatgagcagttgttgttaggtgaggcaaaaatttcagttgtataaggaggttgcaatggagacaaaagtgagggcaagacaacagtctttatgcgttgacgtgaaaggtggatcgacaaaagaaaaatggacccttacccattgtgattgagaataattagtgaatgtaattattatcgttattaagtaattaaattgaataaagatgatgatgataacaacaacaacaacaacaacaacaacaacaacaacaacaacaacaacaacaacaacaacaacaacaacaacaacaacaataataataataataataataataataataataataataataataataataataataatatcatagtgaaagttattattgttcgtgattttaagtatatcttttcttcatttacttagtgattcttatttttaaataaaaaaaaaacagtgtcaatttttagtcatcacatattaacttaactgttttaaaatttaaaacattgacaaacactaacatttttaacgaaaaattaaaaaaatatatttttaaaacataaaacaccataatgaaattttaaaaacataatatataaaagtgaaataattattaaacataatatactaaaaatcactttaaactaatttaaaaattcatggtctcaaagtggggcttttagtatgcataattgttctcaaataagaatacatggtctcaaagtaaagctcccacgaacaacaatttgatcggaaattggagagttggtataattttattattttatcatgttaccatgatgtaagtctactttcagaagaaattgtgaacatcaatgaatcattttttcctgtaagtttaaagtattgtatccctgaactttttctctcatctaacttctccaaaaattaaaattaaggtgtataaattcactttaacttagttgaaagtcgactcattctacttccttattttcttcaccaataaattcttgttaagaaattttatccaaacttaattggaatatgtggaccaactttatcattaggcaacaacatttgataattacaaatcaatatagggataaacatggttgcaagtgaaagacaatgtaaatagttgaacctagttactgtaaatgttatggctcgtggttaaacaacaaagaatatgaaactctagtaaacagaactgaaagttgtgaatgggcattgcttgcgaatactcacccccattatctttatcttcacattggtatgggtaccaacaggtgggtatacaggaatatttctgttacggcatgagatgtgtgtataccaattattaatattgaataaaataaacatttatcaaaacatgaaaagaaaagaaaagtataaaaattctggtaaaattatgaatcaacttcattcatatgtcctactataatcttgtaatcaaatatgaagaagatccagtaactaaagatacacagcagaacatgccagagtataggtgagctttgtaagaataaaaatgtgaggaaaaaggataattaaatttaaatgtatatctaaatacatctctcaatttctttaccccataagaacctctttaaattttcattttaccaaacgcacagtaacacatctgacatgtgcataagggttaaaacaaggcaaggattaacttatagcagaatatttggaaagaatataggacatgaacttagctaaagtatagcaggaaacaataacaaagggtgaataagcctagatgtcatctgttgtttcattagcattacaatgaattgaattgcacattaaagaaccaacagaaaattactccttgaatatttttttcataggcttcagataatagatggtttgaatagaagcattaaagcatgtattggacaaaaaatgtggcctttacactcgcagcttctgagtttcatagttcagtacagacgaacacaaggaacaaaaagcattatttatatcgattagttacactaaaatattataaactaaacatagtatacaacaatacctaactgaagaaataccaattaagaatgcattcaacaattatatgcacttttcgccacttcttgtaacagaaatgttcctggactccccagcacagataaacaaaatggcagagatacatcatccatcaacaatgaattgatcttcttgattatctccctcaaccctagcgtcactgtgaacattcacatgatgcaaattttgcatcatttgtgaaagataatggttgctagcactagtatgatcagataggccagcaggttgggcaggccactgcgagaatataccaagcaattggttagtaagattttgttgctcgtgaagaaaacgagtctgcatctggcccatttctgctcggtgctggctcagcatctcgtcaaccctcttcttccattccagcctcctgcagttcattctctcctcccattccctctcatgaatcaactcttcctctctccttttcctttccatatctccgttttccttttccatggcttcccactccgccatcccctgcctcctaagcttgtccctctccttctccctctcttctctctccttttccctctcttcaagcttcctttcccactgcttatcaagctccactcgcaaattctccctcctctgcctctcgcgctccctctccacctcgcgctgctcgaaccgcgtctccatctctctcaactgccccagttggttagcaagaattcgccacgccttcttctccatccccttcaccaccttcctcttcttcttcaaacttgaccccgtcacctccccttcctcctcaaacacaaaaccattctccgcagcatcctccctctcccgaacaccactcccattgtaattcacctccccttcctccccctcaatctcaaattccaaccccatcacctcattgtccaccccatccaaagcagccccaaaatccccatccccagaatgacccatctgcccaaactcaaccatatccatccccccacaaccagcaagaaacccatccccattatccccatcacgatccccgtgatccccatcctcaatccccatcaactcattcccaccatgaccaccaacaacaagtgcaacatccccaaacacatccttatacctaaggaagttagaccaatgagtaagcccctccacccaatcaaactcactcccctcatcacaatcccctcctcctccggaccccgaaaactcaggcctcttgatcttctgcttcacaagcaaatactggtgccgcatgttctgcaccttcgtcgaaacgtccttccaactccactgccaagggtacgcaatgggatcgcgcacgtggtgcaccgaattcacgtgacaagcaatcggcttgaacttcttctcccgagtccgcatcttcgccagcgaaccgtccgccaccatctccccgtacttgtcgattagggttttctcctccgcctcggtccatttcttccgcctgggaggaatcatcggtaaccaataatctctacgccgacgctctcgcgatgtttttcctcttcttcttcctcctcgtctttttcttcctccgcgagcaccaaaaccttttccgatagcgattctgattgcatcgagaacgcgaagatcgtgcaggttgtttcaatttttatttttatttttatttttttgctttttcaatccacgattttaaccaagcgattaaccaatcgaatgattctctccgaaactgtaaaaataaggaaaaagaagaaggatggagcttgcttaccttttcggagggagaggaggagcggagtgattttcccggaaagtgaaattttctcaagaaaataatatcgaaataataagtcactggggaacgaatgaagtgacgaggagctgactaagggatcgacaaccgtgttcgattcccttgcaaaatttcaaagctgagactgaaaatttcccgaccaattttattttccagaataatagcaaatttttcagatgatttttgtttttgggtttgtatatctgtaatttataataattataaaatatgaaaagttttgttcagtcttgtgtacatgccggagtggttatcgggcatgactagaaatcatgtgggctctgcccgcgcaggttcgaatcctgctgttcacgcttttagctattctattttctgttactttgcaacgagatttcttgcatcctctaatgctagcngcatgactagaaatcatgtgggctctgcccgcgcaggttcgaatcctgctgttcacgcttttagctattctattttctgttactttgcaacgagatttcttgcatcctctaatgctagctagttttacgtaattacaactttgtaaagtttgtactacttatttttttttttttacttatgtaggagttggatttgatcaaatagtatttcacacttgcatattgttttattttttctaggagtaaggtattttatagtagaagtgattttgtttctcttaatatttttttttcatatacataattacaaaatcaaatttttgttaacatgttatgtttgaaaaattcaatcatctatcaattatgttaattttatcgattcattgtgttgatccttaacaccttatttatcaaattatttaaaaactcaatctaaaaaggatttatcttataatttgaaagtaaaagtgcaccactttatttaacactgttaactcaaacagtgggtttgcaggtgaaattcctagtatatttttaacatgtatccttatgcataatgccaaaaccttatacataaggatacaattaaaattgtgtatagtgtgttgtgtaggtgtttggcaattgtgtaaaatttcataattctactgttatggtctttgatcattggttatgaaagtagttcctttagataagagatttattagtaacgacaaagtaagaattattgaagaacgtaatgttacttattatgtctacataatatttttcttagatataaataatttaatgttttggaagtataattgtaaaatttagtttgatcattgacccagtcgagataatggattactggtccaaccgatggatcagtaattgactcgatttgacttaataaatattaaaaatctaaaattatatatgtatctattatatataaatatataactaatattatttgagtaagaaaagttcattcatattctaaaatccaaaataataattgataataataaaacatcaaaaaaacattgtagagatggttcattttttttaaaccagatggaatggaccagttcaacctggatttggtgacctaacctatcagatttgaccgggtcattacgggtcaattgcgtaattggtccaataataaaattggtctgattaggccaccaaagcagaattgaatcaatccaatataaatgtaagaattcagccctagttcatcaaaatatgaactatgcatattctaactctggtttttgctttcaatttcttacattttccttttttcagcagtagtataaaatattaaccagtttcattagtccattcttttattgcagcttattagaatttggatttaggatcaaattccacccaacaaaattgacttaaagacgaggattgtccaaattttataaacattaatttagccttatttttagtcaatgtaggactatatgtctatatctacccgtcacacctatcagaataaagatgcatgagacagcaaattaaggcaggccaagggtgtccgcaattaaggcaacacagttgttaaatgattttctttatttgtatgctcgttcattagtgaattgatgacaaaggattatccaatgtgttaacattaatattaacagcatattcctttccatctgtatgctttgtgacttttataactattttcttctacttcttttaacttactctcctatcaaacaattgagggataaagattactgatgatacatatattcttatttgaaacaatgttacagaattgtggcgcttttcttgagaaggatggagcagggattagaggtaaaataaagatcacaggattcgaaaatggagatatagatctttcaaaatcattatggacctatcaggtccataatatttaaaccctaaactgatccaaaagaacaatatgaaatattagctggtttttagaggaaaatactatttgatgtagtacactacagatgtattctgtaaatctgtacagttagtaaatatacagtaaatacaccggcccaagacacatgttttctctttctctggttttctacatggtaccttctggaatctggacatattacaattggtcttctgaattcaaatgaccaactagcaaacattttctagggtgagtcaattagttagtccatagatagtgtaagtactaggtgtacataagctatttaggtatactccagaagcactctctttgtaaataaaccggtatagttagtataaatattgtaaggactgaagccaaacatttgtgtatttccattcaataggttcactctcttattctctccagtgtgtgtgtgtgctctgtgatatggatactcatttctgttattttggctctttaacctttaaaataattagggtcagcaacaaaggacacatttcaatttttttgtattaaaaaataaaccacttttgtcaaagtaaataagaactgcaaaaggatgagtgcagtaattattgattatatgtaatccaatcagggcttgattttgagctatttgggaattcatgctttagagatgttttggtcttagtgtcttacaatatccgtaagcaaatgagaaaggaatttttttctcaatgtgcttgagtgttttttccaccaagcagattggacttatttatattcaagagtattccaaagataagcaacgcccaaacaatttaccagagaaccatgaagataccactacttcctaagatgcattaaacctagctataccagaaaaattctgatggcaggcagataaagttgagggaaaagttctgacagtgggcagaaaagtcatcggaaattatgacaattactggaaattttgctggagaattctagaatttttggacgtctgacagcttcaagagcccaatcagaccttctacagagaccattttttttgcagaaacaccccctctccccagattaggatctttaataccatgtgagaaaatggggggcaaaaaatctcaatgtacttgagtgtgttttctttccagaagaatgagcttatttatgttcaagagtattacaaagataattaattctaaaataatttagaagagaatagttaagataccactaccttttttttaaaggagatgccactacttcctaagatgcattgaacctacctataccaagtacctaggctacttgctaaaataaacattaaaagagctcttatctcctaaaatattcctaattccaacaatatcttaccgtagtataaattggattgagattctatgttcctgtataaaataggcttttgaatcttaagtttgggttacatgcccttgtaggaataggttgtttaagttgcctatttgagatttttttgtctttaaggatttcaaccttgccatggtaattaaaagatataaatttggaaaaagtattcttagttttgattatttgttcaatgtcagttggtctttctagttctgccttcactccaaagaaacttaaaatgctgctttaatggcatgttttcttggtgtgtctcaccttcattatctttattctaaatttgtactgttctataattttcatcttcatatcatcactttctatacttgtgagattgtacttttcatagtccgaggaatttgaaaaatactaactccactttattcatttgtatcccaggttgggctttagggtgagttttttaaatttttcagtgaagagaatgaaaattctgaatgggtagagttggcccctgatgccatcccatccacatttacatggtacaaggtaactttgagctgttgaagtgatatatctataagaactgttgtacagtgaaagaaaatagaaaaggaaaagagcctataagttatttacgttgattagttataaatataaaatcactcatgaacctccataagagcttaagcttcttagaaagttgattcttgacatggtattagtttcccccatgaccaaggcagaagtttgatactagttgcactctttttttctagataaagctagatttaagcatgccagaatatctgcaaaatatttataaaacgagaatcatgcataatgattaggataattcatgttataccaataattgtgtcacctaatttttaggagtcttagcttgttaggaatcttactttattcttagagattttatcgtttctttagtaagttatagttttgttatttacttagatttggaatctagtattagtattaataggactatttggttagcattttgtttcatgtcaaaataaatgataatattatttaaagtcttttttttctctcacttatcatatttctctaacaaaatgctcatttcaacaaagcacgaggtaaaatggccatccattgtccatgcttcaagtccaaggtgtcaagaaattttgaattcttggtttctttgattctgttctcatccatatatagtacaggtttcatttacatccgttagtgacacaaaaattctaattccaaatttgtacaacctaaattaggaagtctaattgtgtacaaagtacaatgaatgacctggttcgtattcctaatatatacaggaaacaataataatgactagttcccttattgacatccccgctcaaattgatgtggctggtcaggaagcatcaatttgcagataactgatgacgtggatgaggaacagccttgataaagatatccataagctgaagttgctaggtgacaagaggataggagataacttgattctccaatgcctcctgaatagccgaatagaatgacaatccatctaaatatgtgctcatgaaaaactagattagtagcaatttgtattacactagtattgtcggcatagaaatgtgttgcagctgtttgagacaatccaagctcagccaaaagcccacctatccaaataatttcagaacaagctgtagatatagctcaatactcagattgattgagtggaggaattagagacatgagactgctttttacttatccatgaaattaacacaggatcaagaaacatgcaccatttatgtttaagctacaaaatatttcctacagtagacaaattcatgaataatataaagtgtacggtcaatgaagaagatgattataaatttatacgcatgctgaagttctttaaggaaagcagatgatttggaatgaatattttatatatgcccaggacatttgtttgttctgtgttgcctctgaaattgttcaattatctatttattgtaattattatccccaacgcacaactacggagtgagtgaatctaaaatcatgatacactactgagattttatgaaggtgctattaagcccactggtcattctttcccaatgctatttttcttttttattcgaattcagaaacaacttctttgtatatgcaaggataagactgcgtacaatatctctttcccttaccttcatgtagtaggagcatccggataatgagttacatagttttttttatcacaacacaacaatttaaaaataacacctatttattttaagcagacatactttgatgtccctggtggcagagattcggttgctcttgacttgaaaagcatgggaaaaggtcaggcttgggtgaatggtcaacatataggaagatactggactcgggtttccccaaaaagtggatgtcaacaagtctgtgattatcgtggagcatataattccgacaagtgttcaacaaattgtggaaaaccaacccaaaccttgtatgtagtctcaaagtagctaaaactgttggtttcatgatttcatatgactccaaacgactttatcgattaattatgaaatgtcgctcaaagcatcatttgtctcctgttgatttacacctttatgtacaacattttacaagaaaaacttaaattctcctaaccaatcctaataattactaaattaggaaaatattgaattttttaatattccaattatattaaatacatcagctttttaatttaaaactttccttgtaaagtattgaaagaattattgtaaagatattttaggagaatacagcatcacttattgtactatcatacttatcattgcactttccttaacttctgagttattggtcaatctccaggttccatgcgccatgatcatggttgaaagcaaccaacaatttacttactatcttggaggaaactggaggaaatccctttgaaatttcagtcaagttacattcatccagaataatatgtgctcaagtgtcagaatccaactatccacctttgcaaaaagttggagaatgcagatctcattgaagaagtttctgcaaataatatgatacctgaactgcacttgcattgtcaagaaggacacacaatttcttccgtaacatttgctagctttggtactccaggaggtagttgtcagaatttttctagaggaaactgccatgtacctagttcaatgtccacagtttctgaggtaaactctatattgggtagcttttcactcttcactatattaccttgggggggaattggggacacagttctctgcaagaaagcaaaagctcctcatgattttgctgcaagaaagcaaaagctcctcatgattttggcattgtggacttcgataaaagtgatgatgcaagatattttccaaaatgcttaaccctatactttgtttaagtattacgattacaaatttattgttatcactgattaaacatttctgtaggcactagaaaagtgatgagaacttgtatgttaagtgtaaggtcttggctaatgttgatatgcagcttggaaaaaacagggctgtagtgttatgcgtctttttagctgcaggcttgtaatgttttgatgaaaaatattctgcggttcaccaaaagaagaaaaggggggaactcgcctaataagaatggcccaatacataaaactgaagcaaagaacttacctgtcattcaattttatgaatataatgattacaaatcccctttacaattcatctttagaaagttggttttgggtccaaaataactttctaaactttgggttgattatatttattgaggaatgaaatgattcatcggtcagcgtggagatactccatactaatacatgtctgtatcaggcaaaacacttgtgcgcatggttgacaaaacctaacttttctaggttgtagaccctcttgatatatactttctatattttgcaggcttgccaagggaaaagaaattgctccatcaaaatatcaggctctgtattcggtggtgacccctttccaggtgttgtgaaaacgttgtctgtggaggcaagatgcacaacaccattgagtgatggtttctttcaagaggctgtaagcagcttctaaaacgagaggttcacactagtcaaccaactggacaatgttactgaccacaaatggtccttaattgtgttcaccctattgtgtatatgtatgacacttcgctggatgtcatgatttagtacataatacttggtcttttgactttggacagcaaataaataatctctgctgatcaatgattctcctttgtgcatgcgataccatgggttctttgatctaaaatccaataaatcatacacgatttataattgttattaacgtaactttttaagtaattattataaaattcaataaatcatacatgatttataattaaacgatagtgaaaatattttaaactataaatagactatttactctaaaaataaacagttatatttcatcaactttttaagtacttccaacataatgcttcataaaacgaaaaatattagaactaattttaaaaaatcatcaggacggcaactcttcactccacaccaaaacaggttttccaatagttgtcagaaagcaatttcctagagttgcaaatatttataatactaattttgttcatatacagggacaagcttttaaactattttcaggaaggataaatttagatcttcccttcaagatctttctacaaatcattctatttactaaatacaaaagaattaaatgcattttatatttccaaaacattaaatgcattcactattttacttaatacttagtactttataaagtattaaaaagattagtaagatgaagaaaatagcattagtcttccaagaattgtaaactttccagtgagttttttaaagactagtcaaaataaccttaacgaaggaaaattcctagaggatagtattcacagcgaattattccagggaatgttatccataacccttaaacgttgaagcagacacccatatgaaataaagggtgaatgcgctacaatatcatcataactcataagtcatttatacatcactcaaccagtaagtactactgatgagtactagacagttcaatcggcagatcaatgacaaacacttggctgaaatcacttccgcatttgagatagcaagcattcacatcatacagacgaagagtatcatgctcataacgacggcaaggaaggagagcaagtttcacttcaaacgtctgatctttttggtcgcattgataatgttttgacctatctccgggtgtttaaactccaacaatttatcaagtttaagagaagcttcagagaaacagctatcctcaatacaggactcagatttgagagcaaaatgaacctcattgacgtcctcgtcaagctggaggcagaagaggtggctgaaaacctatgtaagacaacagaaatacaacagtgatattacagaacaactagactctaaatacagtaaaaaagaaacataactttcagttgacaagacggtgttaaatatcttccacaatcaacaaaaccaaaagttatgctgaataaatatttatatacaacaacagcatccagggtatatagtcaacaacataataataagtttcttgttagtaaacaagctaaaatatatttgtgatcactaataaatatccgaattgtgtttgctccttggtaaaaaatttctttgcattgagttttgttttgaaaaaggctaataacaaatgaaaaaaaaaaattcagggagcaaacacaaaattgctaatttataagggactaaaaaaatgtgtcagagaccaaaaacaaaattgttattttatcatgaagaaaaaacgaagaacaaatttattagaaagcaaacacaaaatttggatatttattagaaataaccaacatattttagctacaaataaaatatcagactagaaggaataagtttaatttttttgttaaaatttaatacagaaacaataaagcgtaaagcataaattattgatatagcatttgtaatcttcaacatagcacccatcccactatcccaatctatgccacaatgcaggaatgatacctatgggtacatccatcttaacatttccaatctgaagacttgaaccaactaagtactatattgggattacagttgtgaagttaaaaacagtaggccatttcacaaaggaaatatgctcagataccagcttgaactcttcagaataataagaattactagagagaattgatctcagcagtcagcacctatgaatttgtattaaaggattacaattcaattcgctatataagataagtcctaaattttagaaacaagatataaggacagtatctatgcaaacaagggttcaacaactttaaagtaatagaaatatttcattgaaaatactaatgtttcgtaaccgagttacaccaattataaattgtgtcctaaagtctccattttctagcctctctggaattctaaatccccttataagcacaaaagattcatttggacatttttcattagattagtactctaatgctgtgtagcagaatggtagatctaactaaactttgtctcccgatgtctgtgtaaagttttataaattcagaaataactaacaaccataatcatttctacttctcccagcaactagttatatttgggagggttttctttttataaatattggttaaaccttcaaaatttggagtacttttctttgaaaagctcaccggttttagcaagaataaggtgagtgaaatgaaattttcccgattgtgtatgattggataaacaatacctaaagcacctaagaaactgcatttgagttttgtacaaagagaagagagggaaaaaaaatagagattttaaacacatttgtaataaatatctgattaaacaagatacagcatcagacatcaaaaatcaaagtccaaactaaatattattgcactcatttgtttttacctttttcatttttgagagagccatatccttaatggcttgggaccgtgacaccaaattgacaacaaagagaccatcctctgaaagtttatcctttacggtctcaagaaaagactcatccaaaaaatccagagcagggcatgtcaatcctgagctgtacaaaaaatgtaataaataagtaggattctttaaaatcatagaagataatgatattattatttctaatcccttaatggccctaataccatttttttcttagccattatatgatagtttaatgtcttaaatgcataattcaattcaccttgggtctgaagagtcaacatcaacaataattatatcaacttttgtcacttctacaccagcatgagacgcagttgaactttttccatgaatctgaggtgctccagaactgtcaatctcccggacaaattggatcccatcagctacatgcacctggattctccaaagcaacaagattcaatagccaatgttgtgatcaccccatcacaagattaattcaacaaattcttatattatattgtggttcttagtattctgcacacagcccttctccctcccaacaaataaaaacagaagtcactttatctgcagttgccatatttttattgccatccatattttaaactggtgtttaaacagcaaaaaaaaaaaaaattcatgaaatcaaaataattacttgcaagagtcaacattgtatgattcaagtaggcatggagaatcttttcttaaaactagttactgtttcatgtggatatttcctttgatgtaagttagcaatctggctttactttggttagtcctaatttagatttacacccccacaacacctcaagaggaagacatgaatgtatatttaactacctttaggcgtttatcctcaaccaaactgaagtagtcccttgcaatatcaacaatcatggggtctaactccacagtctgtagataaaaattattatcaaaccatgtcatatgaatcattcagaagaataaatcattagggactaaatctgaactctaattatatcccctccctaaacaacaggaaaaaaatataaattacctcaatttcaaaaaaggggatacacccgtgaagaaacatgggaagtaaaccagctccaagacctattattactgcttttacctgagatatgtcacttgaatgcatcagcaataatgaatgaaagaatgttttagagcatctgaagaaagtgagacaagttaatttgccatgtatttacaatttgctattattggaaactacagtccttaatgtaccaaggaactagtagattcatgcatcacattaaaagtcagaaatacttgccattttcccacttgatgccacattttccatgtaagaagatattagcgtgaatcctgaaataatccctgtatgataagaactagctacatagccatgatagacggtcaactggctgcttgctcctgcaacatcggaaaaaaatattacaatggcaggagttataaacaacgagcaaatattgaaaactagaaaatgaatagtttcaaaactgtaaaaatcctctgtttctgttaaaccatttttaaacatcatattcatccaaaaccatttttcagcattagaaaggcttcaaaaaaaactatatagataacccaaaacactgtctacaacttttttttaaaagaaaataaattagcaaaatgaaggataaattaaaagagatgattcctcttaggcctcgttacgtttacattgaaaataaatttcacataccatgtaggcatgcacacatcccaatgtaaaatatacagctatgattaatttggacacacatttcaatcatgttcaatggttcaaaaccaattctacaaaaatataaaataaatggaaactttatgatatacaacagtaaattaacaaattcgggatttgacaataatgttgaagcaacacttacaggagttgaacagtaatcttaaataaaccagaggcaagaggaaaacaattaccaatactgtgtctctgagatccactttttctagatttggaagatgcattgtttttcttcctccctgtctcactaaccaatttggtagctgactgttcatcttttagcagagcttcagactgcaccaaatttgcagctctctcaaatacaaggcgtcgaaacaccaactctctagaaggaaaaatacaactgacttcactatcaacattttcataaattacatcttcaacaataattgatccagttaatgaagatgggacctgcaaaacacataatcataaatgatataatgagaatgttgggatcattttaaatcaagcaaagccatcaagagaatgagcatccatgtaaaaagtaggaatcacaaaagcaaaaagactagtgaataaatacatttttgtttcttattgataaaaacagcatttcaaaaaacttaatagaataaagacgtgaaattactcttagatcaataaagcgggtggataaaaaaataaacataataagaaatgagcccagtaggaccccaactccctctaatgaacaatggaaccaagggctaaacaccataaaaagaagctcagtaagaagttaagaatgaagtttcttgcagaatactagagttaatctcacggccttaacagacagagagttcactagatcaaaataataaaatagagacagtattatgtatattgttacaaaccttgtgaatgatgtttcgctccttgatcccatcacttgccatcatgaaactgtagacatttattcaagaacttgtgagaaaaactgaaattcatagtgtttaaatgtgtgtttggttcagcctatgtttgccaacttctagaaagagattttggcccaaaaaaatattacttccacaaaaataatctgaaccaaacatgctataagtatgacaacagcacctgaaaaaaaatggtttacagtatagtaattactgtaattcacaatggaacatgtttgaatgttttggcatgaatagaaaaacaggagagaaaaaatgaacatttatgttaacattgctcgaaataaatgaaaaatcacaaaaatgcaactggtacaagatacagacggtattttagctccattctcattttctgcaggtgccaactgcgtaaccaatggagacaaatccttctgaaaagggataacagacacaattcagtaaaaagcaacatggttaacctgttataatggcacgtccatgaagcataacttatgaggatgttctacctgaatctcctccatgctggtatccgaatggctggcatccaagtaaacctaaagtcatggatttgcttggaagcttcaattagaaaagtaatttggcatacaaaaaatacgaacaaattataattttataaaattaatagcatagtaccattatgagacgagctgctttagagcttctgaccaccatccactgtccttcttcagaatagaaaagccattcacgtgcacgagtctgagatttaacattcaatcatgaaattcaaacagaattactgcataatttgatgccctaggtgtaaactgcagatagatataaaaaaaaggaaatctgaaatcctgtggaatcagctccataaatgaatattgatgcacattgcaatccaaaaaattaaaaaaatcaaatcagatgaaaaaaacaaaaaatgaagaacttgagaaatactagaaactccatatctgccaggtaacaaaccagtgtccctaactctataataaacaaataatcttatcctatatgcaacacagcatagtacaactgatgaactgaatatatattccaaaacaaaacaattacagttttatcattttcagtatgaacaaggttgagactactaagaatagaaattaaaaaagaatcagaaaatttgaaaataacaagtatccaattgtccattgtctttcctagtttcaaaaaaattgtcagcagcagattctagtcaaaagcaaattaacaatggttctttacttccaataataactatttcacatttattcatttgttaaaactactgtgcttgaatctccagagaaggatcactgattcattttgaaacttcatgagcataccatgcgagtttttttttttttttttcttgttatgaagttagaaggaatgcatgaacaaaaatctaaagggatctccgctaaaacacaccttaggcacaatgaaaaccccacagtgataggtaaatgggtcggcctgttcctcggcatcaagaattacagctctgtaagaaaaagtggagtacccttgtccacccagagttagctgcaatcgccgaccttgagaaagctttgtcaactcctcttgcagatcttccacagaatataatatatcagagccactggagtatttttcacgaatttgattctcattttgaagagcctcatgaagtccagaaaccttgcacaaatgtgggagaggggggggacataaacataagacctaattctctgtacaaataggcattagtacttcataaatgtcataatattcagagcattttctctctatttccccttccctgcataaaccctacaacctttaacaaaataactaccccttctctgttaataccctagagtaatactatctatagttatatacgactaacagatgtagcattaatcatccataaatccttatttaaagaaaactcttatgtccatgagaactaaacagaatgtacaaatagcccagatagtctacctgttttgaattacaatgaagtgacngggggggggggggggggcaagacataaacataagacctaattctctgtacaaataggcattagtacttcataacttacacacatcaaatcaatgtcaaaatattcagagcattttctctctgtttccccttccctgcataaaccctacaacctttaacaaaataactaccccttctctattaataacctagagtaatactatctatagttctataccactaacagatgtagcattaatcatccataaatccttattttaagaaaactcttatgtccatgagaataaacagaatgtacaaatagcccagatagtctacctgttttgaattacaatgaagtgatgaattatggagcaatgatgtaatctggtgcactaaagtagacagctccttctccacaaccaccataaatgtttgaaggctaggtttaccagaagactttaaaggtatggcatcaacactcattttccacccaagtcggaactttgagaaaagtagatctggaaattgtgaaatagtgatatttatcctccaatgataccaaaccaatcacgtaaaaaatgaaaaagataaaatgcaaaaacagttccagaaaatcatttcattgcaatgcagagtaacaaagcacactgtccaagtgcactacaattaattcttaaggtaacacaggatagcttcttggtagcatgtttcttttttagcaagacgtccaggagttaggaagggttttgtgcaaaccctcttccaagtatcattcacattcaagtattattttcttatggctaatacacaaaggaaagtctaaaatgtgggtaccacatatgaaccttgttccatgaatctttcaataagagtaaaggaaaacaaaacgtctgcaattgaaacaccatcacaccttcttagtgttttcaattgtattctctacgtatcacacgtttttctcttattattcacggtgaaacaaaattaaggaaacttacttagtacatgagattcagccaaggtaaggcacacaaactttcccccaggctttaaaactctcttcacctgacaaaaataaaagggctaagttaccaaaaacatgaactcgtaagaaataacaaagtagagaaacgtacctctgataagtactggtttcccaatttcgggccaagttcgggctccatcaaagcatccagtccacctttgtcaataaccgcaccgaagctctcatcctcgaactgcatggcggtcatgtccatgatgcgccatcgcatgaggggacggtcgcggacgttgcggcggagcatgtcagagatgacgaccttggagaagtcgatgttggtgatggcggtgtggccggcgtcgtagaggtgctcggagaggcgggagttgccgcagccggggacgaggagctgaagcgggagaggaagggttttgaggagggagaggagtgggtccctgaggttgggccattcggcgtaccactcgaaggaatcgccgcggagggtgaagaacttgtcccagttctctttgctcgtgaagtctcctagggtttccagaatgtcttccggtgaacctttcttcttcccctttgaacccattcttctgtcttctctgcttccgctctcactcacttcacaaacctcttttatactgctgcgcttcacttcacttcactgtcttctagtcaagacaacttactttagcctaatgtctaattaattaaccctcctaatctcatatattttaggaaaatcatcaatgtctcactcaataatcaaaatttctccaccacaattaatcatttttatcttgttcatacatatatatatgatccaaataacataaaagatattatattaacatgtatttatgagaaaaaacattaataatgatgttttaaaaaatatataaatttaaaataactaattttttaattatgaaaaattaaattgaatcttatatataagaaaaaactataactaaattaaacatttcaatagttacataatattattaaatatttatgagtaatatttaataaccttaaaaaaattacacaatatttaaataacttcaaataaataattatttaataaataataaatttaacaataatatttattattaatttaacgtgttaaaatagagatatcatctattactaaaaaaaaacaattatcaattcaaaaacttatttttctttattagtattttttaaaatttaatttttaaatcccaagggagggggcaaggctcctctactcccacccctcagatcagtcgttgggttcaatcaagattatttatcacaagaagacattttgtattgttaaaaattgctaactctgtcaaaaataaaaaagaatttgctaagcaacattacaaaataagtaacaccaacccatttatttcaattgagcaccattgattaactaagatttttttaagtaaaatcatggacatattaactgaaatagcatgtgagagccctcaagtcatggtttacaaagagttggatttgaggaggaacttccttaatccatatccaatcaaaagtagaaaaagtagtcctcgctagacggtctgcaacattgtttctcgttcttctagtatgaactaacaaagtatcgactccaatcctgtaaaacatcctctaaatgtgtagaatgttataggaatttgttagaggatttcgcaaggtgctgattcaaactgactcaaactcagttgtgaatttggttatgaagggagttggttggtcccatcactcccatgtgtgttttatgtatacataatggagtattttgacatcattccctcttttcttgctccagtcttattggctgatgctagttatgtaaattggtctgggctagtttctgtttggcctttgcccatgttttaacagaaaatatttatttatttataataatttataagctaaaaagttttgtaggaaaatatagcaaaaggatatgacattactcttaaccgtggtatcgaaagtacaaattaataccgctaattatttgaaaatcaattcaaataaaataattagaaatgagatattttacaccggtgtaaaactttataataaagttttacaccattcaataactttttactggataagtattttataaaattcatcgttagattgaaagtttatatcatgtagatcacatatatcaaatttcacaaaaatccaaaatcatttgtgtagtgatatcaaatagtctaattttcacatattttagaaatacatatacagttaatttatatatatatatatatataaatatcaattagggttcaaatgatttcgaatttttgtgaaatttgatacatgtgatctacatgatataagctttcaatctaacgatagattttgtaaaatataaatacttatccttttacaccagtataaaaggatttcatttcaaaattaactataatattagtcatcaatttgatgacttgacaacaatgaaattttccatgttttaataaaacttttaattagggataacagcgttggttcgctttcgcttgaccttggcacaaactaatagagcattagcgtttctacttcgtatcactcccgcaacccttctggattctgactgtgacattgattaaggagttcggtaagttttcatttttttgttcaattggaattggttcacccacatccttcatcctctttactgagatgggtgcactgcaaaatttcattttaaatctttgattctaatatttctgattttgttgtgttgttggaatagaatagtttactcgtgagatgggagagttggcgactgagaaacatgttcgatatatattatcagttgaaaaggtgtgctgtgttacccatttatacatggatgctttgtaaactcttctttaatgcttaataggttgtccttttatggtttccagagaaaagataactttgaatctgtcgtaatggagcatctaagaatgaatggggcatattggggattgaccactctggatcttctaggaaagcttcatactgtcgatgttgatgaggttgtttcatggttgatgagttgtcagcatgactcaggttcttcaatgttttatttgttcccttatattcttttagacatcagtgtcattcatagtttcttatgagaaaatgtgttgttgtgaagggggatttggtggaaatgttggacatgatccgcacatcctctatacactaagtgctgtgcaggtgttggctctctttgataagctggatgttattgatgtagataaggtcacaagttgtatccttacacacatattgcctcactttgaaggtcccgttatctgtattaacaaatattttatgctgcagaagaagctttgttatttttgcaatttttttaactattgtagatctgttttttttatcaggatatgtagcttcagttggcaaaatactttgatgttatgattcaattgcttgatatgtttcttagaaagaaaaaattttagtacagttcgatactaaaactacaatagtaaaatttaataaactagaaagcataccggatcttgtgtttcttactatttatgtcagatattgtcagtctgcaaaatgaagatggatccttttcaggggatatgtggggtgaagttgatacgcggtatttttcttacgattcttttttattattgatcatgtaagagcttactgtatttttaactaaaatccactgaattatttgtcctaggttctcatatattgctatttgttgtctatcaatattacatcgcttggataaaatcaatttggagaaggctgtgaagtacattataagttgcaaaaatatggatggtggttttgggtgcattcctggtggggaatctcatgctggtcaaagtatgccataaattattcatgatctttagttagttattaatttccctacgttacttattcaatgtgtgtactaatactactttttcctttaaagattgtgtgcttctttcccacatgaagggagtgctttatgtggtgaagggcatagtttgaaattttaagatgttgcttaaatttgtgggtataagaatcaattttctccttggcagcacagtatagctatgtaacctagtacttacattatccaactacttggtagttttcctgataggaatgatgtactttccttttgttcttttgtggtcaaaatttactcatgttaagcctgaatttgtctgtttaatttttctgttttctgaatttcaaatgaaagaatgaaatgggttgtggacttaaatcatccttctaatatatttgcttttactattgtcagttttctgttgtgtgggggcccttgccataacagggtcactagatcttgtcgacaaagaccttcttggttggtggttatgcgagcgacaggttaaatctggaggtctgaatgggcgtcctgagaaacttcctgatgtgagtaaatcttttcaaatttaggtttagtgctgtagattttcctttctcttactaggttttagatcttctcaggtctgctactcatggtgggttctttctagcctgatcatgattgatagggtacattggataagtaaggagaagcttataaagttcatcttagactgccaggttagttagttgagtgtcttttctgtgtttataactctgcattcttttttctttttggggttttaattattgtcaggtagtatttctgaaatattatgtatgttgaaactgtaaggacacagaaaatggtggaatttcggacaggccagatgatgccgtggatgtctttcatacattcttcggggtggctggtagagtacctccatcatttcacctttttttgttccatttgttgtgctaaaatcttgttatctaggggttccttggtttgtatgggaaccacctaatctctcccattcccatgactcaatgtgggaatgatattaaccagtgacttcattcggtcatcctgtttctaaaaagagagatgaaaaaccatttttatagaatccttgtggattcatgttgtgaagttgctagcattatgttccgaattcagataagattaatcgtattgttcaacatgcttataataattcattagaactggatatttaacatgattctatttttattttagttgtttggaaggtttaagtgagcatatatgtgaattataagctagacatcgctatttttccttttctgacagtgcctattgcttttacactgtaaactatggacgcttaagttgtgtttttgcttgcaggactttcacttcttgaatatccagggctgaaaccggtagatccagcttatgctttacctgttgatgttgtcaatagaattttttttactaaataaggacttaagtagttaagttcgatgataattttccagtaatgacaaaatcttgggtttgtaagactcaccgttgggagttggaccccctcctcccatccctagcccaaaaacagttgatttcttaaaaacagtgttaacattttgagcatcttttagttaaattgcagtggtacgacatgtaaagattaaagattgatcggtattgtagtcaaccatcaaatttatgttactagttactacatagaagtataatttcttttgttaatatagacatagttatcatgccatcgttttggtgactttgttcttttctaaagtgatttttttctttaaaaaaaggagaataagcagaagtcattcactgaatacaattaaattcaaccttctggtatgattagaacgacttctaagtttagatgcaatgcaagttgcagagtgataaaaaaaactccaacagaagacaagatttttttgttcttttaaaaatgtagattgatcgaaattaatgctcataaaccgtggacagaaagaaggccaccttgggcactgttgtcgttaaaatgattattgccactgctgtttttttggcattcaagtgcttgcttctaccttcattttaagctctcgtccagcttctaactagcctatgtggtcttgaagagttgatatccatgcaactaacggatttcgttcactagattacgtatttaaaccttatttttcttaagaaaaagtgtcaagtagacaaatttactattgtttgcttgcgaattcacaagtcttccaatggcatagtttctgtaattatcaacttcatcattttgacacaactacagaaccttacataaacatcaaacagaccatacctctgccaaaaagattatcctgtttaatccttcattttattttatttatttattttaattctttattttttcaaaaatttattatgataatatatcttttaaaattaatttaaaatgatctgtttatctaaatttgataccattaatgaaataaaagtactaacgattcaaaatcataaaaaaatgtaagtttttttctcatcatcttttcctttctcttcttctctctttagatctcaagctgcagcagtgcacaaccaccgcggccaccccaacctcgatccaatactcaccacaccagaaacccaattgcctaaatttctcgtcagaccttaagctgcaaaatctcctcctcctcgatggcatcgacaacctgtctctcttcaatcctcaagctacagaacatcctcctccttgactcctccaacggcgaagaacaaacctaccactgcaactcttccacgccccattaacataacaacaactcagaacgttcgtcaaccagatttctatcgattcgtgtgccagcaagacgacgtcgtcattttgaggaagagaatttgtagaagcaccactgcagagtgagatagaggccttggggaaaatgggacgcagaaatatgagaccagttgcatccacgtcgagttggggagggaagcgttgtccaccatgtacattcaatttgggaattagggtgtcattttcaatttgaaaatttgttttgtttttcatttgtgacggttcagtatctgtatactacttaatggtgttaactttaatttgacaaaagaatcatttttgaatattttaaaaacataaagaattgaaattatttttttaaaatataaaagatcaaagcaaataaaaaaagaagataaaagagcaaataatcatttggaaaaaaaatagttaatgcaacaaccatgaaacacaagcaacataaaaagaatatctacattatttgtacaagtgaaaagagtaaccatgttgtttggctactagaatttccacccactatgatgtttcttttacatgttgatgttgctgcactaccaaaacacacgctctgctttcaaaatctgatgaagcaagcaaatcaccaatgacacctaactctgaaaattcactccaagttgtaagcccaaccgtctgaggtgggtttaactcatgtcttctcccaactatgaaaaagtgatgttcatttactatttggcgaagaagaagagatgtctctggtccaccattcactatgactttttggtaacttacatttcctaagtgtggtttcttaatatgttttagtgcctcattatctcgtatatactccatgtctggtgtgtgttccttaggagcaaggtggtacacaaccaagttgacccttggattcctcgttgctcgtttggctaagcacaaagcctctcggtcatcttttccgcccagaaaaatcattgctacccgaatgaatgagtcactatgaattgcagaacgaccaacaaggattccaactgagcatggagctatttctaagagcttacaatttaaagccctcgtgttcttgtcatcagattctatggcaccatcaccagaccatcttagatggaatggaagaattataatggatgccactttgtccaatgctaaatgacaaacatcctcatgcatcagggagggtggagatatggctgtgtaaatgtgtgcagttactgcacccatgttgtcatgttcatagaggtcaaaagcaagaataacatcatctgaataagacttgtggccacttgatgaaatcgttctttgaatgcgatgggaaatgaaaatgggagaggcccttccaattagctcaattagatgcaatgcatccacagtgatggggtcttctgttgttggacaacaaaggtcaaggaaatttttcactgcagatacatggtgtgttttatgaaggcaggcaactactctcagctccgagtctggttttaaactctctatgttccttttctggtagccagcgtattttcttgatggatcatacaatagtttcacagaccatttcactaagcttgcaatgaccattatgttgatcatcattactccataagtaggaccattaatagtctgcatgcacatataaatgaaattttatattgcattaaatatagaagatagtgataagacttttcaaactcaagattatggttagttttagggtaaattaaattttatccattgatgcttcacgctttctcaacttactcctatattttttgtatcactaaaccctctgtacctttgtttttaccacatctagaaccgtgactagtgagtctaaaactgtagttaaagaaaaaaaagggagggagggagggtgtgttcaatgacaaaagaaagaattggggttacttagtaatacaaaaagaagcgtagggaagtaagttgagaaagtgtgaaattataagtataatttacccttaattttattgaaagacaagttaaggtggaagtaaatatattaccccttcgtcatataagatgccatagatgccgacttccactacgcctttaacgttcaaaatgaggccaagagtcaaggcatctttgaagggaatcttgcaaaagagggcaggtatagtgcatgctattactttgacaaggtgagtgaaaagagagctgaaagcagtgatcataactacttttgatgaaaagtgcttggaaaaatctgccttcatcatactgcaagttacaaatattggcaagaagaaacagttaccaaagaagtgaagcttcttgaccaatgcagatcctaatggaggtccttctggcacagccaaccccaacataaaagctcctaggatgaattcttgatgtatttgaactgcaacccaacctaatgcaaataccattgtgatgacagcatagacataaccatcattcacaggtcttccttctgcagtacgtttgatgatccaaaacattgctggtcgaaaaaataatggaaccaagatgccaaaggcaatcaatgataccaagagcacaaaaatattctggttttcattggcatccataaagatattggcaacacatataatggttttgcttaatatgtcactcaccagtactgaggataacgccaatctgccaagttcagagttaaggattttaagttcattgaggagggaagcaactactgcaaatgaaattacagtttctggtagaactatagtagtaacattaaagatttgatattcaacaggaagaattaaacgttcaatgctgattatggttggaatacaaataagtatcggcacagccaatccaataatagcaatggtccatgccctgtgtcctgtcctggttatcatgctcaaatccatttgcaccccacttgtaaagatgaaaaatgcataaccaattgatgttattgttgcaagtgtgtcctgacttggaaatgaaaacaatttcctcttgtatttgtccagcatctctacctgaacagcagggcctagaatcaggccaacctgcaaatggaaacaagttatgaatcaattaatgagtcttcctatgtgtctccaagaggacatgacattggcctagtttaacaaggaaatataaagtgagttggatggttaagggaaaagggagaagggatgagagaaaagatcgtgggttcgatccctttgctaataaactaacatttgcagattaaaaaaaaaaattgatttagtttatcagtagttataagtaacaagagagacaacactctatttgtattaatatgaaaaattctggacaaaaaaaaggcaaaatttaataattcagctagatgcaagagtggcatatggatgaaatatgagaaattaacatttttccctaaacaacttttacattgcatgctacacgtgacaaatattctgagtgacctcacctagagagagaaaagaagttaaagaggcaatatcaagattttaaattggtcccaatttcatctgattctataatattgtggaaaattgtggacaaatgcagccgatgtggttacaattacggttatagacactccaaaaatcttaacattatggccgaagttatggttgcaactcgtttttttaaaaccttggctaatactaaaggagtgtaaaggggagcttaagtaaatatggtgttaaaatcttaaggttgataaaagttaaaacagaggtgcatggcactcatcaatccaagattaaaaagaaaacacgtcaattcgtttagtaaaaaaaattgaccacctaatattatataatgcgtgtggtctataatgacctactatttattatgttctatcatatcactttggtcatatatggtggattggttttaggccatgatgtgcagaccataaggaaaatccttttaaattagtttgttctctattttatgagaaacattaattaactatgtgaacaaggaaattttaatttatataggctatggctcaaagataaaagatagtaaaagaagaatacttactatcatttgtgggataaattgagggaagtcaaagctctttaagaggaattggcagatttgggtgatagcaaaaagtacaagcacctgcaactcaaacaatgggagtgaagatttcaatggagtccgtccattaagttggccaccccataagccatctgaaacaatattgggtggagcaacagtgcacacattataggtgaaaaaattgattttatcaaccgacaagaatagggtctcatttgcacttaaattcattcttgctgacaatgccaagttaccaaagagagaaatgagaataaaactcaataaagagaaagttataggaaggaagatggctcgatagccagctgtattggcatcataacttctgtcaccaacttttttcctttttgttagcatgttagagattgcaaatgtgagctattcttcgatattgtaatgcaacagaaaacaactaaattttgtgttagaccacgaggaaataacagcactcaatcccataaataaataatctttagaggttgtatagctattttcaatatatgcttgagacagaacatacctatcagaccataacagtacatatttatccaagtacacagttttctatttttaactttataccattattagatatcttatagttatagctaccctttttataataaaaaaacaaaacaatgttactgctactgttttataccttaatgaaaagaagagacatgaaaggcctttttgcatgtatactaaaattaaacatcttacaaacttagaaatacggacacttctaaataaccatgtcagagtcggatgcatatctatatcagatactgtattgacacttcaaatactttaattaaatttaatcataaaaaaaagaagtcactcaccatggggctcgaatccacaatcacaaggttaagaatcttacactttactaactgagctagatagatacttaattttatttttttaataaaattatagaataactttatatattattttacagttatacaatatcaagtagtannnnnnnnnnnnnnnnnnnnnnnnnnnnnnnnnnnnnnnnnnnnnnnnnnnnnnnnnnnnnnnnnnnnnnnnnnnnnnnnnnnaaaaatttggcatgtttctgtttgttttgtatcctgtctcgtacagtatttttcatgccttgttgtcgaacagtatttttcctagtttacaaataatttttcatgccttgttcttgtactactcactttttaaaggaactaactcatacaaaaagttaataaatatagatttactaacaactatgccatcagtcaaaaaacaaaaaaacaactatgccacatatgcactgatgacaaaattaagtgtcagacttttgcataatttttttcactttttatttcttaactaatgtctttatagtactaattaatttttctttttcagaataatttcccaaattatgtaaccccaaattccataaaatacccttttaattataatgtattttttaaaatttgttttattaaatttttgtaaatatatttatttatattattttctattcagtttattattaaaaaagttttaaaagatggtattctctaaagtagaaattcaactatagatcatgatccatcacaaattagcaactggaaaactaactacttgagaatgaacaaatctcgtctttagatggttactacgcttagtataccatatttttacctcaagaaatttaaaacaaaaaatacctataacgttgtcataattttatcaaaaggaatacatattcccgtagtactgattttttttccaacataaccatcttttttactatataattttgcgctttgcacattcttgcattctctcctcacaattatacattcagtgttgcaccgtaaaaatatgaaagctattaagctcgactcccattggccaacgaccattcaactaagggaggaggaccccaaatggtctcacaaaactcatttaattggttttgaattccaaaaccctaaacaatagatttattaggtgatttttctttttattcttctcatttcacctcccatctttcctctcttaaactgaactatttggaaaactcaaatttcaaatctataagatgcttagatttaaatatattgttaagtttgatacaagtgaaatcatagttttaaaaatcgaaccagtgatcgaatcgatcaaggtactggatcattgggtcaatgatcgaaccgataggttactgattgactcgcatgactcgatatataacaaaaaaatttaaaatttttataacataaactaaataagtttaaatataagaaataaaatcatcaatacaaaattatagaattataattctcactcaataactcatttttagtcaaggaaaattataatgatattatctcatctctatatcatatacatacttatacttaatttattttcattttatattaataatttatgagtattttagaaacaaattttatatatctaaaaaataaagaaaaataaactcctatatacaccatttatctattattaacaggcttaaaaagtattcattcaatttaaaattcaaagtttaaaacacttttgttaaaaaaaaattaacccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacgatgtgacgtgagtgcttggaaggagaagcagaagtagcggacgaagcctgaagaagacatttttgtttttctttcaaatagtgacccagtccgatttgctggatcagcggttggaccatagacccgaccgggtcgcactgggttacacgggataaaaaagatccattgatagactcaaaccagtccagctagcgaatcatgatccgaccggccaggtctaaaaccataagtgaaattcatttaagatgggacaaccatattttcatttcgaaaaaaaaaataattaatgacttaatttatttgagattaaataattaaatttgatcatttatcttttaaaaaatttaatttaatccttattttttttttcaatttaatcatttaacttttttaaaaatttatttgattctttatcttattttttaattcaatttaattttttattctcaacttgattcttgtctatttaaaattgacgttattaataatttaaaaataaacttttttatccaattttctcccttctcttcacttcttttttaacaaaaaaaatattcttgaataattaacaatgtcgatcttaaatggatttcgaagactaatctaacaaaaaataaaagataaataaagataaaggactaaatttaaaaaaaaaaaaaaaaaaaaaccaaatagttgatttgtcctttattttaacaagttttactaaaccgaagaaccgtgggacacgggaaaggaaatgtgctaactgcgagctgctgtagcttcattttctccgcgtgacatgcaggtttgtcatatctttctttatatactgtactaaactctacaaaatttattctgcacttctgttaaatataataaaaacacaaaccattggctcaaaggaccaagcacttcataagtgaagtgaaaactagacgtgcaatagtacaatttacacggatatggaagttctaactagtctaaagcatcagataaactgcttcagaaattctgtagctacaagcctcccccttgtgttcaccgacattttcagctcgcttatctctttatcaatgtcctgcaatttgaaggccattattatactaaattacaaacaattaagcagaactaacatagaagacagcaaatttttaatatttacaatatcctatataacgtacaacagatcaatgaaagtagccactttaaatgttgggaaggtaatagaaaaagcaaacaaaaacatcatcttgctctgtttcagattatcagtaaatcttttaagttgattacaccaaatatcaaccacaagtacaagtaattggcaggaaaagtctgtaagcaaaacagttatacaccttaccctatttgaaagttaatgtataaggtctagtatctaatatctaataaagaatatcaaaacgttgttctatttttttatagtttattttatttttgcaagttatgcttttctttgcatcaattatcctgggagaatcatgttccatagaacctttgctaatgttttccatagtcactccatagatcatacagtatccctaatttagataactactataagccgcaaaataaaatgcaaatccaagtaatagggtcaacaaaattcttgcctccataaattgcacaataaagtcaataagtttgtgcttctgcatctcctcaaagtgataatttgttataaggaagctaatgtcatatccctgccaacagaagcaacaggatgacatcaatgatcactgacaagttactaagacaaatggaactatgtaaattaatgctaaacctgaacaggctttctcctcagtacttggaaagcctcggctctcattgacagaaatcttagaaattttttggtcagtatgttttcaagttcatcagcctgcttcacctgcacaggatgaaacagaataaaattaaaacaacgaattagggacaaattaaatgtgaatttgatgcttgaaaacaaactctcattcaaatattagtttaataaattgctgataaaattaaactgtaaggtgatataaaggaatctaacattataatagaatatagacaacttgttctggcaaacccctataacactcatttgcaactttgcagtactcatcatatatgtggacctcacaaattggaatttctaagattatcggtcctgaccgtaaaagtaaaggcattaaattgaaatttattaatttttggacaggtgccagttgcacaaagtttaaatgcactgtcctaatgcctgcatatcaattccagtcatcccagctgaatttaattttcacttcagattcagccaccttatcagtggtccatccaagcacagtgaaactttttctcttattattttcaaattctactcaccttctctacctacctattttctatttagttattctaaatttccaacacactaagtataacatgtttcaatattcaagagaagtagagactgcacagtacatcaatctgaagctttacacattgttgatatgtagtacattaacagcaaactataaaaaaggaagaagcataaagaaaaatcattaagttaatgaaagatatcctgagctttaatggacagttcatgtcttaaaaaaacacccaaaatttaatagcctccggttaggggaagaaattgttacatcatcgtggacatagactcaattttagatcattttaacaaagcattagtctcacaaaaaagaaaaagatttaccttgagacttatccgcaatgaattgatagatgtttctattaagcatttttcggcctcatttcgacatatcaaaacctgtaaaaacaattgcacacatttttccataaagcatggatgcaaaagtaatatatcacttaggaaggtagagcaagagaagaaattattaagacacaattaccacctacaagagtctgcttaatcctaatgaagtatactcatttagaatggtagactaaaagaagacattaatgcataataaccatgataatagttagcttaaaacattaacctcattgtttacaattgaatgctaggcactatttaaattttaaccacaaattatatgggctatcttaaatctagtcatacagctaaaatatttgttttcatcacttcttacaatttttcagccacttttgcttgatgttttcatctctctttttttttttacatataaaaaaggatctctagccccgcttagcaccccaaaactgtacatcatgtctttgcattcaattaatatttactattatcccaaaaaagtaaaaaaataaacatttatttttaggagcatttgcatcctatctttctaacaatatattatttcatcccacatcctcaccactaaacaaccttctatgttgatctctctctctggcctctctggctgcgagtatttatttatgatacagttatttttctcctttgtttttagacaagtctcattttgtgttatttttcccctttcagatgaaaaatgcttcggaaacaaattataatttcaccttaagctagcattataaattgcatgaagcctccatcacaaggaaaatggtggaataaggtatctgttgaagtccaacactccactcaatccagaaatactagtgtttagagaatatataggacagtgacaactagctttccttctaattggaatctgtaaaacagcccatcacaacaccatcaactcaagtgctgaagcacaaatccactccttccaacaaagagcaggctatctgcaccaaatttcccaagctattacctctgagaaacagatggttaagcctctccaacctattggtgcatgtgaagaagatataaagaaaaggcatttacaaggtcttctaatttgtcaaaatttgatcatgtaacacttcacaaaagctctgagccattaccctcacaagtcacaaatcacaatgaccttagaattccaagaagaaaaatttaaagtaacgaacaaagtcaatagacaacacaagtgcaaagaaggttatcaaacagaagtttggagtgaagtatcacaaatttcgcaaaagctagactccaaaatcctaaatactggccaatttgaagtttgaagaaggaagaggttttataatagaacaccagtctcattcttaacataaaaaacccaaccatgaattatgatttgacttgcctactttctttagcctaaggccaaaggttctatcaactacttgccacagcccacaaggaatacctggcaccctaacttctcttttcatactgtgaaggaaaagaaaagaaaatatcatatagcagtttggcaattcagaaacctagtcacgtaatcttaaatcatactaatcagcattagtaaagcaagtggaaattactacacagtgatatgaattaagatggatcttaccggattgagcaggagttcagggctggttctgcacataaaccaacagagttcacaaaatcgaccacttttgattttttataagaacaacatcgtgtgaatcgtcgtattaaatgtggaaaatgtggaattaaaatacattttttatttcagtatatggttttccattatcaaatagatttagaacagtaatatggagcaaatgtgcaatgaagtaaagaggggagagagaacgtacttgagttcaacctcgggcttgttatgcctttcgacttcttgacagggaaagttctggaagcataacgaagaagagaaaaaaacaacagaacagaacaagtgattattttgttgatgccaaaagaaacgaatattgatagtggcgttgacgaagaaggagtgatacctggaggcacattgcggcctcgagcgtgttccgaatgcaggtcaagtataaccgcaacgtgcttgcctgaaacgtaaaaagggtgtgattaattatacacaacagagattacttataggattcattgataagggcgtagcgtaccatgaggttgggtctgaatctgaagaaacgctgcgtttcgtttgggaatgagtgatgatggaatggaacaggagtcgtagagtgtaagagaggattaaaggaatgaatgaaagaaaaaggaaagcaaagctaagcaacaaaaactccgtccagtgggggatcccaggaatttcaccaactacgcttttctgctttaccagattcgcttcattgcggtgcctttgacggattatgattgaccccaacacacaaaacaacaatgatgttcatgtacacctactactacttccgtagcatttttattatctcatctgtttggtttagtcttataagcttaatctttatagtttaataatcaaaaaattaaggcttaaacgtaattttgttccctttattttttaaaatctttaattttaatcttctgtcttaaaataaatacatttagtcctcatacttttaaaaatctataatttttatctcctattttaaaataaatacatttaattctctaattttataaaatatacaatttttgttaattggtaagaaattaatttggtgtgacccaaatttagtaatgtgatataagattattgtttaatttacatcataattaatgttaatatcttagtaattaacacttttagtttgacggaagattaatatcacatattttatgaatgtgaagaactaaatgtttatgttataaaatagaaaaattaaaattacggattttgagaaaaaaaaaataaggagatcaaaattgtgaattttagaaaatataaaaattaaatatctctaatttaaaaggaaaccaaaattacaaattttaaaaaatagaaaaatcaaaattatatttaagtcaaaacttaatttatgtgatcaaaaagttacaaaatatattagtttttcataaacatttttattatttcatgtctatcattgaatcatttgcttataaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtgaaggttgtagactttaatagcattttaaatttggattcggagcatatctcaaacctacaaaatcaatttataaaataagaattgtcttttatatattttattttggttatataatttatcaatgtagaatcttccacaaaaataattatttttttaaaagattcttaaaatagaaaaaaaaattcctttaaaataagttgaatcaaacacaaattacaaaaaatacttatttgtcaatatggaacatttataaatgtagaacaattttgcaatattatcctcgatttcacaattaattacttttatattttaaaataactttatacattaattttagaataaaacctcgttcaaattcttaaaaccataaacactaatcactttatcattttgatgcgaaaaatcattcatttaaattttttattttaaaaacaatattacttcttaaatttgatttcaatttactcaatttaaattttaaatattgatacattataccaaaatatatctttcctttccaaatattgatgtgtaacgattttgataacttatttctacaattttgtcttcaattttaaaatcttatcactttaatttatttttgtttatacattacattttatttaaatttaaaaaatatctgtataatactagtatatggataactagctttacctaatgtcttagcaatgaattggtcattttagagtggacagaattgaatgtggtaaggttaaaaaaatacctagagtataaaataaaaaaataaaataagttcctgctattataagcgtacttcacccaagctcacattgacccctccccccaagaaaaattacgtacaaattataagttaaaataatgaataaactgaattaagtgacggtacttcacccaagctcacactaagtcatttacaagcactgaatttgaaagagaaattagagatacaagagcaaaatgcaacatttagactgactgtacgcgaaacttgttggcaacatagagcaaatgactaatgtttgtggtgggataattttgcagcaacttgagattagaagtgaaatcacccgcaaggaggcgcttacgaacgagaacaagcattgcacagcatacccgaagaagcgtttcctgcagagttaagtgcgaagtagatcaccattatgaaaaaaacaacttggaaaagcagtctaatagcaaaatatattgttgataaaaacttaaaattgtcttgatttactcgtcaatggtgctcacttgaactatactatactcatgtagagccaaattctctcctctttcttttgtcaagtaaaagtagctttatatttttttttatacaagaggcagtggaccataagtctaaatgcaagtccatcatagtacaaggttaaatatgaaatgtacctgtggaccatctggatcgcttaaaagagtatcccaaatgtgaaggctgtccgcaaaattgaattcctgagtcagcaggagagtaatccacctaaatgcatagaattgaggattgacctgacattcagaaccagaaaaaatgagcaatctgataaactgttcaatagccaaaagcaaatacatggttgaatcatccagcaggtgtgcatgcaaaaaatgtattatgataactagtcaaaggcccgtcacttaactagttgagaaacataaaacagtataaacagacagaaaaacagtggccaaaataataattctaacatagagaaggtcataatgaagcacgaaggagccacacttgtttatttattatttagcttatttaacaaatttataacagagcagtacacaatgctagcataacagtagatattgcaatcatgcaatgtacaaataaataattaataactaattataatatcaagaattaaaatactttaacagaaatgcctatcctctcacaatatttccaaatttaaacagaaagggaactgtgagaagatgaatatatactaaaactgtcttaccttagaagtaacctcaagatggcgccacagctcttcatcatgttctctcaaaagctgggacaatctcgtaatggttgaacggattcccacaacactattgtcgagttgttgaacaaagttatctcgaaacccactcaatagctcaacaaaacaaaagaatgcatctgcttcagcagaggcctgcaaattataatagggaactgttgagcagagtcaaccaataatacagtagaacatgacattgttaatgaatctacattattccaccatattgccacctaagcaaattgtttacaacaaaatcaacattcccatgttcatattaactattttacatactttctattttatgtatacagggcaatgccgaattacatttggtaaaatttcttgtcccaattcccctaagcaatgattactttttaacttgtcacacgtgaattttttatttgtcttccctttccccattctagcagccccttcttctattaaagcatacactggaaagtatcaggcaaatgaatgaggaaacatgaactttttagaatgtatgcatacaaaaggtaaaagactgacagacttgcatacagatatagtgcatctgatcagagaagaataacaaaggaaaagtacttcttcaaatgaaatttgcaaaatcaaaaagaaaaaatgaaatttgaaccaattaatctttagaaaccacatacaattaaaatcaacatactatggtaagtggtgttaatagagcatgaattacaaacaaggacaataacagagaatcaggtgtttgataatgcaacccaatgatgatagatcatatgacaaacaattaaaagattaaaagcatatactcactgcattttcctcatctgggtcatttttgaaaacatagaatagaggagccaatatctcattcattccttgcacatatcgtacacccgggtttaactttgcaaaaataattaatatattcttcaaagcctcctgaaaatgcccccccaaaaaatagtaataataaatcaaagggttcacggcagaaaatacttgaatttggagtttgtatgaatttcaagacaaagaaaggacctgattagattttgcaaattgggaatcaccagagaaaaagtgcatatcaggatgagtgcgctttacatctcagtcaatttgatcgatgatctctgtatcctacaaaatgcaaagaaggagatttgcttcacaacagcctttgcacagagtattatagtgcattagcatgagatttatataattgtgatacaataatgaacacaagagttcattaaagattaaaatattgacagtagaaagaccattaatagtatgtggtaacaaatttgcttagcccaatttcataaagacgtttcattattggaagtttagaacaaatagatcacagggtcctcttgtactgtcaaaaaatttagagaagcattcatagtagacaataaatgattgtcattacagataaggtatatgcgatcaatccatatttttttggtaaaggaagtttcatgaagaattatggttttcagtgacacctgttcatgtaaaattaaaagtgtcacgaactgatgcatcgtgagacaatattgatggagtttatgcaacattgtcaaaatgcattgtaatttttacttaattttagttgtgagtattgttatcaataaaagtcaaaaattgctgggactctttacattgtgactctttatctcattgtaacttgtcatttaagagtcaatcatctatctataaatatgtgctactgaaatgtgaaagagaattcatccccaaaaatactctccttgttctatttctctgcacaatttttacagtacatacagtacagtccaccatatcctataattccttgagtgttttgaaactttcacaccaatgctagaataccaccaacggttttaagctgaaaggcatcgcatgatttttcctttaaattttaagtactagagcactttacaatctacctggaagaactgattccatacactggtcttcccaagactcaaaggatgctccccatgagtgatttcggatctagagagcaatgccctcgcacagttggcatcatcagtatcacaatttgtcgagttgaacatcttccttgtgatttctgactagctagccacagaaacattcagagagccaaatagataaagcaaatagaatagaatatgcatgacaaatcactaattccacaaaaattccacttgtacacacatacaccctatcaattccacgttgacacacatgcaccctatcattgtgagtttgtgacagaaagaaccaagtaaactacaattaaattcaaataattaatgtgacgacatattccttagaattatctctcttctacaaaccatagtctgtcacaagaatcaaattcttttcttcttcttttctcttctcctctcaccattcttttattttaactctatttctctcttttgctttattttcgatttatcattgggttcatctaccaccgaccccaattaatttgggttaaaggtgctgttgatgttgatgttgattctaaagctcnaaaaaaaaaaaacaaaacaaaagtttaacaaaaataatgaggatgatgacactaaggcatcaaagctccctaagcaactaacttacaggattcatgaaaatctcctctttgaattgtttgtactgtgaccgcttcttggctaattcagctgaccaaagccctcgatctggtggaagatatccaagcaaaagctgcaagtatcaaaaagcataaattgcaacagcattccatgatttcacgtccatctttccatcaataaaggaaaaaactcttgactaaccaatagcaaccaaaccatatccttacttagacttatgaacacacgacctgtttggttggaatggaatggaaataaaccactcgcatatttggttagatgatttggaatgcacatccctagtgcagaaatccttgctccatttttcctaaataaaactaattcacctaaaaatatcagaaactaaatttctattacttttctttcttaatttaaatatccattcaagcgtcactgcattcctatccatgccaaacaaccacttaagctggatttaactatagtatcaatttcatcacacacaccagaaaagaagacaataaaaaattaattagaatgcactgacactgtatcaactaaactacactcgagtgtgaatctatcatgcaatcgcagattttcataaatggtaagtttatagacttactattttaaaagtcgtatttgacatgatttttcatctgttgataatgtataaatctttacagtaatagtgcaggaaaattaaactccttaaaaaaaagactaaaatgtaggggaaaaaaagaacgaaaatgcaacctaaccttccacacagtagaacgtatcccagcagcatcaggtataccttgacacgcgaggctccgcaactcgctcatatccaccaccttctttgacaactgaaccaaaccaaatcatcacaaaatcaacactgttactaaaagcactaatcaacaaaacttcaatgtcgttttacagaagaaggcggagagagggaacctcggccagcaattgagcctggcgagacacgtcgtgcgcggaacgaaagccctcgccgtgatcttccctaggcgaatcatcgattctctgcgtcggcggaggatcgtgggcggcgggaggcgacggaggacacggcggcggctcggagggggtcacgacggcgggggatggaggacgcggtggaggtggctgttcgaaggggctggcgacagcggatgagggaggggacgacggcgacgatgaggaccagagagagctgttgagccaatcggggaccttcttcttcaccattttggtcggggggattggggttagggtttgtcaatcgtgatgggagagattaacagcgaagcgcattggattggtaacatcaacatggccgtgcgaggttgattacatggatgaactagcaactctccaattattcttaacttgattactttcgttcttaatttaatccctaaatttaaatattcatacattaaaaatttataaaaatgagtaaatagtggatgtaatatttattcattcacaaattttaagtttgcttaaaattttaagatttaatacaagaggatgttcctgatctattttaattaagttcttaaacttaaaaaaaaaattgaattttttgatcttttaaaatttgtaattcagttcttagagttagtaaaatagccctaaattattatttttgtgacgattttgactttagaaacttaattacaaaaaatttacaagaccacagacccaatataaaaatatcgcttaggaatccaaataaaaaagttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttggaaggtaaaagtgtaatatattgcacatggtaggcaagtctgtacaagaaataaagttgcaaagttacatacagaaagcctattcacaaaaaataaaaataaaaaatcatgtaagatattctaacaatgaggaaaaacaaaacaaatgattgatactctatgataaaaagatcacaaatttatttcttctcttgtacaagaatcactgtcaagaagtgattttagtctcttataagagttttactccttcaaaatgttgttcacgaaaagcaatgttgtttttggtgttccatagacaccaccaagtggcaaaccaaataaaattcccccaaggagatggtaatactaggaagaggtttgcaacaaggagatttgttatcttcttatcttttcatcatttgctcataggagctctcatccttggtaacaaataataacgaaaaaaaatcctaaaaataatctccttagtcttcaattttgtttagtacattcatgagttgctactactcaagtttaacatgtttcaatatcagttaaattgcgtaattttttctgataatgtaccatatcagttaattaaacaaaacaaactccaagcacatctcatcaccaccacctccaggttggtgtctcgcggcatagatctcagcaccatcttccatattaagctgaagtcatgatacataaatataaaatattaaactataagtttgttgtatgaaaaaaaataaagaactatatgcaaaatatgagatctaaatattacttatacacaagcagtagacgcacagttcaatattaatttcattttcacaaattttagtgtactatgagactatgagacgtaaataaggtaaagaaattcatattgaagtaaaccgaaggtgtattcccaaaaaagacaaagttatgcaagaatattgagcagggcaggcctttctgatttcctgtgcatttttgtgtcttatttatattaatgataggggtgagtttctttaactttatttttttaaataagtattttttaaataaaatatacaacggatgtgtttgtttaaactatttttacttaaaataaacagtttttttaagaaacaaatagaatttgtttcttaaaaaaaataaaaaaaaatatttatataaaaatacttattttaatttatttattttaaatttaagaactcacccataattttaactctcaactaaataaagaagcaaaacaaattagaaatatgaaaattaagaagaagaaaaaaaacttatgctagatatttttttgaagagcctcatgttaagatacttagtcttctagaaattgaaacaagcaccaaacatggaccctgaacagatgaaaactgagcatatcttatgcttcaacgtatagcacagtaaaaaatacccaaactttgtgtgacatgacatgttatgaaagaaactaactatttttggtgtatgttttccgttaatgtgaataccatcgtataggaactgcaaggtctcgtattagatggtcgacctctggatgtagtcatgttcttctacacatgcaattgaagattgcacaaaacattttagatgagtgggaaaataaaacatcaattcaaaccaaaccacactaataagttgaagaggggtacatgcaatttattttattcttgaatcggtgacaaaggaagagaagaaaaccacaccagtgtggtttcaactcttgatagctagatctggttatggttgtaactcctagtgtttgtttcttcagttcctaaaatgtgttaatgaaaaaagttaagtgagtgatgtagattttcatatttttaaattgggttaaatatattttctctctcataaatatagaaatattttgaatttttctttgtaaattttgaagtatattttttattttcacaaaattaaagtatattatgactttttaaatatgtaaaagtgacatatgtttacgttgatctgtatataatcgatgtaaaaaaattatgtaaatatatttcttgttccaagcaaaaagttaaaattttacataataaatttcaaatatttttatatttataagaactaaaaatattttgttgtgcaaattttcaaatctgtgttcaggtgttcttactgcagagggaattgattctctttgtgacagagcatgatagctttcaacgttgtcattctttctattatttctaatgcaacaagcctatacttgaaattgacctgttattaattaaaagcgtcctcaatttctttaacagtttgcatttttatacaaaagaagaaaatagtataaataaatcaaaatataataagaagcaaacttttgaggttctattaaattagaagtattttacagtgtaaaatgcaaaattcatttacattcagaagatgcgaaaggaattcaaaataaaacaaatgcactgtgatttttacatagtttttgttgtatgagtaacgtgctgtccactatagtcaattagtgttgtgccttgtgactctttatctaattgtaacttcttgtagtttaagagtcattcatcttatatatgcctatgtgctgctgaattgtgaaagagaaaagaaacaaaacagtaaactattcgatcagcccttgaaatactctccttgttctatttttatgcataattttacagtacctacgctccacaccatatcctataattccttgagtgtttttggcaacttagcttgtgctatacacccacatacatgtcatgtccatttctcttcccccacccaccttcattattccttattcatattcacgtgacatcattccattgcactatatatatctacaattcaattattgatggatatcactaactagtgttttaagtaaaaaaaattatgaacaatgtattttatgcatcttaataatttttttttaaacttttagtcaatgtcttcaaaacatttattagtatttgttattgtttattattcaaacctaagggtcagtttggtaccgcagaaggctgataaagttttcatcactggaatggccggatttggagagtcaccaaactaataaaatggtaatactaaaaatactctccttagtccttagtcttcaattttgttcagtacatttgttactaatactactcaagtttaacatataaacttgatatacaaacagttaaagtgcgtactttttctgataatataatgtaccatgtcagttaagcaaattaacaaactctaagcagtacaacaaacatttcctagctaatgcttttaagagtcaaagtgccgcagcaccacctccaatttggggtcttatggcgacgatctcggcatcatcttccatattaagctggaatatcaagttacaataatataaaaaaattaaactataggttagttgtgtgaaaggaaaaaaaaaaaggactatatgtaaaagaacagggatttattcccttgatttgtattgaaaataatttaaatggatacacaaatagcacacaaaattgacgaattattttattttgtaaatcaatttttttttcatttactgagaaagtgcatattttaccacaatcttctttcttagtagtaaatattacttctacactaacagtagcgatgcacagcaacaaagtgaaataggttgaaataacctctaatacacaacactattgatgatttcaaactgcagtagtatgtatatatggcgctaatcatttaagaaaactgaattttttttcttttttaatcaaaaggtatttaggatttttatttgacattcaacaagtgtttcttccatcaaatcgatctattttggaataaaatgatatttttacttgcaactccattcttaagacgggaatttattaaactccagatcttcagtaagaaacctaaatatcaaatcacctgtgacaatttttggttatttactatctctattgtatattacagcctcctagaagggcatattaatatcattttcacaaattatatatagtgcaatatgagacgtaaagaaggtaaagaatattgtaagtgcctttctgatttcctatgcattaggcatcatctatatatactattctgccaatgtcctatttttgttgaacttatgaaaaaaaatactttgaatgatgttttattagaaattgtgatatattaaaaacttactatgtgatgatattatatattaaaacctaaagcattatgtcttatttatattaattataatctcaactaaataaagaagaaatcatgaggagtgctagtatcattctctttaacacattctaccacacattttactattggttataagaaagacacattaacataaagaatgtgtgtaaaagagtgcattagaaaatccattacattattaacatttctcaattatgagatattagaaaatatgaacactaagaactttgtgtgacttcttatgaaagaaactaaccattcttgctgtatgtttccccttaatgttaaaaccgtcataaatgaacttcagggtctcgtaatccaacttctgtcgatcacagaactctttaaatacattaattaacttcatatcccggttcaccttgaagaacaaattacgcccatcctatggttcaatgaagaaaagttaaggtgagaactcaaatgttgtattcaaattccattttgggtctttcagtataacaatgtacggttataatctcaggtgttgcaattgcatgattttagtcttcatgttccaattgtgctaattgagtctaaattaacacatttgtacaactttaatcctccacacacacacacacacacacacacacacacacacacacacatatatatatatatatatatatatatatatattatttcatatatattaacaaaaatttgttgttgatatttgtgctacctttaaaatccaattggtgaaatgtgaggattaaaatagtaaaatcacatttcggtgattaaaatcgcactgctatacctaaaaaaaactaaaagtacaattaggcttacaaaatttaggcagaacggttttacgcacagtttcatataacatttgtcataaaaaaaatatcatgtaataatgatttgatgcatgaatataactttcgttcaatatgacaatcaatatctttatagacattacaggtctacaacaactggccaatacatacttatagaagattggtgcatactgttatgtatatatgtgcagactctgctaaaaaattattacgaaaaaacaaaggaatattgtggaaagagtcaggcatacacctgaagtttgatttttaaattgacaggctcatcatctgatggagattttctcttaagtggaccattggtagccatattcttcttctgcacacacaaaggggagagatgtatgatttcaccaacctaaatgcaaaacaaaaaagttccaccaatcatgagtttctttcacaatattgaagaataaaacattttttttaattatattagaactataaaggccaaaagctaaggtctcattcccaaatagcatttaaaatcgcacaaaaactattgagatgggtagaaaaaaaaattgtttctctgtcagaatgtgaaacaaagcctccaaaaccatactaagttgaagagggctacatgcattttcttaattttattcttggatcagaaaggaagagaaaggtgcggaggaataaagagaaaaaataaacccaccaaaaggacagagaagtgagcacaagaactttttggtttcaaatgaaagctgaaaccttttatgattgtgcctgtacgttgtagtgtttgtttcagttttctaaaaggtgttaagtacgataaattattagggctcgagaactattatgatccctattaatttttataagacatatatttttttggtcttaaatgttattaattattttcttatcaattgaaaattcttggtacttactactaccatataaagattggttgagattatatacttgcggactacctaaataaatttctcgttaatgacataaaggttccttaagtagtactgagtttcaattaccaaacaagtcacacaaaaaaaaaaactgattattcatatgattagaaaacaagtagcatgtattttcaaggtagaacttcaaatttattcactaaacattgcaatccgaacatataaatacgcgatagtgagctcttcaaaagagctatcagcaaactatttcaactgagtaaaaagctaatcaagcgatgaacctggcataaaaattggaaaaatcacaaaaataaaaatgaaaacataaaaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaactcacctggaaatagcggagtaaaggaagtcatagaaaagagagagaagtttgaagctgagaaaaaggctttcaaaaaaaggtagaggggggagagggagagaaagagaagtgatatttagttaagataaattaatttattaacttcttcaagcagtttttctctttcagaattttaaaatgaattgggaaaataatcaaaagatagtagtactatttagcaaaggctgcaatttttcaaagctcctagttcccagaaataggtgattcagattctctccatgtactgaaactctattgtgtaaattttcaaattgatgtttgacatccaatttcactactgctcttgcttttcataaggtggtgacaatacattgctgcagaggacattgattctctttatgacagcatgatagctttccttctttagatttctgatgcaacaagctacaagcctactaaattaaatgtagtgctgaaactgacctctcattaattataagctctctcaatttcttggccaaagtaccaaaagggaaaattttaaaaaaaatttaccatttgggacaaattttaatctaacatcaatttttggataattcatagcatatattataatttctaaattaaaaatcgtaacatttgttataatatcattttttttacattgaagtcataaaatattttatgattttaatttttttaattacgactttaatgtggtttgagttttttttatgacattaaaatcataaaggataatatttttttattgaagtcataaattaatcacttcaattgttaaaaaaattatatataatttttattttaattatttaatgaattaatgtatgctttcttttttaattttatttaatattttctatatttttttatatgattttattcaatatttttaatattattttatttaatatattttctatatttttatatgattttatttaatattttcttaatttttctatattattttatttaatacattttttatattttaaataaggtaatatttatattttttatattgttttattaaatatattttttcaatttaatattttatattctttattattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattttaataactacttttattattaaattattttttattattaatattaaaataatttataaaataaaattaatattattatacaaaattattaatttatttaatgaaaattgtaaaaattagttaaattttttaaaaaattaatattatttgataaattataagtgaatattattggttaatgttaacaataaaatattttaatatttttgtttaacaaatatttaatatgttttaatatttttatttaaattgaagttttaatttacaaaataaataaaatgatataaaaaatattaaataaaatcataaaaacataaaaatattaaataaaactaaaaaaataaaacatacatnnnnnnnnnnnnnnnnnnnnnnnnnnnnnnnnnnnnnnnnnnnnnnnnnnnnnctatttaaattagaagtatagtaagtaataccgtgtaaatttagtaagaagaaaatttttagatttttacattattattcacttaccattatgtttaaattttaagaaaactgaaacaaaatattgacagcctttctcctatcttctgatttaccttgaatagcaccctagagagagatggattgtttaagtgcatgtttaattaaaatttataaacataagtttgggtcaactttaagtttgcaaagtaaatttacaaaaatatttaaagtcttgtttttccaaaattaagtttccaagcaaaaaatttaactcaaatatattgttagagaataactaaacatgactccaaattatactctcaaagatacttttaaaccctctcaatagaagtccaaacacaccctaaaacattattagttggtaccttacaacaaaggcgcagattccaggaaatcaatttctatgtgcggcacattccagaaaagccttttgacacacaaatattatatatacaaaatcaatcaatgaagaaactgaaaaataaactaatcacatcacgtactaaaatcaacaaaattcgataaatccttacatcaccgtttcccatccgaacagggatttcatccttgatttcgcaaaatgttatgtattcctccaaaagttgccttatacatgatatgcttgcaggaatgtatgacatttatgttcttctcaaagaatatatttttgacagtggtgtatactctcttttttcaaagaataccaaatccattatagaaagtttgactccattttgatcacaatgctacaatggaaggtgcaccaaaaaaattgcacccggacaagaatttaaaaaaaatcaatttacaaggaagttacaatagagaaaaaatactactagatcaatttgtctattaaagctgaagactagatagtccttaaaagctctctcaaattagccaatacatggcgtggtcccaaactcttggcatcaacgaaattcaaaagctgttctaaatcctacagtcagaaaagcacgagggaaaggagctgtaagtcaaggttaatcaggacggataatgtgtacacagtacaatatatatcaaatatcgttcaaacaaccacacttcaaaaaaaaaatcaacatcaacatcaataatacctttaatccaagttaattggaattaatggtagatgaacccaatgatagatacaaagaggttcaaaaaaaagtggaagcggaagggaaaatacgataaaagaaaagaaggggaaaagaaaaagggaagagatgaagaggaaaaaggctaaaaagggaccatctgaaatatagagataacgatgagtctaaccctccaccaagattatagtttttcctcatttcgtcctaagacacaccgtccgccaatttatatctcactccattaagtcttgtttaactactttttctcatgtaagtttcggtctacctctacctctctttgtgtcaagttcttgataacaaacttttgttcagaggccgtctcattatgggtctaaaccaccatagtctatattccctcatcttttcactcaccagtactattgctacctttcgccaaatatcttcatttcttatcttatccatctttgtatattcacacatccaccttaacatcctcatttctgttacccctattttatgttcatgttgcctatgtacttcaagaaaaaaattaatgacagaaaacaaaggcactaacaagtatgggagaccatatttgagatataatatagaattaaaagtctaagacaacctgccagccaacaccaatgcaaaaccaacagcctgtcaatatagtaaatgttaatcttgctactcaattttgggaacaggatcacctacagttgtttgtaaactgcagggtcctgcagttaaaatcaaatggtctaaaatgttgtaaggtgcaacttattttatttttcagtgtatgtaatgcatttttaatggtgatgatttcttgacaatggaaattcaactgcagaacaatcatagttttgttttttggtaggaggaaatctttgggggaaaaacaagagatgagtttttaaacagatgtttcttagaattaaagcatctcatgtaagcataactaaaaaacaaacttctaatctttcatgccatgaaacgaacaaaggcatttggctcctctggagtaagtaatctcagctgttgagtataaataaataaaaaagcaacggtcaatattccaatacatccccaattggttatgcatgtgcatgtgatattgactcttgattttctcattgacaactgagatttgttactctgccctcttaagtgaattgctcacttttgaaaaatcaaatttcaaacaaagagttgggaaaacaaaaaatagaaaagaaaagaaaaaaaaaaaactaattctggaggaggacctgtcctcacttccagttagctaacatatacagtagtgagctttattctcatagtaaaatggaaatctgccaattcagtctcttttcattacagagaaaagcacaagcaaggccanacatatacagtagtaagctttattctcatagtaaaatggaaatctgccaattcagtctcttttcattacagagaaaagcacaagcaaggccaaaataatttcttaatcaaccaacatgttggaaattttgagtagagtcccaaaaaaagtagaatactttctcttacaaaaagcaacacaaaaatcatagccagaaagctaattacgtgaaacaaatgggaagtaaactctaaccatgcaaaagcaaaacacagatccggcaatcttgcaaaatatggtaatgcataaagtcatcaacaaatataaaatgtccatgatccaaacaaataaattagataaatgataaggggcagaaagtgtcagcaaaaaaatgcactaaattgttttcttgggaattctgaaggagacaatgaacaagataagactacccctgttatgttttgccttagttcaaacaaagcacgtaaactcaacgattgagagtaactacaaagcaaaaataaatagaaatatataccttatttagtaagaaaacagcataagctgctcttgtggtgtcttgaccttctaaaaaaagagggaattccacatgtttggcgtttatgtttgcatttgatgaagcttcagaagatgttagctctgttgaaggtgcattatcaataatatatgaatgagaagcacccaaccgtaaaggatatcgcaaaggaacttgcaagtatgaggctataagtgaaacagcctgcgagaaaatcagtctagtaaagaacatttcaataaataaataaattttcgaaaaggaagacatttcaataattattagctcaacgatcatccacttgagctacaataagaaatgctgcagctggaacacagaagtttggtatatgatacgaaaaagcattgacaattaagtttgccatatacaagacatgtcaaaatatgaaggcttcaaatacattcttcgtcccttcaaatatactagttttcggttttaatcccagtaactttatgtttctaatttgttaacatttttagttttggctcttcccattagtcatgaaagtgtttttgtaatggaagaccaaaaaacagaaggtttggacattataaagatcataaaaaaaaatgtatttaaaccatgatctgtatatgacaatttagaaaccactatattagtaaaggatggaaaaaggtatttaaaccaaatatgtatatgaaaatttagaagctgtacatcacatattttggaaatggatcacaaaaggcataagaaagaataatatgaacagttctgaggcaaaaaagggccgggtaggttctaatacttacatgtgcaacatatcctagggctgtagcagaattctgaatttcctttttatcagtgaaaaagctcatcttcctaaaagatagcacattcaaatgcagaccatgaattgttaaggatccttgattaattggttttagtccagcagaagtccctgagtaatgaaataaatgaaacttttacaataaaattcagcaaaaatatcccttagaaatgcagtgaatattagcaaaaaaaaattgtgataatttaaattagcagaagataaactatacttaacattcaatgaatagctatggtcttctagagcatccaaaggatcaaccataccaaaatctacagtaccaaactaaattataaaattataatttaaggccgttgtcaatcagcaaaactagtgcagaagcatgaaagaaaagaacaagatatgaggcacacacatcagacagacgaagtacagaatgaaagacatcctttcaacacaacagtccaacttacagaagaactatatccaaggtgccagtaagaaattaagggataatgattgaaccatccagtacctcaagtttcttagtttatttaaaggcttaaatatgtttttaatccttcatatttgggtaattatttttttagtccttcaaaaaaacacttattagtcccttaaattttcaaaaagctactttcagtccctctttgttcattgtgtttatggtttcaaatgtggcagtttttaaccaccaaaataaatatttttaatttaattttttaaaaaaccatttctagcgattttaaatcgccaaaatatttgactcatggattgttggccgctttttacatattttggtattttaaataagaaaaataaaaacatggatgttgaattgtgacgcttttttacatattctagcgattttaaactggcacaaatcatttttccaataaattaaattaaaaaaattctagtgatgagaaatcgccacaaattgggacaccattaatgcaaagaaatagagggactaaaaatagcttttcgaaaatttgaggaactaataaaaacattttttaaggactaaaaaaacaattacccaaatttaaaggactaaaaacatatttaagccttatttaaattgtaagttttgtattttgcatgaccgaagccatttttttaccttaggggcactatccacacacaaaaaagactattattgagctaaccattacctgccaggctgcctaaaggatatgcttcaagctcttgctcttgtgctggtccaaccaagatcttaacaggatagagcattgaaatttgagatgtcatgtattgttgcctcttcctgagcatcttttgcaattttatcagatgaacataaccattttcttcagacagaaatctacttgattcctataataaaagcatcatcagctttctagctactagaataacaccagtaaaatacaaacaataatcccttcccctaaaacaaggaataatgataacttatatatatattcagctaaataaattcgtcaaataccatttcttacatggactaatagagaaaagaaagcttttaaaaaatgaggaaatttgaaataaaacaagaagttcatttctgaaggacaggtacaagtggagctaaggaagatatactctattcaattgaaaataaaatcagtcaaaagcaaaaaagaacaatactccaaatgtcaatttgtaacacatacttcaatatcaataaaatgaatcaatctttttaatcaagacaacaatgcattcccccttgtgaggtgaccaaaaaagatataattgatgctaagtcgtgcatggcattgtggggtgatgccgataacaattgggaatatcttccagcaatcaataaggctggtggattactatgcatatggagcaaggaggcatttgtgttggataacaagatttcaggggctggatttatttatttggaagggacatgggtagcagatggcagcaaagccacaattgtcaacatatactcaccttgtgagttatctatgaaaagaaggttatgggaggatctaagacagctgagaaatacaaatatggggggtttatggtgcattataggggactttaacaacatcagaagaccacaagagagagtagggatatgtcagagataccaagatgaaggcactgtaagagagttcaatgaatggatagcagatatggaagtagatgatgtcccctgtatcgggcgactctttacatggtataggccaaatgggtctgccaaaagcaagctggacagagccatggtctcagcagaatggatcgctaaatggcaggatacaactcagttcattctagttcggaatttctcggatcattgtcctattatactgaggtcatcgctggctgattggggcccaaaaccatttcgggttttggattgctggcttcaggataatacattcaggaagcttgtgcaggaagggtggaattcaaagcagatcagtggctggggtggttttgttttaaaggaaaagcttaagaacatgaagcagaaaattaaggtctggcacaaaacacattttggagacatgcagctgaagattgaatcactacagtcagaacttaacaagctggagactgaaggggatgacaggcattttactgaagatgaggtgctgaggcgaaaacagttacaggaggaattatggaccgctgctcaggcaaatgcctcaatcttgaggcagaaagcaagatccaagtggatcaaggtgggggactgcaactctacttactttcacatgactgtaaattggaagcgcaatagtaacatgatcagaggcttggtggctgacgggagctggactgatgagcctcacagagtcaaagaagaagttaggatgttctgcaagaagaaatttgaggagcccattctaaacagacctaatttagatggcactaacttcagtgccattgaacaacacaacttggagagtttggtggcaagatttgatgcaatggaagtcaggaaagctgtgtgggagtgtggtaacgaaaagagtcctgggccggatggctttaatttcaagtttattaaagctttttgggatatcatcaaagccgattttctccgtttcatggatgaattctatgtaaatggtacaatccctaagggtggtaatgcatcttttacaactttaattcccaagacacatgatccacagggcctaaatgatttcagacctatttcactagtgggctgtgtctataaggttgtggccaaggtgttagctgcaaggctgaaaaaggtgatgccatctattattgaccaacgacaatcagcttttattcaagggagacagctgctgcatagtgttctcatagctaatgaggtagtagatgaggcaaaaagatcaaatagaagctgtcttgtgttcaaggtggattttgaaaaggcatatgactcggttagttggacattcctgtcatatatgatgaagaggatgggtttctgtcctaggtggattatgtggatcgaggggtgtttaaaatctgcttccatatcagtgctggtaaatggaagcccctctgcagaattcacacctcaaaagggccttagacaaggtgacccacttgccccactactgtttaatattgtggcagagggcttgactggattgatgagagaagcacaggcaaaaaacctgtttgatggctataaggtggggagaaacggagttgatatcagcctgttgcagtatgctgatgataccttgttttttggtactgcatcaaccaaaaatgtgaaggccattaaggtgatgttgaggaccttcgagatggtatcggggctgaagattaatttcgcaaagagcagatttggggtttttggtagggatgatcagtggataactcaagctgcaacatatctgaactgtagaaggctggttttccctttttcataccttggaattcctattggagccaacccaagacgtcttgagacgtgggaacccttgattaaaaaatacgagcgaaaattagctagatggaaacagaaatatttctcttttgggggaagggtgaccttgataaagtctacgttaaactcgattcctattttccttttgtcttttttcagggcgcctaagaaggtcatagcttgcattgagaggattcagaaaaggcttttgtggggcggaactgatgagcaaaggaagattgcctgggttagatgggggctgatctgccaatcaaaggagcatggggggctgggcattaaagatttaaccaaatttaatcaagcccttacttggtaaatggttctggaatctttttcaccagccacagctactatgggcacaagtgttacaatcaaaatatgggggatggagaagcttgactgaaattacaaggaatggtaaagagtccatttggtggagggatctcagctcattgtgtaataatgatgagaggcactggattagaagcgggattagctggaaggtgggaagtggaaacaggattttattttgggaggacggatggaaaaatgatggaatcaccctgatggaaaggtacccaagattgtaccagctttctaatcaacaacaatttttcattcatcagatgggcaaaatgactcaagacggatgggaatgggagctcagctggagaagacatttcatggagggggaagttgctgctgctgtaaatttcatgaaggacattcaacatgtggtaatacacttacagcaacaagacacttggagatgggcggctgatttgagtggaagttatacagtgggaagtgcctaccactacatcgacagtgaactgaatagtttgcctcatgagggtttcttcaaggtgttatggaaattaaaagttcctaataaggcactatgctttgtatggagattgtgtaaggataggttaccttctaagatgaacctgtgtagaaggaatatggaaattattgataacacctgccccttttgtagaaatagtgaggaggacgtatcccacttattcttcagctgcagtaggatcatacctctctggtgggaatgcttgtcgtggataaaggtcgtaagtgtatcgtcagcaacccctatagagcactttacccaacactcctcctatgggaatattgaaattagatcgatgagatggcagacctggtgcgttgcattgacctggactatatggcgtcataggaataggattatcttccatgctgcgacgttcaacagtcaaaatctgatggaggatgcgctttttttatgttggtcttggcttaaacatttggaggatggctttactttccctttccacttctggtcctctaatatgggagaggcttttgttatcaggggagggtagttttaagctgtattttttgttatcctagttataggtcagaactcaggaggtcttttccatgccttcatggtttaaacctccttcgttctgttgaacactaggttctttttgcaatacctcttgtaatgcagaaactttttcatatatatatacatattatttttgctggtcaaaaaaaacaatgcattccccctagaactactgaactttttacatttaataattatttccaggaaagaaaagatattatatgaaaattcaactacaatatgacataaactcacctggagatttctgctggttacagaaagagtaccccctgccaccaaaagtgattgcactgcaccactaagctgctcctcctgcttgctagcttcctcctttgccagcctagaacgtatagacatattctccatcaccattttctttgattccaatttttgacgcatctcctcaagttcattcaaccaacccaatgattcagcattgacctgttaggcgggctcattaattagggaccagtaaaaaaacaaaaaaccaaccatgcacctatatattggaaacaattagtgcaaaaaagcatcccaaggtgtaaacaaaaactaaaccactcaataccctgacaagactgaattggtgtgctaaaataaaatcttagcagcatggttatcaatctgggataacggcacagagcaaccaaccccaaaacggccacagcaagatagcagatagtgggatgactactattacaaaatttattgatataattataaattaaaacaatgtgcaagtatgtgcacgcgcgctaaaaaaatatacccacagaatgagagttccacagattgttagttggctggaaacgcagttgagagctttcggtcagatggtttacaacgaagagagaagagaccaccccctttgatgtgaacagaacagattgcaaaggatgtgaaccaagtagaaaccacagaatggtgtgccagagttccacaggttgtgggttggctggaaactccagagtgctacggtttggccagcaatgcagttgagagctctgtgtaagatggtttgcgttgaagaaagaagagattaatgagagtaatgtgttatttaaccttagaaaggagtgaaagtgggaaatagtttgtgttctgatcaaatataagagggggagggggaaaaatcccaagattgcccctcataaacagcaccaaatgacattgttcaagggggcaaaaagggggtttcgtctttgatgcaatgacaaccggaattcatgccactccaggcacaacggtgagttgcgacatgacaggcttccttggagcaggccatagacatgacattccacgacaccactatagcgtgactgactattacgctttgcaggctattctgagttggaatttgggaatcaagcatttccctttgttcagatatcatggatctactcatattggacacattaaccagttaagatccaagatatgcaacagaaaaaattcatggcacactaatgattgtacacctactcagacccactgataaaatttaaaacatgaaatgatcagtgtaaaatcatatgtttgatcatcagaaaattatttctcttaaatcctctccaaaaaaaggtaaatatgcctcatactataatttataatcaaagttatgtagttctttctccttattctgataaagaggaagattaagtaataaatatttatactaggacaaaagaaagtgcctagtcagagataatgtgttcataagtaatcaaaggtaaagaaacagactgaaaacacacgtcatcttaacatgactctccaatctctgtccacagacctttccagttaccactgacaaggctttcaaaaaaaaactgacaaggccaaaaggtaaaatttaaaagcataattaccaacagaaacaagtgtattgtagatccatattaactaattattgacaaagaaatgaagccaacaaagattgatttagttaataaggatcaaagccacgtttgtaaggcttaggtccaccccccccccccaaaaaaaaaaaaaaaaaaaaaaaaaaannncccccaacttaactttttttttgttacccaaaacaatgaaaaattagagatcaactggtccaaccacaatacacctcagccctattagatagtgatgtgtgcttccaagtctctcgctaatgaactcaaacaccactacccaagaccaacagatcacagtccattgtaaggcttaggttcaatccctgcccccacccccaaataaataaataaaaaaaatgtgttgcccttggaattatacacatttggtcccaatttttccagagaaaataaccgcactgtaatcaaaagttctttatggaagccggcaaaaaagagactatttttccaaaacaagctgaacaaacatgtacattttcttcctccttaactttctattaccaagaacaaaaagagagatgaaagatcatccagtccaatcataataaacctcaaccctcctactggaagctaacattagctctttgtctcgttcttgaatcgattggaattgaaatggaataattaatctatttctccgcctctttgctaataaatccgtagtatcatggaaaatagtaggatgtgtaaaatgattgaatttgaagcccctctcagctaccaacttaaacattacaatccaaaaccaaaaaagtaataaaatagcctagttgtgaaccgaaggatctgcttaaaccctaaatggaaaatgagccactaataaataagaaaataaacaatttgcttctaatttatgatataacgcaacgaactcaatcccccaatttccgattagatagtgatggacttaaagcttctcagcaatgaactcaaacaccactgtccaaaaccaaaaaataaccacaatcccctctaccctaaacacacctgcaagcaaaaatcactataaaccatcattaaggactttagcatgccttggcagtggaattaacacacatttggatcccattttttctgagaaaataatcactttgttatcaaaagttctttacagaagctggcaaaaaacagattatttttccaaaataagtggtgccaaacacctacaattacacnnnnnnnnnnnnnnnnnnnnnnnnnnnnnnnnnnnnnnnnnnnnnnnnnnnnnnngccagtccaaccattataaactcaaataccacaatcaaaaaccaacttatcatgtatttatgacttccctggtaatgccttaaaggcagattttgctggtgtttcctttccaagaggtttctaggttggttaatatattgaataggcttataaggagagcccaaatgggccacaagtaatacaaaaagaaaataaatagtttgcttttaatttatgataaatacaacaaaaatcaatcccatcatttcccattacacagtgatggacattaaagccccccagcaacgaactcaaacaccacagcccaaaacctgaacaccacagtccatggtaaggcttaggtcaatctcctatccccccctgccccaaacatacacacaagcatgaaaatcaccttgaatcatcatcaagacctttagcgtgccttggccttggagttacacacatgtttggttccaaatttttccaagaaaataatagcttttttttcaaaagttctctacggaagctgacatagggagattatttttttccaaaataaccagaaccaaacacatacattccctcccccttaacttccagtacgtttggaaacacatttcaaacacttcaacccaaaagatatgaaggggttccttccaccaacttaagcacagcaccccaccaacggatttccaaacatacgcttactattaccaagaacaaagagagagagagagagaagagatcatccagtccaaccataataaacttcaacccactaaacagtgatcgagatttgaagtctcttgctcaccaacttaaaaaccacaatccgaaaacaaaatcgtaataaaacagcataggcataaatcgatgtatccgcttataaggtgaaccctatttcgcaaacaggcaacgagtaattagtaataaacaaaataaataaatgcaattatattcgtctcccttccccaattctatttccttccgccaagaattttcgtaatcaaacacagaacgcgatacgattccccactcaagctcgcattttccacgagaccaaacgcgctttccctccagccactaaattccaacttcatttccatttaacttttcattcattacagtaaactcgtcaaaagcgcaaacacaatttccgtaactcaagaaacgcaggataacatcgtcatcataaacccagtttcggcattttgcaatggctaaacctaaaaccaaaactaaaactaaaaccctacctgaattagggaatcgagcttgtgctgaagattccgtttcctctcgttggcttcgtggagggcggaagagagactcgccaaccttgcaagatcgtgctggaagtcgtcccactgaatgaccttcacatgatcaggatcagttgtggtggtccgcaatgacagaatctggcttggttccatcgcggatcgaactcaccatcgtcttcgagtgagtgagtgatcagcgtctcaacctcatcatcgacccctcttctgattttcttgggaaaatgacggcagagaaggaaaatcgcgtcttggtcctcgataatgaatgttgcaaaagttaggctttttttattatgcccgcgaaatagtggacacgtgggaaacatgcgcggtactttttttgcctttgtacatttggtccctcgcgtatttggatttttctagtatcacaaaagtgaggaaatggattctatgcaacggtagggaaagtgattatgaaaaaattcagcattatactcttaaatatattgttcttaacatactttcttttacaaaaaggttttggtttccaaattatttaatttaatttccaaaaaaatttaagttctaattagatcctcaaattcttaaaaatatatcaatttcattatttccatcaaattgatgtcgttaaaattcgatgattttatttaccaatagtgacgattaaaaattatcactatatttttttaaaaaaaaccacagaaaaaatatcagcacttagactcctccctcctccgtccacactctacaatgttcttcccctcagttgcaaactacagaaatgtcactccatttgtgtgcgatcaccatcgatggtacgaggtgcagccagatctcaaccccgaccacaaccactgccaaatcttgtgatttttatggtgcatatcaagcctctttggtgtcatgctccattgcacttcttcacttagtgtatggctggttggtggctttgtgtatgctggtagtggttgtgggtcgtgcaaggtagtttgcagttgtggggacaaattcacgttatattggaggttggtggttagtggcaattggggtggcggcgatgggtcgtagtgattggggtgtgcggtggtgtgttgctcgtttcgaaatattttcatgtttatattgtaaataagaaaaatatatagcggcgatttttaactgttactatttgtaaataaaatcaccattatttcaatgataacgatgtcaacatcattttgacaaaaagtaccatacaaataggataagtatgatacacttgaaggctagcaaaatctctagatgccctagacaactggagtcactggattagcttgcttttgaataaaataaactttgtagtctagtttagaacttagcaacgttttgcaaatattgatgatgttatcaaactcattcaacttcatcttctgacaactgatacttaagactattgttgccaatctatttcgataaccactttattgaaatgcagttcctaagcccactttatcgcatgaagaagagctagtgcttatccttcgtgaatactagacacctagatacaaagttaattatcaacaacatcaatatcaacaactactttaacctaagttaattggggtaagtgatagatgaacctaataataaatacagaaaaattaaaagaaaaaaataagaaaaaaaaaagaaataagataaaagaaaaaataataattatataatagtattttcttacatcctcttcaaatcttagtatctctcgatgacccctgagtgtatgatgaatttcctcttatgagtttcttctagaaaattatactatcagtcaataaagtacaactctattagttcacaagagattgcaaatctttttttaaagttttatttcttttaattaactacctaaggtcgctaccaaatttaacttgtgcaggttcacacttaaagcaatgagagacatccaaattcacacatctaaactcattgtgaaacccaattatactaaggtacattagcctatatccaacaacatccaataactttttccatccaaaatggaggtaactcatctcattcagatatattggcataaatatgttttttagtcactcgaatgtgagtcattttctttttaattcgccaaatttgaagttacttttttagtcctagaatacacaaaatattatttttgtccttgtgtaaaatgtaaaccaaacagaaaataagagactcacattttttgacatgatttggcacggtcaaaatcaagttaataaaaaaatttcaagcaatttatatttttttactaacttgattatggcagtttttaaccaccaaaagtatactttaaaatacaaaacaaaatcaaattttggtgtcaaaagttgtcacaaattgcatttttcttattctatgttaggctcgtgctatacaaaatgactaaaaataacattttatggatttcaaggactaaaaaaatcaactttgaatttgaacgattaaaaaatgacttaactttgaaggactaaaaacacatttaagtcataaatatttcatcctgaatggtaatatccttcatttaattccaagaatttaatgtatatttatcattttttctcaaaaggtaatgactgacccttaaaataacaaaaatatataatttttagtaattatcaattagattctcaattcttatcatgctaaaattctcatcaagaaaaacaacgaacaattggatttcaacacacaaaaaagttcaccttaaaatcctgaaaattcttatgaaaaccttaggagtatgtttggatgagacaatttaaaattctaaagaatttttaattctaagaatttcaaatgcttcaattgaaattttttcattttcaaaatttagtgtttggataaagaaattaaattttttcattttcaaaatttcgtctaattcagaatccgacccacttcgaagtcagcgatcttcacatgcttctgtgagtttatcagtagattcaagggcttgatgtccctaggcacaatgtgctgtcgatgcaggtatatcagtccctgcagaatcttgctaagacaaatctgctaactgttgctcttgcaggaagtgtttcccctccaacgacctttcgtccataaactccagcaacacttggatttcgctattctgatagtatatttcgtggcacttcatcacatttggatcatccacgtcatggaggatctaccactgcactgactcctcgtggtgaccatataagcgcgtacacgcgtccgctggtgtagtggaccatctgagaacgggatcacatgttgcgccgtcactgccgtcaataggggagagtaagtggcactgccaagttggtgtcccgctgcagcaacgtcaggtcctttcgatggcgctggggacgtcagcgacaaaagataatttcaatttctcatgttttagaagaaaattaaaattctacatttttagttatttaaaattatattttaaaatttcaaaaatttcaatttttcatataaaaacataaaaacaatgaattttagattaaaatattttaaattttctaataaattactttcctcacttaaaattctttattcaaatacactttagaggaaattgcattcctcaataaataactaaatgaaaaacaacaattgggttgcacaaaaattccaacattttcttatcaataacccttaataaaatcacatccactaaattcattccatgaaaatttagaaaagatattgttataatcacttcttgaagacctttaattaagctcaaagtttatctaactgctgtgttaggattttttccccaaaaataaaggcttgggcctgagagaaactcattaaggaagttaagagaggttttcagaatggtgaaataagtggtgatgagggttttgattgtctttctcaaagattaaataggtggtgaaataagtgtgtatagattaaaaaaaacttcatttgagctctttctcaaggatggtatttattttcatctgcaacgagattttcatatgcgaaattgaggagtacatttcatatgatcggtagcttttattccaacatatttatcgagcaagcaactcatatgcggactagcttgacaaatcatcatcttttttgcctttgcaaaattgagaattttgtccctaactcatacacatgcttaatcgatgtagcagacatctccatggtgagaatttgacttctcttttctttttcttttcatgttttcctactagtaagaaaacattttagcatgtttccattaaatattggatgggttaataggtgaaccaaaattaatatatatatatatattaaaacagtaggaacagattaaaaaaactatatatatatatatatatattaaaactgtaggaacaaattaaaaaaactaagttactaaattgtgaaataatgttagtaatcacaagggtaatttaagaaggaaaaatagacgataaatacatcaattttctctttataaattagaataaccagtattttagccttgcacatgataaatatttttataatttaaaattataatttataatatttaaatcatattataaataaaatttataaaaaataaatattttttaacatataaattatattttaaatttattataaataatttatattctgacatattgttattattaatcattaataatttcttttaagaaatattcaaaataaagttagaattaaagatttaaaaaataataaattaaaatagataagaaattaaattaaatcgttcagttgatattattgttagaaagatatataaattttgaaaataaaatatatatttgaaattttttaacgtctaaaataattttttaggacgaataataatgataaattaataataatttgttagcggtgttgttgcatctccactttactcctgagaaagcaagggcaagcagtcgtcgtaggtgctgctgattggtcaaaatataaatccaattgttgaaatttgttacttgcactgcgtttgctgcatcagaatcaatggcaggcgtttctctcaagtgcggtgactgcggtgctctgttgagaaccgtagaagaagcgcaagagcacgccgaactcacttcccactccaacttctccgaatccaccgaaccggttctcaacctcgtctgctccgtttgctccaaaccctgccgatccaaaaccgtcagtcccactctctccgatcaacatttcccgattctcattttagggttcaataccgcaatttccttttattaatatattattattattaactgaatatgttactgttggttggatcacgaacataggagagtgatttgcacacgaaaagaaccggccacaccgagttcgttgacaagacttccgaggccgtcaaaccgattagtttggaggctccgaaggtggatgcaactgcttcgtcggaaaacccttccgctgctgcatccactgaccaaagtgaaggtaatttttgtttttaagtttagttaattaaaatttaatattcctaatctatgattgttaatctataaaataaggacgtaattactcgtttggttatcatacctgcataatctttgcagtttagtctctatacctcgaattattcgttttagttccaatacatacactttttaactcttattagttcttacatatacattttttaatctgttttaatccctacgatctttggatgccaggaactaaaactgattaaaaagtgtatgcataaggattaaaactggtagtagttttaggtgtaagaactaaaacggaaagattgtgtaggtatagggaccaaacgaataattaaacctaaaatggtttataagctcagtggttaatggtgatgtagttttattttgtatttttgcctgattgtgatttatgttgtaaactgcagaaatggttgttcccgaagtggacaagaagctgctcgaggaacttgaatccatggggttttcaacagcacgggcaacacgggcgcttcattactctggtgaatttacatgcagtcctattcttttgttattgaccatagttgtgtagtgttctttacgggttcaagatagagatattctcttatttctggattttttttcttcttacttgttttttgctgtctcatgtgagacccttcaggtgagcttactattaggttgacctttggcaccttaattcgggctgttaccatgtattaggttgccaaagttctggtaggctccctgggggtgtttttctttctcagtactacttgtactcatctttattatatatatatatatatatatatatataatattatctttgctgataaaaaaaatgtgagaagaccaatagaggcttgtgtagtttaagtggatcaaacggaggatggtccaagtaaaagaaatagaggaagaaccaatttagtttaccttgccctgaagtgttttattgaaaatatgatttgcaatagagcctaggtctagtgtgttgattgatcgtggagctgatcccacctagtgtgataaggcttgattgttattgtttctttttactttttctgtctgtccaagtgttatcaatggcaaaaggccaaatcctaccatataaacacgcccatggcgccgaaaagcaggcctccctttacaagttgcttatagcggttgccaatctgccatggtgaccatggctgtgccatttaacaacattgttctgtcttgaaaattacgtttttatttttattggatagttcgtggaatagagaactgtagttattaatgcttcatgggacatttatggagtatgttagctgtttcatttatacctaagtaattaccatttgttctaatagtgctttttgtcacaggacattcttggacgttcatgaaatatttttggcgtattttattaaaaaaatattgatatttgtatccattaatcattattgtatcacagagcatctatttttgcttttttgaaggaaactttatgatattgttggaaattagggtgggttaacagagagaagtgagtacaatatagccaggaaagggacttgtttattcaaagtttataatatttatatatgatggcaaatttgatttaaaacttattagacgtaaatcttagtttccttatttacggatgacagtctttggatctaggatacatgagtagtcaatttaaagggtattttcaatacaccattaatgttatttatatctggacattgataattattgagtctctagatattaaacctgggttctcccttctacaggtaatgctggccttgagtctgccgtaaattggatagtagagcatgagaatgatcctgacatagatcagatgcccttggtacaatatttatattttaatatcacttattgtcattatgtgcttaactgcttattacttcatgagtaatagatctgatgttgcaaacttcaacaaaaataagactagttcatattatgaacaaatcttaaaatgcattcagtgtaattaagtcacactctagtttctaacctgctgattaatgattcactcaggtacctgccaacaccaaaattgaggctcctaaaccttcgcttaccccagaagaattgaaggccaaacagcaggaactaaggtataaaactgaattcagataacattcatactaaagggcgaagttatgaagctattttagagttttaatattgttatggacaaagttctagagaataattttagatatgtattgattcatttgatagaagtaatgtatgatgatgacctagggtaatccctattctgctttcacctgacctctaaaggaaacagttgatgcattctggtatttttgtcagtaccataggctgattaagtgaacacctaatattaatatcattgggtattgcaccctgatttataagtcttgaagttgttaactgttagagattagaaatgtgtctgcatatttctttgtcctctatcattgtgtgcaagttatgtacatgccattaatatataacagtattaatgttagccaaattcgtgtcaatgcattgtgttctggccttctgaacttttgctcagttgatattgtcatatgaagtttttgaaaatttgtagtttaatacatgcctacatgtgtccagaactatagtttacgtgtgcttacttttaagccgatttattattactggtatatttgtagtctatgtaatcattgattttttaaactataatctcaagggagagagctcgtaagaagaaagaagaggaagagaagagaatggagagagaaagagaaaaggtatattgcagattcatccatttgattctcacttatttcttgtgactttcattactgatatacacatgtatttaaaatccattatggaagggttccatacttgttgctttgcctcacctggtcaaaggttgaatttcagagcaagatagagtgagcttgttagtgacattgcaagcccaaatgactcttctgaggggcatgttagagatataaaatcatttatgagcctccacttaatagcttaagcttttgggagagttggtcctcagcacatgatgtagtattgcttcaaaaatcaataattttttttgtttgtcaattattgtttttaattatatcaaagtctatattgtaaatgaattgttgttcctgtaacatggtaaagtttaggttgattaaaagtaatagattacctcatctcagtcatctgtgtattagtatattcttgaattgaagttcacgttagtaaatgtaaaaaaaaaataattctaggctgttaatagtattttgggaagttttattgttttcttgttttgtaaattgtatctaaggtggtttgagggttttggtagtagttttatgacccctttgttttagattttggaaaagataaaatgtgcccaggcacagaaaataagatacttttggaagatgcccaacaccagttggggttggtagaagtgtaatccaaagtccaaacaggtccatgctccatagtcttattatagatgtataatgcctgcgttttttaagttgtaacacaactattcaaagcagttttagtgaatctagtttgcattcccctcaattcatattaatcttttcctattagctattttcacatctccttgactcagaccaagaatttcatcacaacctaattcgtgggcgaatcattcaaagtccaattttaactcattactcctgcattgtttaagaattctctctctctctctcttgtggtcttgcccatttgtgtgtccatgaaggtttcatgaattcattggttttgtcaccctggttattatctagtaaaagacaaatcattagagttgatttcacaataacctttaagtatctccaaaggttattgtgaaattaaactattgaaattaattgaactcaatatcagaaatagaagagcctatgcttaaagcctatgtaatttgtttgaagaatctcaagacttcacaaaagatatgctaaaagagggaaaaaagcttcacatataaatcaggtcatctttaattggttattggcttaaaatgttggacatcttttagactaatttttctgctcttatacagtctagttactctgatttgtgtgtgtgttttttcattttatgatattcaagctgtcatgtatctgtactgtgttccaaagtagcaatatctctttagttcaacatcaacatcaacatcaacagcacctttaacccaaattaattggggtcggtggtannnnnnnnnntggcgaggaccctagctcttttttcgatacatccggggtccgatgtaacgcgtcgctatgaagagaacgccccaacgaaatatcataaaggttcatcacataagaatagctaactttttatggccggttcgcaactcctgacgccaaccctcctcctttatcctggcttgggacaggccatgcatgcatacacacataggcggagttagcaatatctctttagttatcttgaaaaattcatgggttaatttttgttgtatatatgttcttaggtcggaccagtttataacattgtaatatagtatttcttgatacttttgtccatatttgttaattactttggatcttcattttcttatctgtcatgtttttaatgcaggagagaattcgcattggcaaggagttgctggaagcaaagcggattgaagaagagaatgagaggaaacggtcgggctaagctagtaaatttgttgtcgcacatcttgtgttttgttttgaatgcactcagctacaagaaaaatttgcttcctcttgcaggttgttggccttgagaaaagcagagaaagaggaagagaaaagggctagggagaaaatcaaacaaaagttggaagaagacaaggttccaacatttcttaaccattttgctctgtcttgttcttttatcgagcctgttcttatctgactcaagagtcagatcatataagtggtttttaattagaattataattagaatatgaatgccaaatgcttaaatctgtgtccctgacctctatttagaattagaatatgaacgccaaatacttaaatctgtgtccctgacctctatttagaattataatatgaacaccaaataccttatgtgcattaaatcctatttttttgccatctggctgtagttggatactgataatactttttgagatttgttttcattttccatcaagatcatttactttgaaaacatagttgtttaacttattctctcagtctctggtaaaagatcacaatacatagaagtgtgggacattaattcaggttgtgtatttaataaagatattgaaagataagccaccatttgctatgcatggttgtctaaaatgaataaaagaccgtactttgggataaaatatatttagatctgatagatttatattgttttgaattggttgacaatattggtttcattttggaactgcattccgcttggcattagcttatttgaattataggttagatcaaaatggtagaattatcctccaacccacaaatcttgtgttctgcaatctgcatatgaatgaattatacttcaaagaagttttgtgaaaaggctaatttctgttttgccaattttattgttttaatggaagaaattaatgatttgggcactgcactaactcggaatatcaagtgcagaacaaaatgttttgtgctcaatgaaagtttccgcaatgcatatttccatatatgttataccagaagaacccatttagaaaatgacagtctacttagtgtcattgctgatcaaattaaatatgcattttgaacaatttttttggcaaagaaaaacaatttttggagcctgctactactacttttatggctgcagtagctttagaggactttagtcccaagtttttaggaagacttgaggagtacgatgagtcttttctttcaaaagatggaatggaaaattgaatatcttttattgggagatttgaatgaagtcaatttgtttctctattatgacaggcagaaagaaggcggagacttggattgcctccagaggaactctcagcagccaaaccttcacctgcacctgttgtggaggagaaaaaggtatgagcttggccaaaaataatggtttcattttttttccccagctacatgcatgcttatttgaaatttgtgcttgcagagttttgtgcctgttaggcctgccacaaaagctgagcaaatgagggagtgcctccgttctctcaagcagaaccacaaggtacattcttggggaactccgggacctgtttagtcgacagtattaataactattcgatagttaatgaaccggtatcaattgaacatctaatggtaatagcataagaggtaccatagcaacctcaatcagttgatgctaaataatatattttattacaaattatgcagatagctttacatccaaaaaagttttgccccttgaatctttctatttaggttcttactgcaagtgcaattgcataacctttttgtgttcatgagggacaactggcctaccttggcttttgaaagaatattacgtttttttcagaagccaagaaaagaattttattatttttatgcttctttaagaaacttcttttagcttcatatattacctttatgcttctcaaaggggtcaatttggttgcattatctttttgaaggaccaaatttatattctcttatcatcaacttcttgatatgatttcaattattttctttttgatttctagtgcttttattttggatggccagagaagtatactgtataccacgtgccatgcaatctggaaaatgaggccatttttttatatacagtagtgataatgttaactgcattttacattctgctaaaggaatttgattacttacctcacatcaatgcttctcaaaaattgcttgttaaaagtatcttctgcttaaatattgtgataccttagcctatttacatgttcacttattcttggagcaggaggatgacgccagagtgaagagagcattccaaactcttctaacttatgtagggaatgttgccagaaatcccgatgaggaaaagttcaggaagatacgtcttagtaaccaatcttttcaggtatatggccccatctttctcttgtctaaacgaaagttgggttttcaatactaacctaccactagatcatttaaatacgatatatttatggtaagtctgtgtttatgttgggtgtgttttacaggacagagttggttccttgagagggggcattgaatttctagaaatttgtgggtttgagaagatcgatggtggtgagtttttgtttttgcctagggacaaagttgaaatggcggtcctgaattcagctggatctgaactagactctgcaataaagaatcccttttttggagttctttagatgaggcaactgttataatcagaggctcgataattgtagtttcttgtttcgaagtctgagtgctaccgtttgtttattaaagagatactctgttatttatttaccttaacttatgctcgaaggtatctatggagagatttgttacttggctgtcataactcataagttaatgaggtttatacaaatttgtttcataacttcatcttatatctaatgatgcatgtgaccgcttaggatttccgaagcagtttaagcagaatttatacaataacttacataaagtttaagcatacatatttttttatttgaaaaaatcaaatcaaaaaatttataatgactttatgcatcttgctcaattaatattcaactaatttgaaagtttagaaaataattaattttttattgatgtattatacaaaagtaatgtattaaattttttgtgagaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaataatatatttaaagtgcattttttttgtaataaagtgcatgttatttattttattttatatttgttacttttgtttcctcctaaattataaattttataataaattgataaatgaatatcatttgatacttacaataattcgatggattttaaataatcatatagaaaagtccaaaggattggactttgatggtaattcatcaccctttaattgattcctttttttaatattccatcaatatgtataaacaagatggaggaggttgaaatgacatttatcgtggannnnnnnnnntttgtttattaaagagatactctgttatttatttaccttaacttatgctcgaaggtatctatagagagatttgttacttggctgtcataagttaatgaggtctatacaaatttgtttcataacttcatcttatatctaatgatgcatgcgaccgcttaggatttccgaagcagtttaagcagaatttatacaataacttacaaaaagtttaagcatacatatttttttatttgaaaaaatcaaagacaatatcaaaaaatttataataacttatgcatcttgctcagttaatattcaactaatttgaaagtttagaaaataattaattttttattgatgtattttacaaaagtaatgtattaaattttttgtgagaacttaaaaatcaatggtaaaaagttgtaatttttctttcattagtaattagtggtaagacgattttggattataattacataatattttatactaataataaaataaatgatttaaatttaatattaataagaattcaatttcgtaaagattacatgaagtatataaattcattgatcctgtatttggagggttttataattctaaagaatcttaaattgtaagaatttcaaataaaatatattgtttttttctttgaataaagaaattaaattttttcaggaaataatcaaaatatgtctaaaatttctaaatcagaagcattgaattaactgtaatagtctaaatatacaaaagagcatgtctttctcacaccttgaatacttgtcttgtatcatcctttatcttatatcatgcttctcttttacgttctcatcaagatgtgttagcaatagtttatttaatgtttttgctaacaagaaacacactcccaaatgattgtgctataaaaggataatgcaatcgaaagaaaaaactgacatgaaaaaacacaaaaagaaaattatataagctaacgacattgcactatttgtaaaacataataatgtttgcaaggagaacaattaaattgaactattgaattaaatttgagccctatagtaaaggccttgatacaatctagctctgctctttcctgaataaaccatgtttgccatgcttaacttgttcataaccttatacattaaaatagtggcggtgcaagaggtagttgcataaaataaggttataaacaaccaaagggagcctttcaacttctgacaaaactgtaagcctggcccaagatcttacataggctaagagataatgaatataataagagaggaaaaaaaagctaaaaaccatgtggctgttgcttctgaatgtgctctagaactgtcagggaatggagtgctcattccaggagttagtccaccagtgttgcccccaccaaagattggtgatgtggtagacgttggcacatttgggttgttcattggaggggttgtggttggtgtatttggtcctccagcagcactgaacatgatacgaaatcaaattgttaacttttagactccataaagtacaactataatttaagggatcaatgaaaaacattctcatggcttaacacaaaaatcagttcccaaaaactagcctttcactgaataacttgtattttttataaaatgttctttcttgttcttcttcaattgcatgatgcatctcttaagtcttaattcgtcactctccatggagctgaagtaaaagttgtaatagtatattgtaataaccatgtgggtgtgatccccctcaactgatcaaaagcactcacataaaggctcatcatgacacgtgagagggcaaaatatgcctagaactcgactagtatggccccatcattgtccgtggtctctatcagcaattttcttacatgctgagtcataataaatctaaaggggtcaaacacattccaagtaatgatttgatcacaaccagcgtctttattatgtgatcccccccccccccctgttnctccatggagctgaagtaaaagttgtaatagtatattgtaataaccatgtgggtgtgatccccctcaactgatcaaaagcactcacataaaggctcatcatgacacgtgaaagggcaaaataagcctagaactcgactagtatggccccatcattgtccctggtctctatcagcaattttcttacatgctgagtcataataaatctaaagaggtcaaacacattccaagtaatgatttgatcacaaccagggtctttattatgtgatgcccccctgttgtgttcaacaggcatggttcccttattgctatgtctaggtacagcactcttttagcacattaattaagtacatttgcaaatcaaataaacatttatggtgattattcagcactcttttatcgatctaaaaattcctttcatgtaatatatgtcaccctactacagtactaccaaaacggtatcttcaataagatactaaagaaaaagttatgtcaaacccgtttactatgtaccctgtatctacttttttgtctttctttttacaaaacaccgagtaaaatttttacgggcttaattttacgtgattaaaaagtatttgtaaattaatctcaatcatagttttctatattcaaatatgtctcgatgtgtgaaatacaccgaatgctgattaaatatgtaccaattactctttgacataaagttggtgtttctacactgaattataccaaataaagattcaattttttccaattgagtctccatgaactgcactaccacatcccttatgaagtaaaaattcaattatagcttttctttccaacctcaccatcacatgcaaatggatgctattaacttgcaataaagacaaaagcctcagaaacaagaatcagatgaatgaacaaatgaaagaaagttgaaatgtagatgaattgatggatgagaatatttcacccattgatgcaaagtgcgcaactaacaatgctcatatctatggaaatgtggattggatcatggatgggtcaatttcaggattgagaaagaacatctgaagaaggtgctaggtatgtcattttccacagattatttattaatggtaaagaaataacagctgacataaacgtaagcatcaattattactacactacaccgttgcatgacttgcatcagatattcccacaatcacttttaccatgttataaaaaaaaaaaagtatcacacataagacttgtttgggttagattgataatgaaaaataatcaatttaatttttaaatcaaaggcaagaaaaagttatttctactttttcataatctggccgtgattttatggagtaaattgatttttatgagttattcaaatacactaataatgtgtacaaatgatggtcatgattcatgagtgtgaagatcagcaaggtacggttaaggtgaatctaagccgttggatgaagtgggccacacagactcatccaacggtctaatcacaaagtgcagaaaaaagtaaccaacacactctgggagagagcacacagtgtcagtggaccaaaattgagcaacccaagattttgaaaatttgaactttgaagaaccaagaatcagacacagagaacacaaattgcctgtttggttccaatgttgaaattcaattggatccatgttcatatggaagctactttgtttttatacgatttgatgccgaataaaaggatacgcgcacatattttatgcccaaaaaagggtgtataagcatattttcaacacacatccaaacaaacttggtagcgtaagaaatgttaattataaattatatgtcttaattgattttagtttcaaaattttatatgtaaaatatgcgacgccatctgtaagattgatcgaaagaggcacacaaataagggcctgtttacacttaactatgattaaatcttttatttctgaaaaattcaaaccaatgttaccaaaaaactataagtaaaatagtttgggtaattgcagcagataaaagaaagtttgaacagaaaaggaggaaaattacgttacccacccccatgcacagtgacacgcgtcacagaccattcaactcacattcaaacaaacatttcctcttacaaaacaaccatcctctccatcggcgttccttgtcgtctctatcgtattagggacgccatataaaccagacagaagaaaggtaccaaagagaaataaaggtaaaaaaaaaaaaaaaaaaannnnnnnnnnnnnnnnnnnnnnnnnnnnnnnnnnnnnnntcactttcaccaattgtaactgaactctacacaccacactcaataaaataaaactcttcataccatataatattaatatcaataggcgtattagaaacacattccttgtcacacttttattgttagttaaaataataagaaaaacttgatatattaaacaagacttgagatactcaacaaattttagagaataatatcagcatttctttaataaaagtataatattagtaacagagtaaaaccatacagaaaaaggccataccttgcagaagaagggtacacacaagatccatagcctacaaacaccaaaacaaataaaaataaataaaaatgagatgacactgatccactgaaaaacaaaaatggaaatgaagagaaaagttatatatgatactgggatcactggtggcaatggtggcagtgccagcaaaatcacaggagccaggggctcttgccctgcgctgatagtagctgttgaaggcataagaagcatgtgcctgaatggtattagggagaaaacagagtccatctggctgaagaggaagacaatccccaccagccccacatgcatagtccaacgccgtttgaagtgcgtagttgctagcgtcactcctcgccacacaccaactcgcttgacccaacacattcttgcttagacccattgttattatggttattaataacagtaaaggaaccggctttggtgctgccattggagaaagttatattagggagagtgctaggtgtgattgtttgctttgcttagttggtaaaggtggagagagagagagagagagagggaagtgtttagagaaaaaagagaaaattatattatatatggtgactgagtgagtgtggaagagatgggaatagaaggcgctttcgctttctttttggtttctctttttctttttatcagagcatgatagtgtatctcaggtttctatgttctaacgttaatgtctctctgcagtgcactgtgcacgcagtatgaaaatcaaacctcgtttgctagctagcttctgaaatacaattcccacggtctctccttttcttttcttttggtgagaaaaaatacaaataccataacgcccatcctctccctaataaatatttttgaataggcaaaaatggtaacaagtaacttaaggatattagttaaaaaaaatttaaaaatggaagctgaaaaattatgtcgattttttaacatttttttataatttatacaataaatattttttaattctttaattaatgtcttaaaagacatctttttttagtataatacttttacattatcaataataataaaaaattaaatacgttttccctctgaaaaataactgtgttttgtatttttttataaatttatttgacttttgattcttaaaatatttcttccgtgtttgtcccttataaatacttaccttataaatacttaatttacaaatatgtttttatcatgtttttcttttagacaaaatagtctatacatcattaatgtaacagaagtttccagtgtgacttaatcatatttttatgatattttatttttaaaattatcaaaaaagtatatatatatatatatatatgtatatataattgcatacaaggtgtcagttaaatttctgaaagtcgaatttgcttttgtgaaaacaaattttgacgatttttcctgaaaaaaatggtgacattaataagccacaagaaaagtgaaaaaaaaaacatcataaattgatttcacaaaaaggaaagaaagccgacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaatattccatcaatatgtataaacaagatggaggaggttgaaatgacatttatcgtggatattagagaaattatgactaagaacttaaaagagatctccgtgaggttggtgagaatattttttttaatcgataaatgttaatcgttgatttattgttaatagagaagttgaaattgtgatatttttctctttccttttttttcaaccacctaattaaccttatattttttaattgatgagggtgtggaatgtgtaaatcttgtaaataaatgctagcaacatgtttttgcacaaaatgatagtaattgactgaaatgtgtttgaataggaaaaagatttgggtttgcatattaatttaggtgactataatattatcacaaaagattggtgggtccataaaatatccaagccacgacagttcatcagtaatggttaaagcaacggggtgatactagtttgtctacttttatttgatgtgttaaatgaaagactcgtttgattatgagaactaaagcttgtaaaagtaatcgttaaagcaatggggtgaataacaactatatggtctagccctagaactgttaatcttgacaattgctattcaaataaatgattaaattagttattaaaattggtaaaagtttattctgtttagtgtctaatattatgagtttgtaaaattaaatttttggcttgctcaacaatatatcaaaattatgttatcaggctcagatttttttgtgtgattaaataaaatcaagtttcgaaatagtaatatgactttttacatccaaattatctcgcaaagaattaatgtatattcggacaattagaacttagaaactaaggattggcaaaattatttaccaattaattgtattggataatagttaaaaaaataatcacaatattgttgtgaaattgatgatttgaataatcaaagttgaacttgattttttccctttttcaatataataattttaaacaatccagttcatgtaatttatttccaattcacaattatattctaatcctaatatcttaggtggaagaatataagttatttaaattaattcctaatttgtttaaagtgagtatttaaaaacttaaggcattcctcttttctagatggtgtgtaaaaacttagattctagaccaaagagcttgccgtggacatttacatgtgagaatccgaatttgagtttaatttttaaatgttttcatgggccatgtagtagtttctaaaggcccaaagttgttagattaaaagtactattcatggtccaacagaaatatttgacgtttgcagggccggccctgacagggtgaacagggcacctggccagggtctaaaagttttttcacagataatttatataaaatttatttttttaaaaaataaaataaaaataaaatctatgttaggagtccattttatatgttagggtccattttttctatcttttaattttaatattatttttattttaaaaaatttgtatattagagacccatttttttcattccttaattttaatattatttgtatttcaaaaaattcatatgtcaagggtcattttttccatcccttagttttaatattatttgtatttcaaaaaatttatgtcttaggagttcattttttgtgtattagagatctattttttctatccgttaattttaatattatttgtatttcaaaaatttatgtgttaagtattcattttttctatcttttaattttaatattatttatattttaaaaaaaattatattagcgacccagttttttcatttgggccttcagcaacggctttcgatactgatgagacattacttatttcattaagcgatgagtttccctattataaagacctgaacttcaggttcgtaatttacgagtataactcctcagttgtactatatattttgtatgacaattgactgaagtgtaatatatgcatgactgtgctatttgttctagtttataaattcatgtcgtgctactatttgtatttattttgaatttaacttcaattctcttaaaataaatcaacagtaatcaaggccttatataaaggttgaacagagaaagaagacgttctatgtttgatttttttttattagtaaaaactaattaatattgactgataaaaaaagtcaaacgataattatctcaactaaaatttatttattttatttgtcagattttttctttgaaagttaattctggttgaattcttcctatcaaattatttattatattataaatataccaattatttagtattaattataaaatttaaaatatttaataaagtatattaaattatttatgaactatactacttattctgctattcacaactttgcttaccttatttttgacttcagttcgtgcttgtaaataactaaaattaataaatttaaagggacattgttgttttgtacaattgcaattgaatttctcactttttttttatacaaaagttaagttataaataactgtccttttcaattctttaaaatgcttatgtcagctacggtcaatctttgatttttttttaatagagaaactttaataatgaattctttgacatttattattgagtgaactaaatgtaaatgtcattaacagttacttaataaaaatatataaaatacattctgaacatttaatgttcaacaagttaactgaataattatagaggtacctagtcgcctcggacatttacttgtggagtttcttgttgaccccctatccttcggcgaaaaatctgcacaattgccttttttttttccggttcctttaccacattcttccatcatagtgaacttggatcccacttggaagcataaatgacttgaataaattttgaattagattatggattctcttatttaagttttctaagaatgtataaaaaaagtgatttattatttagatattttataaaaaaaaaagcagaagttgcattttgtttaagtcataattataacaaattgttttagttttaaaatatatgacttgttaattaagcacctaattagtacgtgtttctcatgcaagcattcatgcatgttactaagttgtctttataatcgaaaggggaaactaagttaaattattttcatgtaagttataagttagtttcataaactatatatatatatatatatatatatgtatatattatactaatgaacttattaaaataaaccgaaacaaagtataaataaatacatctttatttatttatataaattctcttaataaaaaattttgtatcataaaataacaggttgataatttctctgttgttattgagattagcttgggcagtattcaatcctccttgttggtctggtcttgtaatatcttgctgttcattggaagccccgtgagtgttgtatcaactcctccatcagtgctgaaaattaaaaggaagaaactctttgtcatcattcataaataaaatgagtgacaagagatagcaggaaaaactacataaatttgagaaggaaaattcatttaatccaagaccgacgagcagaattaaacggtttgaccaatttaaaaaacaacattacaagaaaagaaagaaaataggccatatatatatatatatatataccttgaagaaggtgggtacacacaacgtccaaagcctaaacacatgaaaacaaagcagaaagaaacaacatatggttaatcaatgattttcacacataaataagagagaaaagagaagatatgtacatactgggatcagaaacggcaatggtggctgcaccaccaaaattacatgcaccagggtttttgccatttctctgatagtaacagtcaaaggcataagaagcatggttttgaatggtgttcggattgaagcaactgccaccgggttgaattgctctgcagtcagctccatgtgagcatgcaaagtctaaccctgacttcagtgctccgtagccagcgttgctccttgccacgcaccaagtgtttgcttccacaatattcatcatcatgctccctactactattaacactagagaaaccacttttgctgttgatgatgatgatgctgccattgaacaaattactcttattaatttgcttattggtataaagaacaagtgttcagcacagaagaatttatagtggctgtgaacactggtccaagtcaatcacccataaatatgcatattattttaattagagaaacgctcctaacattaatcacttttcttattcttatttttcttggtgatagccgtgccaaaattttgtcttccaacatttaatacggttacatatttaaaaatttaaattccaagaccaatgagttatgtttgaacaatccactcaattgatgtatgcgtttgatggtactaatactcctcttataataataataattatattttgtcagatatttaaaaaatcatttctggtgttttatataaaaaaataattaattcattcattaaaattagtaaaataatcaaattagttgatcttaattttttttaaaaagttgattttaattaagacttacaaatttacattttattttagaaattttcattaatttaatgatttaagtaatcgttatattaaatgatgttgcttataattcaaaagttattttttttcaataaatacgactttttattgttaataaattaattaacgcatttattcacttaaaataaagaatgggtgaattttatatcaataaattttacaataaagaatggttgcatttatttcactagcatttcttatatgtaatttccgttataactgtccttcttaattctttataaccgtttggtttgtaatgtcaaccggtcaaccttgatttttcatgaatatattaagaatatactagtattttaatacttatactcttaaataaattttatataattaaaacttaaaaaattaaaatttcccaaataacaaaaatacattaaaaaaatgtcatgtaaccataattgttgcatcacatctaagagcatctttagtacaagatgttgaacaagaatcttgagttactatatcttccaataaagaaaataaataaatctctaatataaagaacgagtttttgtgaaaaaattcttgttcaaaaaagaataatttttattcttcttcctaagatctcaaagtgagatcgatctatcataacaaaaatagaaaaaacacttataaatctttaatttttttacatgacactatcacactatcatatgtatgaaaaataatataaaattttaatttagaatttaccactataaaaattaaaaatgctccaaattacctcagacatttgactcggcctctcttttacctcctcctgctgcctttactcaatttgcatttcctatttccagcttgagttgcataaaataaatgaactttagatatattagttttatttatctcaattaaatgagcaccgacttttttatgttcagtccagacgttcagttactctaccaaatatttaagccattcatgtccttttaaaaaaaaaaattaattattttgttatctctatatgatctatacaatatttgttttagtcccaatacataaaaacaactcgttaaatacaatgtaacatcgttaacagtgtgacaatgtagtgttgacatacatgtttgtgttttatggtttagtttctgaactatttttatgtttcatctctacttgcacaatttttatgttttaattcctatatgatctcttcttgctcctcctacttcccttcctctctatttccttttttatttcccttaacatttccttttatatattttgcggtttcgatttcttttaaatacgtttattgttttacatcaactaatttgttgactctaaatcagagtctcaaggacgtagagttcaaatgcacttttgggataagacgaggtaaccaagcgtagcaattggttcaaacattccttacaataatagtgacttgctacattagtttaatcttgttgcgtcaaacacttaaaaacatgtaggttgccagttaatttgttttctagatcacatattagcataaggaaaatggatgctcattgacatgaaatgatgaatgaaatgcttggtttgtaggttggtttctatggacaaaaatgtaaggtgaaagcatagggactaaaacctaaaaataatgtattgtgtaggtgtagggattaaaacataaaaattagtagtgtaagtataaggactaaaacgtatcgtgcaaacaccttaaagtcaatgtcatattaatgttttagacaacatgatgcaacatatcatgttgttaacgacattaaattgtatttaacaataaaaactataaagcaaaatttttgtttacacatgaacttaaatgagtaattttcaagtgtaaaaagtaaaacgtaaaaattgtgtaaatataaagactatgtaattaaatctaaaaaaatgctcaacatgacatcatgtcaactaaatattattttatatattaaatttttaatgattgttttcatgtaagtgatatatttttattgatttttttaatatatatagattcatatgatatattacatttattaaatctaataattacattatatttagtaaatataaaatttaatactattattgatgttagttattaataaaatatttaataaatacaataattattactataaaagaaaaaaaatcagttttaaaaaagttttattaggtaatttttaagtaaaataaaaaatacttaatattttaatatatatatatatatatttaattaacatttattatatcattaaatgtaataaattttttataacaatgcttttaatgtttagtatatataatatttaataatattgtaatcaatacactgtaagagaaaatctatttatttatatgtctatttaaattatacattaataacatttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaaatcttattaagtcattcttattttatcatttttttaaaaaatcatgacttctaaacttttaaaattatttttatcaaaattaccataaattttcaatatttggatagaaaataagatttaaaaaaattggtaagaggatcatatgtgtttaatttaaagaaacaacgagttttactttaatttttttctaaaaaataaaattacttctacttaaaattaaagagatcaaaaaatgaatggataaatagttgtctgcttgtcttttatcagttgttattattgagagcttttctagtggaaatataatactttttttnnnnnnnnnnacaatgcttttaatgtttagtatatataatatttaataatattgtaatcaatacactgtaagaaaaaatctatttatttatatgtctatttaaattatacattaataacatttaatattatattaatgtttatgttcaagttgatttttttgtatatataaatataaataaaggtagtatgctgtcaataataaaaagggtagtttatagaaaataattctatttgatttgagtatatctattatgagttataagaattatctaagtagttaacaaactatatatttagtatttgaacttgatatcactcattaaattgaaaaattctccactaaccaatcgatgcatttaatagttgacttaaagcatttgcattaattggaaggattttgttgctacatttaaacaaaatctgattttatcccaaagtaggcgctcaaagttagtgaattgccatctacagcctttcttaatgtaaatccttgatcacatcactgcttataaaagcagaagtaaagaaacaaaaaatataaaagtagaagttattgactaatcttggcgaaaactatggctaaaattgtttgtcttcgatatgcctttcttctcatcctccccatggcttctgtgatccaaattgtttcggtgagtttctctgcgctttcctgcgtcatatatgtataattatatatttcttgccccttatgattaacttttctttttccattgcatataattatctattatatatatatatatacacacacgtaggtataaaaatttacttatcaatttcatgctcaaattattttaaatagttatatttagttctcaaattttaaaaatttaaaaatgttcaatttaatctttaaattcttaaaaatgaatggttccaaattttttaaattaatcaatttgagtctcaaatttttgaaaataaatcaatttgattattaaattttaaataacttgaggatcaaattaaattatttaaaataatttgaaaattaaattaattatttttaaaattttgggatcaaattagtttatttttaaaaatttaaaaatcaaattaaattatttaaaataatttaaaaatcaaattgataattaagttacatataaatgttgacacatgagagttataaaattaatttgatagtaaaaagaagaaaaagaaaaaatcatggattttattcacggactaacaattaacaacattataaaaagatgttgacccctggattcatcattttgatgtctatgaatccttttgtcttttgactatttttttaaaatccacaggctggtggggaaggatcactccctctcgaaggtactagttaaaaattacttctttaaatgtaaacatttttatagcttaactagatgaaaaaaaaaaaaagaagaggaaattaaaagattaatatataatctggttgaggtgatcatgactgaaatcttgattacattgtgcagaatgcggaaatgcatgtgaatatcgttgctcagagactcatcacaggaagccatgtctgttcttctgcaacaagtgctgtaagacatgtttgtgtgtcccatcaggaacctatggtcataaggaagaatgtgcatgctatgacaattggaaaaccaaggaaggaaaacccaagtgcccttaatttgagatccttcatatttacatgtttatcatttatcaactcaattgcacgattgatgtatttctctgttttctacttttctatatctaataagattttactgaggccttaatggcctcatgatgagttactatattattgcgactcttcatattgaaaaaaaaatggtattatatctcaaaaaatgtataaattaaggttaatatgcattatcaaccaacgataattaaaagggtcttgtggcgaggaatagagaatatgttgctgtgttctggagggtccgtttatgtttatatatgtatatgtgtgtgtgtacactcaaatgctgtaaatagttatgggctaacaaaccgcaaaactcaattgtatcttcttactaaccattaaagttgtaatgtttataaataggagaatgctaacaaatgttcaaagatactaatggtccatttcaagatggtaaaaagaaaaaggggtaaacattgagaaccttatagtcagggccggtcctgaaaattttttgatccaaagcgaagtagaaaaaatgggctcctaccacacattttttttttgaaatacaaataatattaaaactaagggatggaaaaaagggcccttaacacacaaattttttgaaattcaaataataataaaattaagagatggaaaaaatgggcccttgacacacaaattttttgaaatacaagtaatattaaaactagggatgaaaaaaatgagtctctaacacataaaaaatggatctctaacatacaaattttttgaaatacaaataatattaaaattaacaaatgaaaaaaaatgggcccctgacacataaattttttgaaatacaaataatattaaaactaagggattaaaaaaatgggcctctaatacacaaattttttgaaatacaaataatattaaaattaagagatgaaaaaatggatccctaacacacaaaatgaacccctaacatagattttatttttaatttatttttattttatttttttaataaaattttttacttaaattactggcccaaaaatttttggaccctgggcggaggccccgctggccctgccccaggatcgggccttcttatagcattgtattctagttgctctataacattgtttgtacaagaaaaaggagtaaacccatcgagagactatcaatgatgccattggcaattgatgaagctgaaatagagagactccataatctaagattagcattgcttttacaagaaaaaggagtaaacccattgagaggctcaatcattgatgcaaactagaactcgtgattgcccattcaaaccaaagcaaacatagagcgaaagcaaaactaaataaacaaattaaagagaagcacaaagttttgaagagaatccagaaggcaattttcaaactcagcctaatgtttttctacagaatcaaatctcttgcgtaatcaattgatgcagtagcttcatcaggcaccactatcttaatcctgaaaagagcacgccccaaacaaataactgagtaacattttgatttctattcaacaactgaacaacattttgttgctagttattagtaataaggaaaaaagtgcttgcaactggactacctcttgcaactaacacttaccaagaaccttcacatggaagctataaccagttcacatacaagccacatttttgttggagtaacatacataatatgaatgtataattgttgacccctagatgcatcattaactttaacgtctatttaattcatttttctttgttttttttattttttaaataatccacaggctggtggggcgggatcacttcgtcctgaaggtacttgttcaaaacttatttaaatttaaactttttatagatgaaaagaacgaggaaaaagattaatgtattgattggtcacaactaaaatcttgatgacatcattaattgtgcagaatgtggaaatgcatgtgcctatcgttgctcagtgactcaacacaagtgttgtaatacatgtttatgccatcaggaacctatggtcacaaggaggaatatccatgctataacaattggaaaaccaaggaaggaaatcccaagtgcccttaatttaagatccttcatatttacatgcttatcaattttatttcattcatgtatttctctgttttctacggtcgattctaacatgaatcaccccatttacggactcatcgatgaaccacccatttttacctacaatagcaggtcatttaccggaaggaaaacaaaaaaaaaattggcaacacaaaaaaaaaaggttcatgagcgaaagaaaatataataataaaaaaatcgaaaaatttaatataattcaataaatttatcattttctctctcctccccgttgtgcttcttccccgacaccggcctccatctcttctgggtagatcaggatcttgttgtgctttgttctacatggcttgtttggattttgattgagaaagctcttgattttaattttaatttttttaagttgttccttatcggattttggttgtttgtaaactctatgctctggttttgagagctaccagtgtgtctttttaacctttttttttttgcttcatttcttggtttctgaaatgtttttcaactggcttggtggcctacaacatgaagggataaggcagcaccttaagctttgcagatgttcgttggaaccaaagttgttgggagggcttgatcaaatcataaccaaaaatagtagtagaaaattgggaataatctccactatcgacaaagtacaggttgagcactgatttatttcaaaatcagtgtcttctactcctccaacatccaagttatagttcccaaaaccattaattatatgaacttctagaagattgaatttagataaggtgttttttcatcttaacaatacggttcatcacccctgccctagagagggttccttcctggtcatggtttctgaaaacagccacccaaggaatttttgatgcaattgtaggagcatatgcagcatccaatgatttagctgaatccggggaatcaaagccaaatatattatctgctattcgcaggcgacaccttttcgcagccctcgttgaaggagaaattggagtcgcaggaaccgccgaacaatttaaaaaaattaatggtcatttttaagtaaaaataggttattaaaatttaaaaacaggttattttttatgttcattttttcaaattaattttaattggacttgcaggtttttgttaatggtcattttcgatgaaaacagtgagtcctgcaaggttggtagtgggagttgcaaaagaacgaagacaatcttgatgtaagggtcaaatagaaaagaaagaaaaaaattaacaaaatccgttgtaacatatgaaaaagggggatgcgtcaagtaaccggttacgactttaaagtcgtaaagcaccatccgactttaaagtcgtaagcttgtttttttaactttgttatatattacgtaattttattaatattaaattttaaatatttttaaaaaatatataaatatattttttttgttaataaattttttaattgaatattatttataaaataattatttaataaatttaatataaagaaaagatggtttcaattaattgacaaattatattatatcattaaattatattatattttaagtatttttaaaaaatctataattattttatattgtgttaattatttttttaatttaaaaatatttatagtttgtttttaaataatttatttttatgatttttttatataaattttattttttgatttaatgaatttaatattattattttatatattataataattaaatttaaatgttatttatgaaagtgctaccctaagttaactccaaatgaaacaatttaagattattattaatccatcggcatttacgtttactcgtaatttaattttttatcattaaaaattataaatggtttatcggttcagcaagtaatcagtttgtaatttgaaacctgcaacctattcactcggtaatatttgtctattaaaatattatatattttttttggtgttatcaatttttttttgtttttcttccaataaatgacctgctattatagataaaaatagataattcattgataagtccgtaaatgggataattcatgctagacgccaccgttttctacatctaattagattttacgtactgtggccttcttgattgcctcatgatgagttactattcacaatagattaatgtgactcttcgacccaacctacaacatcacctcctcctgcgtcttcaaaacctcgtggatctcctgaggtttccattttcatctcacatttataatataaaattttcttatcaatctttaaataaaatattcatatatatatatatatatatattttaagaaataactaattttaaatatttcaacacagattataaataaattatttgatgtcacagtatattcctaatcagcggttagaggaagtcgtcatgaacgtagtagaacacgaacattttaaaattaaaaagtcttcgtggagaccaaggaaagactagatttagaattgtgaagattaaaaatcaatgagagattaatgtgtctttttaaaatatattaaataaaaataaaaatatcaaatttacaaaatgatctttagactttcattgtaaaaaacaaaaaattaaattaattaataatatgatatgacaaaataagtaaattaactaccatatcaagaactgaataatttttccttgtctatatacacacaaatggtgtgtatatttatagctaacaaactgtaaaatggaagttaaaagattaaatttgaatagtatagtcatgcataaaggattaaaatttaacataaaaaattatataactttttaagtgatcatataacgttaaattttaattattcatatttaattatattgtttaaatttaattttttcacttttatataaaatatcttcttttcatgatatttttttattgtatatataattcaaacttgaaatcatttatttatcagtttgattgagtttcgacgaatcagttcttatcaagttacttctcatgacaaccatgcaaactttcccatcacaagaactttattttggttgggtcattgaagatgatgttaaggacagatttttttggacattgcttctctcaatactatgccagtataccatcacctccttcaacgccctaattggcaagtccccttctaacatcaaatttaaccaacagcacttttggatagaggattagaggctaaggtgatggtgattcaaatcttgatttgtgcactctatatgctttaataatgatagacgtgagaggcgagttgagaacgttccaaggcaataatgatgcggatagggccattattatagaaacgactacttgcgcacttgatcggtgggtctaaatgagttaactttagtcaaattgacctcttaaaatttaagtttgatttataaaaaaagattaatcaagtttaatttatttatttagataaatctaattaaaaatttggactttatttattaaaaaagaataaagtttgaatttgacttgttaagctcatgtaaaatttaattatttttaatttgtaaaaaataatttttttaaacattatcaagttaatatttaataaattattttaataataattgtgtaaaaaaataacaatatatattaatctacgaatttaataatatacattaaacatgtgatatgatattttgaaatatatataattttaattttctctttatatataaacaaactattaatattgaacttgtaaaatttgaacttgactcatttaaataatcaagtataattttaagtttgaatttatttaattaattaaataagcttgatcaaatattttacaagtgaaactcaaataattcacaaataatttaactcatttacattttattagtcacaaaaaatttccaatcccgacagatcaatcacaagtaacaacaatgtttttctacatggactttgctagttgttgttttgcagttgtttggcatacttcttttatcatcattttcaagtttccaactttcacttggaataattattatcaaaattaataaatttactatacatagttatttgtaattaaataaaaatgtaaaaatattttaagtttcatgtcttattttttttttaaaaaaaaaaactactataaaaagtaagtttaacccatgaacatccatttccaatttatatttattcactagctcttaaaataaaattcttcatcgccagcaattagctcttatcccttggtgtggtgtcaaagggcgagttcctttcttgttttgcccaaaaaattgttagaattctgttaatcctaatttatagactaatatttttttattaaagataagataaatagtggttataatgtttttaggctctaaaggacttttattccataaaaattaatataaaatcctaaattcggcattggtatttgtttttcccccgactcagttatggttatttctttctcattatgaacgatgatagatagatttatatttatatcagtcattgccgtaatcgtctgatttcaattaaacaccccacctaccttcttttcatgatcatctaatctccatgacatccatccccgagctaaagatgtgcacacctaacaccttcttctattcggctggcctttttcatagtagaaaacatttcactgattccgtcgtttgatttctctggaaagttctttatttgtgtttagtactagttactactatggtcagaaaattactccgtagagtaaaatcaatatttctatttgtatttttgtatgcatattgaatggaaactcttgaaaatatttcactttacgaaatgtaattgattttttttcttactgctgactgtctaaacgattaacaatgttaaaattaaataaattggctaatcaaaattaaactattttcacaatttaattatttgtttattacataacagtatttttattttatatatattcatttaaatacatttacggtactttaaccgatttagccagccacccgctcttcaaccaatgaaactagcttaacactcaaccaaatggattatagaacccaattcaataaaactagtttaatgccaccattgcatatcagcatacgattactgtatcctccgggtcagattatattttgatccttacactcttaagcctctacgaatcatatacttgaaattaggagattatatattctttaattagttcatatttcaatccttatactcttaatttctacacaccttttgtttgaggttgaggattatgtattctttggatcgaatcgtattttgatccttgcatgatcttattaatcgagtattaacgagatcactacctataatatcaatcaattaactgataaacataatcatgcacctacattattggaatatgacaaaatattttgatatgtcataatgtttggtcaacaaatattggaggatcgtgcttgacaaacaagattaaatagtcttctttttttttttatcttaaacaataaattaaataatatattttactaaatattttgaattaggtcttctcttttatgagaaaatcttttgtgaaacgattagcaacactatcactagttttgtgattagtgagaccaagtcaccacccacgttactcaaaactactccttaatcagcaatcaccgcctaattacccccatcgacattgttgtcgcgccatagttaattaccaccactctaccaacttgagtatgaagaagatctgagcacatattttgtataaataaatatttttagtgtaattaaatgttaatttagttataccggccagcaaacgatatggtgcaactttaattattattactattactattttttatatcatatttcatcttatcatgtaggagtgtattctatttttatttttttgtacttttttacttaaagttggcattgaacccgatcaaagttgaatttattagaagaaactaatcttcacaaaaataatatataaagagagtttaattttgataaataaaattacactctgaataaattaaaatttaatctagatataatttttaaattaattaaaatcaataatcttgctatatttatttggtaaaaaccacacatttcacaaataacaattttgcttaagttgaatatacaatcacgaactataaaatttttactctaaatatttattgtcgttatatgctcatgattcaaattcaaaactactaataaacttaaactaaatttatatcaattgattgacatgttttgtgatatataatttagaagaaaaaattagaggaaaatgttggatattcatcgtataaactaatttacacataagtgaatagacatttgatataattaagttaaaccgaatagatgatcaaatgataaaactgaaagaatttgatcagatgattttttactttaaaatctatctaatccagatcgcgaatacccaacgtcagtcaacctagtaatacagacaaatcatcttccaaaggaacatatacccactaatactaaatatttcgtatttcaattcggataaattataatgacaaacaatttaaaaaattatagataaaaatgaaaataataaaattataaagagaatatgtgtaatgtattgaatattagcctaatattataatcataattaagttcctttagtcaaaaacatctttcactggtgatgatgacgaggaatgacttcagttagactcgaaagaatactgagaatttgagatgctttagttgcacattaatttggtctcagctagcttctaacgcagacctttactcctttcacgaatttattgagtttaaatttatttattgtgtaatatttattctattttgagtctaatgctgcattgttgctttcttatttaatacgagtatttactaagttttcaatgctccaaaattttaaggtacagtaacattttgtatcttttcttattattcatttaatacttttctttaacataactgattagcttttacgtcgaaatatttaaagaatcaaaatattttcaccaatatctcaattaattaagacctataaaaaaaataagaaatgcgtcaaatttagtaattcctacaaactaaaaaataaacgttgaaagagtcattcaactcagattgaaattgaatttaattttttttataaaaaaaatcacttttaattatagaaaatcttaaaaaaatattgcaagtgtttaatttctaactaggtttgaattcctttattaataatcttagttatatgggtgttagtacagagtgcaaacttacattgaactttgttaaaattgtaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttgtcttttatcagttgttattattgagagcttttctagtggaaatataatactttttttagtagataagctttcaaaagtacttctaatcttgtatccaaatagatccaatgactattacttcttcacaaaagctaaaaaaaaaaagtataacaaataagtctttttgcattaattaaatgaattaaaagaggataaatatacaattaaagaaaaaaggtgcaaacaaatgtggttatggacgtgcaataaggttcataagtggcaggcaagcaaagcaaagcaaataagtctttttgcattaattaaatgaattaaaagaggataaatatacaattaaagaaaaaaggtgcaaacaaatgtggttatggacgtgcaataaggttcataagtggcaagcaagcaaagcaaagcactagaaactaggaacagagaagaactcagttgccaaactatttttctctctcctttctttgtgcaactccaaaatgcgttccataggggcaaaaaatctagcactctcctcagccttgttgctccttttggtcgattttgcaacctcagacatcaaccgagacaaagcagaatgtaccgacaaacttcttggtctagctggttgtcttccctatgtcggtggtgaagccaaagtccccaccatggattgttgctctggtatcaaagaggttattgggaagagcaagaggtgcctctgcatcctcatcaaggatcgtgatgacccgagtcttggcctcaagatcaacgtcacccttgctctaaatttaccagatgcttgtaaaacacccaccaatataactcagtgtgtcggtaagtgtgtaactatacggtgtgtgtttggatacggcataaaatcgattttgggggccaaaaacagtggtgtgacggtgaattttgagaaacaactatgtgttattgtggctcgatcctgagattggccacgatttttttcacggtgccgccactccaaacacgcacataatctatttatgacacttattttgttacctttatgttgtgccggtacccaattttgatgttttatatgttgttttcagatcttttgcatttggcacctaactccacggaagctaaggtgtttgaggggtttgaaaaagccttgaccaacaaaactagtccctcctcagtccctagtggtaaatattgttgattaatttttattatacgtaattccactttttattcattcctttaactatcctggaatttgttgtccgcatcagggttttaaatcatgatttgtggctgtggttttggctcatttcatatgcatacaaagaaaaattgatgttattgtcaaaattattcatattttttttcttcaatgagtctaattcaataggttgaatgaatgggtgtgagtaattgtgaactcactgatattggtattttcaattctgttaattgggtctcagaatgaattatagaatctaatttacacgattgaaaatacgaggaaattaattatagaattgtgacggttaagagaccaaaatataattgtagtctctgattttgaactgaaaattgactgcagctaatagcgcgactgcaaagggaacaagcacaagcacgaacaacaacagcggtggtgggtggggaaagaggtggttggtgacagaggtgctttgtgggattttaccgtttgttttcatttctcatttgttcctcttcgtagtttgaaccgagatcaagagtagtaggatgttttggtggttgtgtctatttatttctcggattcatcgcatgttctgcatgtaagtatatgttatgcaatttgtgatttatttttactaggttgtactgtctttttcctttagttatttttgcctcagtgtgtgcccatcctccgttgtctgcgtgattaataatccaactaattgaaaccattgaaggggacccgttacttgacctcaacaatgtgtatgctttaaatatcattgtgctaggaccctctatttacacttgctattacgtaattggttggatcgatgttgacatcttttctaagtgttcatttatttaatagtaccaaaatgagacatttattacgggtttatagcaactgtaatcaactgaactattgattgacataaaaacaacttagaccatcttcaaacgtccgtgtttaaatgagatgtttaaagttaagaaatattacttaatgtaacacccccgtgtatacccggtgtattaacattgtataatcatcagattagcgcttaagcaagataattaaaacctttttaaaacatgtttatattgcggaagcataaaaccaaaccatctctcttgataacattatgtatggagacaaaacccacatcaagtataaccatgccccctgctcaaccagatcatacaaccaaccataggcagataacataaatatctcaaagatataaacatacaggagtaagcataactgaacgaaaaccgtatatatatatatatatacatataaccaagttatatacaacatctgatcccgaggatccttcctcacatgagagggtatacaaaatatacatcaacagtgtataatacaaaacacatgcgcaacgcatgtcttccctcaaaggggtatacatcaaaaataaacaaaatgctgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagcgccacctcccgcgccaagggcgccaacctccagagagtcccgcgccaccggcgccagatcccacgcctcaagcgccatcttccagagcatatggcgccaaccgcgccacccacggcgccaaccgcgccaactgggaaattcagggtggttctggcgccaccggcgccgacctggcgcccagagcgccaaccaccagagaccatggcgcttggagcgccgttcccgcgcccacagtgccaacaagcagagaccctggcgccaagggcgccaacctggcgccgtcagcgccacaccttttggccacggcgccatccgcgccacacctggcgctggccgcgccagattatgcagaagcaattctgcagagtgttttctgcataatccaaaccaaaaggcctcagactcgcgccacacgcgtcctaattcgcgccaaacgcgctgggactaagggatattacacttaacaatttatttttattagagttgataatttgatagtgaattgtttatattaacaattgttgtttaattaattattacaaaattaaaaaaaaatttcaattcaaaatttaatgtggttcaaattaaatactcactctaataattatagtataggaataaaaattttaaatctatatgacatttttgcaagatttataaatttaagataaataattcatataaccatcatataatttccaaataacatatatagtttcaaaattaaaactctctaacattacatataaaatttacatgaaatgaatctctaattctccacccaatcattattacatttaataaacttatatattaccagatatgcaatattacgtcttccatatagtttattttatttgatcaaagacattaaattgcatatcaatgtaatgaagtgtgctatgtctagtaccatatataaatccaacatatacatatacttgagtaattaaatgaacacactatttattgtaaataataaatattgaacattatgtcttatttgaatagtttaagtgaaaagataaatttatataaatttttaaatgttgtataattaatcactactttctttttttggttaaaaaatatatatatctcaagtctcaatagatattcagatattaattctttttgaggcataataatcaccaaagtaaattttatctctttaataaatacttctttatgccatgactagctaatcgattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatagacatgcaacattacatcttccatatattgctttatttatctttatcaaagatattaaattgcatcaatgtaatgaagtgtgctatgtctatataataaatgtatttattttcattaacgataaacttacatatttctagacatgtaatattgtatcttccatatagttctttattttttttttaacaaaagacattaaattgataagataatattttattagatttgtttaaattaattcaaaattaattagatagtatctgattaaatttaaaattcattacccgacatgacaaaagcagccacatgtcaataaataaatagatgaattatcaacttacataaatgtgtattatttataacctacaccaaagtaatatgcccttactaaaaagaaacaagctttgcaacttggtgcatacaagttgagtccaacttactgacaagaaggcccactgtacaagacacaaaaaggctcaagctaattgatttttttacactcttaaaatatccctcttctctctccttgtcaccctaattatatatattactgattaaatattaaacttttaagaaaacatttggtaacactgatgaggaggttatcgtgatttcaattatattcaaatcaggaaaagtaatcaccctagtacacagaaaaaaagatcatcacgtggaaaacaattgaggatagtaaggtaacagggtaaataaaggccaacatcccaatcgttgttatagccaagaccggactttggcattcattattaaataagcacgtttaaatcttaccagcaactgaaagttcagcaacacacatgaagttgaagtctcagcttaaatatgtacataatatcatgttcataaaggtctcccgaggatataatataacgcaaccacactcggttttgcgagtcttggacactttgacaaatataagctaaggcaatagagggccagtgacaggttaaaacgtcattccattatgaaatacaacagctagtatgaaactggatctactcagtgagaagcatgggaatttcatcgaccggagcaggtagctgcaaatttccagaagttttatgcgagttagtatttctctgactgcattagaaaaaataccaaacaagggaaaaaaggttgcagatgatatttatttataagataatatggacaaacttaactagtgtatgcctctaattagtggaaaacttgcagttttgaggatttgtttgttcatttacaagagcaacagatgattgaaaagctcatattaaccatcctacccttcccatgctcagaccatattgcatacacaaaaaactcatattaggtgatatgatcaagagcgtttgtcagcatgccaaaaactcaagctattagcataggtgcaattcttggcatataatatcctgcatcagacacagacaattccctatttaagccactagatatcaaccactacgttgaacccgatccacagacccaatcagtacactacactacacaccctcgtgacccttttgggcatatcataagagacgttgaggagtccaaatatttcatgagttattacatactcacaattggccataagtagagtgaactctataacattacttcccccttggcgcaaggaaagatcaatgactgccttcaactttaaagtgcatttaatacaagcagaaacggcttaaaaccaaggaactggtgcgaaactagccctgatcccaacaactttctatctttttttattcataaggaattgaactcaagtattactgaatttacaataattcacgtacattgtttaaccgactgaattagagcccttagtaatcccaacaatattattcaatgttgtactactataaattaggtccactgcatagtttgagttccttgtattgcccatagggcaatatatagactgtattgagtcaattccttcaacttttcaaaaactctgttttagtcgagaactagaaaaattaatctctcgaaattcctagactaattcaagtggatgatccctttaaattcctgagcatgtggatacgcatgtcgtaaaacacatacacactaagaaaccctgaatctgatgacataaatcacacctctcatgaaactaattacagagcatcaaaggtttaaccatttcagtcaaaattcaaaaaatagagacctaaaaaaaattcgttgactattccccatacttagcttcgatgtttacttaagtataagtcttttcgaaccagtttctggattagagcaattaaacctaatctagtgttccaaaaataacaaaaatcgagcgtctaaacaagaaattaggaaaagagtaaaagaatggcgaacctgaattgaacgtggaaggcgaggggggcacgagagggatttgcggcaggaacgaacggttttgaactggtcaacgtcgagtttcttgttgatgatgccgacctggaagtagatgctgtcggagggtggcaaatcgaccctgatctcgtcgacgttgaaccagagaaagaggcgctggacctgaatgcccttgagattggtgatggagccgtagctgagcttgccggagatcttgctctcgtagtaaactaagtaatcgaactgtatgtagcagggcttcggcaaaacgacgacgaattggccatcctcgtcgagcgtgtagtcggtgacggtgtccggtaacagaccactcgggagcccgtacttggggagtatatcgtacacgctctccttcgccgccgccgtgctaacacacgcgcaccacaacagagtcgtgaagattgccatggcaacaaacgcgtgtgatgatgatcggcttgggggtgttgttgccatggctgaaaacgttagagagagagagggctgtagagacaacttccagtgaccgcttcagttacgattctctctcgctctgtgtctggtctttgtctcctttcgggaagagactcggtttcaattttaaacacaccaacaactacttacatccattatttcgaacgattgtttttattttatcaaaaattaaaaattaaaaactatttttttactccctctgttgcggtatataatgattacaaaattaattaatctcaaaaaattttaactttttctaaaactatcttttttttattaattaggaatattgaacttgacttgaacaaattcatactatataattaaatttattatatgtaaattaattattaaatgcaaaaaatattattttttaattcgtgtagtttattaaattattaagttaaacaatccatgattttttaagttgtcatttttatttttgtcttgattttatttatattttttatgttaatataacattttatttctatctaaagtaaaatatcatattagtcttgaaataattaattctattagtcaaatattattataatttgatttctttttaatatatttagtcattatatacatataaagctttgcgcaaaaataaattattgttttaaaattgtattttttacaaataaaaaaatatatattttaaaatatttagatccaattaactttactcgagtcaaccaatttatcatcagggctaggttgggtttaattttttgtttacaaacctaaccaaacccaatacgtaaatatttgatgggattgagtgataggttttgttaaatatgattcaatttaacatgtgaacactttatcattaatattcatgtctctcctaattatttattaatacattatcttttcttttaatgagagatatttttagtctaataataattactacaaaaaatattataaattgaattttataaaaagaaaaaaatatcattttaaatttaaacttgaattttataaataaaaatgaaagaaataaccaaaaagtctttgatagagttggacatttgggtttggacccacatgtcgctcgcgatatacatgtcttgaaattttgagtccgtttgaatccaggtttcggaagtggacttgcttatatgcttaacctgaatcttcaacatgtaatatatgactgtgttgtttcggtgatttataaaaagaatttgtggaattggttatgcgttggtaaagttgtgtttcggtaatatgactgtgttgtttcggtgatttataaaaaaaattcttctggagcttgccaggtatttgctcgtttaataaatcatatttcattaatatataataaactgtatcttcaagaactttttataacatccaagttcgtgggacgcgtggccgtaccaacaatgctaaactcagcagtcagcagtcagcagctttcaagtttcaaatgtgactttttgtttttgaattttgagcataataaagatatttttttctgaatgaatataataaagttatatttccgcaaacaataaatatttttaaaaaagtttgctaaaagcgagtttaatttatttatttaagataaaataagcctaaaaaattattatgtactaagaagcacaaaacttagaagatacatcttcgaagatatatttagtattatttacctaattgattatgttaatatttaatataaatctttattacatgaaatacgagaatgaaaatttaattttaattgaaaaacaacacaaagcatataagaaattatttctaagttttatcatattgttaaatctcataaattcataatttataataatgaaactatccgacaactgtacgtgaatctgaataagattattttaatttaaccactagtttcaaatttgagtcacatatatgtaattgcgctagatacttaatatgcgtccacattaattatatccgaattaaacatgattatctccattaaaaaatgtctatggtctgaaaaaaaaaaaaaaaactatccaatacaaaaaaatcacatgcctccattataaaaagttcaaaacactatctccaagtgtgtgaacgagctggtttgagattgctccagtttcatcagaattttttagtttaaatcttgtgtatgcaggtgcattaaatacgaagagttttgtcggtcgtaatcgaataatattgcttgtcctattataaaaaagaagttaaaaacactattgcataatattattaaagttggctacatagatcatggtcctaggctttttttaatgtttattttcatgaaggcttgttgtttaacttacaactagcggaaacccaactttgtgatgcctattggcccatttaaatgcttgcttattcaggttaacctatttaacccatgacttggactgaaccaacccatgtaatattttcttttttgttattttagacttttagctcttttttaaaaatatttttatttaggtttgcaaaccaatgtgaaaatgatttgaaccctgacttgcctgttcacctcgcaagcaaatcctgcttgccctatttgcaaactaacgcaggccatacctatgcaaattgcggctttttgactgataaggggcattcttgttttaatataggagtaaaaattttaaaaaaattattatttagagataagtcgtgctaactttttagtgagacatcgtgtcatgtatcatgatttttattttttattttctgttcaagtagtagtaaatttaccactttaccgtgcttactattcaaaagtcctacaagcacctgcacgttttgcttttttattcatttgtagcagcacctacaccttttgctttttattcttttttttattgagtttggcttccagattttttgttttggttagtagcgtggccttttattctttttattttggttagtagccttatttttttttttatatgtatgtatataggttacgactttcgtacccatatatatatatattaaaattgttttatatttttattagttagtaattttaatattgtaatttgaaaataaatattttttgatgaatttttttaataataagcattttttatatataaaataagatatattaattttgataaactaaacataaaaggggtttattttttaattttcatacttattaagtaattttttatatttgttattggtgtataaatatgtaacaattttatgatatgtgttacagtttcttatggacatcttatgacaccctcaaaataaggtcattaattcataatgtagacatatttatgattgtgtcatgagataatttgaaatgagacaaaatatttcacataacccatcaaacctggacaactccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgcacctgtggcgctaaccgcgctggaaaccagagagaacaggttttccagagcacttctggagctatccgcaccagaatccagaggaaacaggttttctaggacacttgtggtgctgaccgcgccacccatggcgctgattgcgccgcacacccagaggaatgaccctctagatctcattggcgttgatcacgcccctatggcgctactagcgtcatcccctcaaatgcctggcgccatccgcgccagactccagattatcacattttcgacgatgcgtatatagaagaactcataatcataaatataattcattcaaattatatgttcggttaattttactactattcttacaaaattaaattacgattattgtgccaaatactttattaacataattatatttgtaaaaattacttaacaaaaacaaattaaatataacttatttcatatattaaaagaaaatattattatcaaaatattttaagtattttaaattttaaattttaaaattagaaacatattatacaaaaacaattaaataaatattcataatacaaagtatttataacattaatttcagatatattaaataaaaagatataaaaattacatacaaaatattaaactaatttacattaattcaaaatgacttgcttttttaaataattaaacaaacaaatttttaattctttaaataaccaaaaactaaaatacaatataacaaattcaaataacacaaattataaaaaacaaaataaataaaacaaataaaaccaatgggttacgtaacccacgtatataacaataattttaaaaaatgataaacaaaaattaacgaaagaaaactaaataaaaaaccaaaattgaataaaataaaaaaaacctaaaacccttaaatcaatgggttaggtaactaacaataccaaatggggcttctgaacatacgagagatcatcataatcgtggcccccacttctgattctgatctcaaggctgaagcttttgcagaagatgatggaggcgtggatgtgggacacgtgggttggtgccactatgaaggatggttttggagtggtgggggaagtgaatctgaatctgaggtttctgatgtaggagtccaaggtgggagggtatgaggtgctgttggggaaatatgtgacggcagagattggaattggaagagatgggtcagaatggagagagaggcaatggagaatgttgtcttgaaaaggttctaattctgaagctgctgccattagaacgtagagtagaaagattcagacaaagggtaagatcgcaatcgcagacatcgataggcaatggatggattcagatttcagaggttccttatggaagaaggaagccagagaaagggatgatcagatattcgaatactatagtttcttcttccgggttacgcgtgaaggataacgtcgagggtaaacaagagacataagaaattcttaagctacactttgttccaacgaaaaataaaatgaaatgagatgaaaattttaaattgagatgaaacttttgaattgaagtagagtacaaaagtgtgatatttatatagtgatggactgtgatactagtgattatatttcaatatccacaaattttaaacactttatcaacgattttaatttcattctttctctcttttatcaaattatattatatatcaaatcaattacttatttttctttatctctctcaaggtatgtgtacaacaaatattttccttttctttttctacactgttaggcgttagctactaaactcttctttctattatcttgttcaaatacttttaatatttttcttttttagatatattccatgtattatagttgtagacgagtaaaaatatctcaaactagttttagtaactatgtaatacacggatatgcaaattatctattgatcagtaattgcaaagactaacgacaacaaaaatacgagttttagagaccttttaaactttgttttaaaaagaattaaaataaaaaagagtaaattatagggattagaagtatattaaagtcattctatttttctaagaagaatgaattacatgatcaacatgtctgtatataaatatattattttagtttatagttatgaaagtgatcnnnnnnnnnntttatcaacgattttaatttcattctttctctcttttatcaaattatattatatatcaaatcaattacttatttttctttatctctctcaaggtatgtgtacaacaaatattttccttttctttttctacactgttaggcgttagctactaaactcttctttctattatcttgttcaaatacttttaatatttttcttttttagatatattccatgtattatagttgtagacgagtaaaaatatctcaaactagttttagtaactatgtaatacacggatatgcaaattatctattgatcagtaattgcaaagactaacgacaacaaaaatacgagttttagagaccttttaaactttgttttaaaaagaattaaaataaaaaagagtaaattatagggattagaagtatattaaagtcattctatttttctaagaagaatgaattacatgatcaacatgtctgtatataaatatattattttagtttatagttatgaaagtgatccatcatccatgattggtcaaaaagctccgaacatattttcagtgcaaacttccctcttctactttaacataaaaccttttctaactaccatcatgtaatctacttatattgttattcggaaaagaaacttacatatctataaaacggctatccacaagtgtcttttaaatattcaaaatacttaatattgtatgcttattataattaaaaagaaagtaaaatttgttactcgaaagactaagagtctaatggcatgcctggctatattcttaatactatatgatatactaatccgaaaacatacataaaaagtataaataagaaggatatagagaaaggaaaaggaaacggaaaaagggcttccttccataaatgaacctcttttctgtgttgcttcactgttagaacttcgaagtttctaacttgcatggcagttgaaggaaggtttgtccttggtccttggtccatgtcatttaggctttagcccctagaaaacatttcttgaacatcaaattggacacagaaaagttgtattctttgattttaaggagtattttttatatgcataaataaaataagtaaaaaacataaagataattgaatgatacgtaacatatgcgttaaagctatgtttcaacaatggaactgcttaaagtttaagaagtaggcaaatatatgtattatctaatacatatcttgaccaagggtcaattcgggccacctgtttaaacacgtcaaaagtcttactaaacaacaaattacacgtttagttttaagaaagctaccaattactatgataattaaacaatgttcccattgaagtattttttgaagtcaagtttacctgaattaacaatagttcaaaaagtatgatgcctcggcaagtagagtaatattaaatacgtaccactcacaaagctaagttctcttttcgcctgacgacaatcataaagacattctcttcaagtctatccactttctgtgttttttctctggcctatggccatgctatacacatgctgagattgtaatataaatagtgaactttcactctttcaggaatcaagaagccattctacagcaaaatctctctctctctctctctctctgagcttagagtttgttttaccttatcttctataatggatcatggaaatgacttcagtggcagtggcaccaacaagaggagcagcaatgaaagtaacgataggaagaagctattaatgagcagacaaatagtttttgagaatgagaaagaagacatcaacaaaatggctgatgcattcgtcaacaactgccgcaaacaactgaagattgagagagaaaattcattcaaacgttttcaggatatgataaacagaggcgcatgagtgatttgagctgaatggaattgctgcagtggctaaataatagtagtgtgattgttacttcacatacgcaaaaaaaaaaaaaagtgcgattatttcttaaaatggagaataatacaatagtgaaggatataattttggatttatgaaaagttcttcagtagttcataaagttcagagtttctctaaatatttttgtattcctctcagccaccaaacattcagggaaaagactagttgtgcatctacctttttttcttaatttacttttaataaatttgtatcataagtaaagaagtaattttgctcaagttatagtttaacactaattgcatacgtctctcccaacaagaatctcgaactaatcccttctcctagacttgattagcgttggtatttgaaatctgtatttgacactagcttttagaaaaatattatccaagcagatactatactattactcttaaaaaacatgcaactgattttcaaaccatccattggaatgacttttgccacaacatggggatatgatattctgttccccctgcttactgaataaattaacttgaccaaagatacaaaagttttttgatgttttctaataaatcatatacagcggaaacgcatgtcttacaaacctaatatactgtaaagaaaggaaaaggcacagccttgagtgaaacaacatttacaatatctgccccctattcataattgtaaaggaatgacctcattctatagccaaaatcaacaattaacctcatctttacaatgaaagcacaatctctttcccacacaggaaagtggataaacctgtttcaatttgattttcccaaaataccaacaatttcctaactgtatagccaagattatcatcagaggagtttggatctcaggcttgaagaacctgacaatgaacaatatgactcttcaaactaccacgtccggctatagtcgaccataaatttctaactaaagacctgacatgacctttcccagcaatattttcccaaagttgaggattgctttccacacgtctgtttggactcaaaacatcaactagactgatgctcatattgttgcgtataatgcaaagccttccattaaggggaacaagagcagcagcgtcaagagcacgggaactacctaaatggagcttgctatcaatgaacttcttccatgaatctgttgctctgtcatatactttgagcttgcacccatcctggcaatcaagtgcatagagttgcccattcagtgagatactaggattacgccaaccattgaccattccattactcactgggatccaggtatcagtttcctgggaataggattcgcatatgacactgcgattagatccaagtcctttcaaaaaccatgttccgttatgaactacaccaataaagggaaccattgctgtggtcatctctgagataaagctccacctgttccggttagggtcataaacttcagcagatcgaagagttctttgaattccttcacactccccaccagcaacatagagacaattatttattacacaagaaccaaacagatgacgtttccgcagcatgtctggtgctctatgccacttattagtacgggcattatagaaaataacacgtctcatagatcccttcagtggatctcttccaccaaataaatacaggtggcaaccactaagaacggcacagccaaatcccaatgcttcagaatattccccaggaacaggtggaagggattgccacagttggtagatgggatcaaaagcatgcaatgaaattcttccatcacgatctcttttgatgacataaacccattcttctgccattccaagacttctcctgagtgaatagaagaaatttccagacaggaggcgataccatctcttgcaaaccaaacgcagtttactgtgctcaaccctaggcacacgaatcaaacatgcaatagcaagatcatccggaagaccaggcaggagaggaggctgaactctggtcctctctctacgtgagtttttgctcctatgtgcattcgggtttatgtcaggttggatacataacttcgatcctggaacaaatttccttgccccaacaactgttttcaggcctgaatctaccttacagtagcaagaaacagagtcaacctgtaaaattctcaatgcagtaagttgaaagtaccattaaaatatcaaaaagatttcaccaaaaatatgtatatgcataatgtccgagagcatattcacatgcacacagtaagctttagatacttctccttccaacttcaggttccaaagaattgaacagttcctactttctatactgctttttttcagcaagaaaacaataaaaggaagttcaagaccaataacttcacaatctattgacttgtcaaacaataaactattattaattttattaagctgaaatctttattttcttggaaaggtcatattaagttttaaaattataatatatgaatatagtcttggaattttcaatggctatattgtttgacttgttgatcatgagttcgaatccagaaacagcctctttacatatgtaagggtacagctgagtacaatattcctcctccttaccttcgcatatcgaggaacctttgggtaatggggtacgtaatttttgtatagccatggaattttcaatgctgcaggtggggcagtaagatcttaagaccaagtaaggttatattagataggttcattacatactatgattaaaatagcgccgctttagcgcgctatctcgcatcaaccgcgagttgcggcacccagccgctacttccgcgccgcaacgtgacggtttccggtagcggtcggtggcggcggtgcggttggaagctcttgtggcgctatcgcaccgctccatggaagagaagcgagttgcagagctcctccgccttcagccgcctctccaactcctccctgccgtccttcctcagcgcgttcagctccaccaagcctccgaacagcctctcgccgaagaagatcttcggcaccgtcgcgcttcccgttctctctctcagctccttctcccgctccgcgaaatcgcacggctcctgatgctttgaactgtgttttctaaatttgaataagcggctgagatgcaatttgggactggagacacggatcgtgaaatctaattgcttgctttctattggttgattccactgactagttgtggtacgttggaacttggaagccatgtgaggattatgcgttatggagcaattttttttccagcactttttattgggccctcggcccatgaaatgtaaaacagacttaggcttttacttccaacatcccctattttgcttcttgaaccccgaaaaaagcctcaaagggataatttattataagtatggacttcacagtagtggctttaccgctatagcgtttttggggtcggccgctaccgaccgctacccgctacccactatttaaaactatgacttcatgatgaaaatgttgaacaaatgccataacacttcagctatcctcagcttctgctaaaatgtttctattcaaacccttaggtctaatatcctcaaattttaaaaagtaaaaaataagggatatctgcaatatattggaattaaaatacatgcaaatgatgctcggtcagagtaacataaaaacagaaaacaagatcaaataaatcactttattactgcttgtgaggcttaaataaaggtgttaggcgtaccattattatccacataaaatacaaatacaaataagagaattttcaagagaaaacaaggagcatctgggtatcaccagagagacatcttataagagtttgaaagtgaatttataaaaatagttactcttaaaataatctcaagttaaaaaaatgaaatcaatgaaaaactcccctttggccacataagaaaggccttttcagtaactacatcctgcatttgtaatacatatcatgtaagttacacttccagaatgagggaaggtagtgacaagcagtaaatttgaaggatcataaaaggatgtgataaggtgagatgattcattaaacaggcttgatggagatactaccatcagatgaattttttaattgagacaaaagaaaatgaaatatcaggtagccaaaaaagtagtgaactacaataaaggagaaatacagaaaatcttgggaaacatatgaggacggagagtagataagaataactctatacaagagttatgataactgatcattttcaacacccattattataagacaaatagcttaaggtagagctagtgatattgatgagcagaagaatttgcaggaataatatgctcagggaaaaaaaggttgacatataaaccaagatgaatttaatttatcttatatatgtacaaatataacctgatagctttcgatggaaaatcatggggaacaatgtaaaaggaaaaatgaaaaaaataaatctctatgctatatgaaggtgacaataaaaaactaagctcactctttgatcaaatagctaaatgaaaacaaagaacaaaggctagatataaatgagcattgcagctatgtactaagattatacttgtaaatactatgtttacagcagctggaaaattcttataaaaatattccatgaaaaaattatatggcaagaaatggaagtagatagaagaaggatgaaaatctagctagccaaaaaaataaaacaagaggggaacattagcccaaaacagatttccactttctcagcacatccattagagaagttaaagaaaagtattccacccccctcccccctaaacaaaaatgtcctaaactcccttgttggtacctacacatgcttaagcctcaaacccaatacatacccgagaaggcaaacatataaaatcctcctggttggtaacattctctgtcaagggtgtggagtatggaggttaacattccccatatgtaaaacactagctaagtacaactcgtaattagcaagaccgaattgcatcaacaaaaaggtcttgggttcattcctgctgatgaactagtgatatgcaaccttggaatggagcaacccctcaaacccctaagaatttagccttttaggtgccaaaaaacaaagagaatggtagcattctcagtcaaaggtgagaagtaaggacgatggaggttggcactccataaatgttagctgcgtgaaactctatagtctagaacatcatgtttaggtaggattagaatttaggaaagtcaacacacaatgcatgttgaggcagcaagagacttctaagatctaattttgactgaagagccctagaaataaacgagagcttcttcccatttaagaactctaaggttcatagactacccaattgactgaagttacaacttagttctccgcctctcttccaaacacaagcagagaatgataggaactcaagttaaccaaaacctcaagcacagcgctggccaatcgaaccttttatccacacaaaaaagaaaaaagaaaaaagaagaagctgcaactgaaaaatggagaaaaagtcatactattcaaaagaagaaaactaatatgcagataaaaaattggagtgaattggactttttaccagtggagcttgaactctagataccctttgagtattcgttgagctttcaactaactggttcatttccgaagccgagtcttgcaaatgaatggatttttcaacgcaaattaagcatcttggtgcagatcaacacaactcctattgaacctacccttcaattcctggaacccgatccagtgagcagaagagaaaagcttgtatctttacctcaggaactgcaagagaacgaaaaacaaagaaaagggtcattcgagttttgaaggaaggaagaagaactaagactttaagagcggtgagatgaggagcaccttctctcactctcttctttcacctttggttgagaatgagaaagaaaccacaagctttagcttcacaaaaattgtgtgatttttttttctctcttggggatttgcgaaaaattaattaaagtggtttttttaattttattttaatgttaaactgagttgtgtgaatttgcggaattttaatataaattgtataactgtcataagaggacacatcgcttcattcgcttgtgacgatggtcctctttaataaatgagttgcagttcatgggtcaaaccaacccaactttgaaggcaaaggagggagagggagagggagagagagagggttttctttttttgatttattgatcgcagaaaatatcatccttttgtgggattgtgaagattggccatcacatggctacttcgaagtccgaacagcttttttgtctttttctttaacacattttggcttttaacatttttcttttcttttaactcacggccagtttggtgtttgcattgtttgcgagttccgatgatcgagttttggaggaaaaagatttgaattactagttgaaattaacagtttaattttcaaattaagagaatctaactttcatgcactatgagtaattttattatgttaataggttagaaataattattctaaaattaataaattcatcatatttgttaatttataattggatgataatgtaaaatatattatattaccaaagtcattttgattaaattcttaaaattaatcagtagaaaaaaaatgataaactcaaacagaactaacctaagaaagaataaattagatatattcagattatgaagttaataacatatatttttcaaaatattaaataaaaatgaaaaattatagatctaataaatacacaaattattataaaaatgataaaagtgtccaaattttttctgaatttagatttttaattgtagtttactataagtgcatggactaaatgacattgaactaatttagcttgataaatagtcttaggttttagttctgaatataaatttgcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacatttgtgaaggtttttttttttatatagaaagaagttaatgacgagaatttcacattttaaattttatcccacttcaaattactattcatgtctaaatgcaagagaacaacttccatattacatactgttactgcaactcttgttgcttaactgctatgcctttcatacttcatcaaaatactagttttttgtgtctaattaaattaattacctgttacatgtctcgatttattatcatatattgtaacttgattattgttcttgagttttaaaatcatcatacaatggagtgaaaagaaaatgattgataaagattaaaaatttcatccaccaaagcattagatatattatcacatccaacaataactaaaattgttaagatgtattagtttatttgtatacacaannnnnnnnnnctaaatgacattgaactaatttagtttgataaatagttttaggttttagttctgaatataaatttgcactaaatacttagaaagtttttatcttttataattatcttaaaagatatttgtaatctcaaacccccattttcacccaaaaaaataacagtctatttaagttagattaatttaaacttgaaaaatataaatttaagaattgaatcaatagagatcaaatttaattgatttagttcaaattagatccgattgcttaaaaaaatgaaccaagataattaattacacacataataaaaaggttgatttaattcgggttaatccagttttaaaaaatataaatctaagaattgaactaatttaattcattcaaataaagtcgaacttaagaaaaaaaaatcaattacatatatatattcagattgaattgttaggtcaactcaatttaatgaacacccctaattgagggagtgggttgaatttaaatatcactttaaaaagttatataaatagtaaatatcatggtagcatctatgtttcccccaaagttattcttgttatccctattcagtttttataaaaagtaaaataatgatttaataacatcaaaactataatgttaccataaaattactaggaataagggatgtatattaaaaatgggatagaattctctatgtactctttttttttctttctttcccacgtctaaggtttaataaggaagacaagtcctacattagtcgacttagattagaatagaactttctacttatgaagacaattatgggtcttaaatagtaaatcccatccacacgtccataaataagggtcccgtgctatacgtaatttttctccactcgagtatctttctattttaatcggaattattgacttgatcatcaacttgagagtccatggtcggtccacttctttaacgacctcaagctatctttgaatagacaagacaaaactaatctaactttatcataaatgtagcctttgaaatacaaataaaatggttggccgaacacctaaaatcaatataataatccactatgtcaaactggagggagaagaacctctattatttgtttcatttgttatgtatatagaaaaattacgagcatcacctatgatgaatgataaaactgggaaaccattgggagcgaagtttacttagaaatataaaaagcaaaatctggctgtgcacacatacaaattaccacaaattcacgtagagaacatactaaaataaaggcaggcattctctcttctaaactcgtttaattaagaaaagggaaaatatgagtaaacagtgtttgataatgtggcacacgctctgttgtgcaatgtaataagataacctttgccattggtctatgttcatctctccctaaatatagtattcaaagataatgaacatgttaccatactagtgtatgttcaattgaaatcgtcggcgggaacctgttgttcatttcaaccaccgctataatattacaaaaacctttgccaaagtgggaaaatattaaattccaacataaattggttgacactggaaagagcatgctttgagagagataagtcagataaccacgatcggcaataacaaaaagctcgatttctctccccttgcacaatctcccaccagtctcccaccaaaattaccacccaaaatgaagggtataaaaagttgtcgacaagaaactcctaatatgctagtaatcaccaatacccaccatcattacacaacctttattgatgtggctactagaccacatacacaaacccactccccacaatgattagcactgtaaaatagtacaaaatgatgatggcttgaaacacgagtaaattgaagatcataaaaacacggggggagtaaaaccatcccgtaggcgtatccacgcctatacctaagatggtatgtaatgctatgaaaagaagaaagtcaatcccaagcactagtgaccccaggaccataccctccaccagcatacccacccgagcctccatatccaccaccactgccgtttcccgcactgtagtaatctgaggaacctctactgaaagagccctctcttcggaagtcacgaccaccaaatcgaccacctgatcggcggttcctgcctccactgaaagaagatcgagcagcaaaccgtgagagccaagcaggtacttcttgatttgcttcttgcatcagttctgataaagctctagctagcgatgaattgttatcactgaagaatgcagttgcaagacctttctttccagctcgtccagttcttccaattcggtgtacataatcatcaatgtcattgggcaggtcaaagttgaccacatgagcaacatggggaatatcaagaccacgtgcagcaacatcggtggcaaccaatatgggggtgttgccacttttaaatgacctcaaggctgattctctttcctgcaggtatttcagaattgatgagcacagcaagactaacaagtatatacttaaccaataatattgttgcaattcaaaaccaacagaaaagttagtaaatgctatgaagtaaaagggtttaatatgagggtagcaagttgaatagcaatttcctaacactaactacaaagcaaaatgatgcaagaatccaggaccatgaccctattaatgaaaaaacctgggaaaaataaaaaatacataagaatatttgaaagctccaggtttgaacaaacaaataatagggtaataatatcagagaatgactgcaaaagatgtgccccaaaaaaggatgtagaatataacagaatcattttaaacctaataatattgcctgtaaccaaaaacaattcttttataggaataaccacttgatagctgttctagacttctagtcttgaaatgtttgacttgcgaatcttgcaaggctcaagattctgtgttttgtattagagtcacgggaatgcagtagacagaaaattggaattcaataaaattgcagaagaaacataacaaaatagtttcttccattaatgcaatggtgcaacccgtctatttggtgtatcaagtcatctctaaataaaacccaaataaaatgttcaacccactttattagctatggagatttcttgtcctctgttcaggtaaaagtaacttcacacattctaatcttttctcttctctgttctgatttctcattttctcttgcttctctgttaatatgagacagtcaggttggatattcttcctagatgtttttagaatttagatatatagttttccttctccactattatgctaagggcgtctttttttctgttgcttaaaaatttattgattggttgctaaaatgaataactactttaaagacactttttatccctcaaattttagcaactggtggttaaatgagggaggagccacttaagaacataccatggagagcacaaatacaaatgctctaagaggcctaagacatgctcttttcttggcatactataactactgtccgtgggttacatttttaatgagaatttcgtttttgtcagatatattagctctttttctaagtgagattacaaatcttaatttgtgcagaattggttaaaccaaaggcatcggtttgagagattgcagttgtgagagtgaaaggaattattaaagaaagagttcatactcattcagggaacatgcgtttcatttcaaatggcaaacaattgtgactataaacaaaagtcaatagcaatatgggaaagtgaaatgtggcaaaaaaggggaattggggattcagttaaacgtttcatatttttaatttaatttttcatacttttaatttcatttttaacaataacacgcacaatttttcacagcactaaagcaatcttatgttatacaccaatcatcatagacgtgtgacaacccattacaagagctgtttatttttaacattcatgcaatagactaacctgctgtgacctgtcaccatgaatagtagttgcaggaaaaccattaagacacaaccagtgttccagcgaatcagctcccttctttgtctccacaaaaactaaagtcaaaactagctgcaaaaaaaaaaaaaaatcatgaatgaaataatcttaccacaatttagcgaggttttactcttaatgaagcacaacatgagtaaaatagattatccacactataaatcccccatacaaactgaaattcaaatgcaactttgcaaaggcattacctgacagagttcaaaataattaaaacaccataatccaaacatgtgcatgcatgttgctcagaatcagtttagactgtccggtagatatttctttacaaaaaaaagtttggatttttatactgctagttttgttggttttggtagaggtaaagaagctaaattttttggcaataagccatctatgctacactttggggtatacagtcagaatgtaattcttgtatctataaggagaattctatgaatgatcaaattctttggggacaagataaggtgttttggcttctacttgctgataacataaagctcgtggccattttagaggaatgttaaagagactgggtcagtaactttgtatgtttttatgtgctctcttgttttttttttctcttgtaattttgttttctcaaggaggatctcttatcttcatatctgttatagcatacatcttctactcatcttaattcttttaacaatatgcatgcacgagtagaagagtataggcatcactgagaactacccatcccaagtgggtcagaatagttaatgagacaatagtcattgtaaaaatctcgggtatttcttttggaaatgtgacactggacaacaaagaaaagctccaaattcatttgtgacataggtatatgatcattttagttgttctggcatttttttccaaccaaatcatctatgcattaacacaacttgaatcaattcatgacattcatttagtctcaaaaaatcacttgtaataagttctatgtaaataaagtacctttccttgtacaccatttgccctctgtgcatgaagaaggtccattaggtgacttctcttgtcagactcttgaacatactcaactctttggacaattaaatcagtacttgaacccacccttccaacagcaaggaaaatataatttgaaaggaaatcagaagccaatctctgcatatcaaccagaaatcataagaggtcttaaaagttataattataatatacacaacaattaggcattcatgcattgtttgtttatacctctgaagccacttatcatctcaaatcaaattaaaagcaaccaaattacattattctaaaggcactctttctgaaatagaagaggagggagattaacagcaagaccccttagatacaagtatgtgattcacaaataacaaggaaaatgcatatcagagcaatgacaacctacactataaagtaaaacacatcttcctgagatagacttccaaccagcactaaaaggagtccataatatatgcaggccctagagataatggggcaacaaaggaggagggggaagcaagccaaactgccccatgaagtaggaaaggtagcaaaattaagaaacacattcttattaaaaacaacatgccagataaaagcatgcttaacatgaaagcatattttacagactatatcagacctgtatctcttttggaaatgttgcactgaacaacatagtctgtctggcacctggtggaggcatgtccatttgctctacaatcttccttatttgcggctcaaaacccatatccagcatccgatctgcctcatctaaagccagatatcgaatcatctgcagtgaaactctagctctctccagcaaatctaccagtcttccaggagttgcaacaagaatgtccacccctctttcaagatcccgcatctagagaaaatataacttgttagggtaagggtatataccaaaacctaaaatttcttactatcatttaacggtaaaatttgatgggtcaatttagattccatattggacctgttaagtaaaatttgcaacaggatagaatctacaggagaatacatctacagtgataagtttgagactcattaattacaaggtgcagcacctccagcaaatgtactacaatatataaccacaaaattcttgaccaaccaatatccacacagacatatgcaaaaacttctcaagtacagaattgcaacattattggaagattgaaatcatgaaaatccaaacagtactgaagctcaaaatggatgtaacaaaatttcacaccatggctcactatgaaaccatgagactatatatgcttccaaacatgtacatacacattattttttttttttctccactctctgactacccacacaactcatgcttcacatatgatgtgttccctagtgttttcatgctgcttgcattgatcattcaaggtcataattgctgctgttatatctatattttgttgttgttccttgcatgtggactaacatggacattgtgatgtgtcctctggctatttgtgctgaaagggtgaaaactgaaaaatgagtacaacaaataatgaggttgttatgtaaagccactgtgtaagtgtcccttgcatacccttgctttcttttgactgttatgcgttgaactatggtttatagtgagtttttcttttttactttagatgcctatatatgtgtgtgtgtgtgtgtgtgtgtgtgtttataattttctctgcgtcaaaatgctaataaatctgtttttcagttttatgactttgttaactatataaaacatttctaattatttatcatgaatcttacaattaattatacaggtcggaaaacgagtcttctgattcatgattcaaatccctatttgacaaccataattaccaaacttggatctcaaatagaacaactttgctaggtaatttgaaacaaggtgtctacacaccagagagagaaagagctataataattgaaacatctatcaagaatataatgtcatagactcagaactagttgtgggagaaacaaagtatgaaataaagagaaacaaagataaaagggacaaaaacctgctggtttattggtgctccaccatatgcaacaaccaccctaaccccagtttggtatgaaaacttcctagcctcttcatgtatctgaaaccaaattagaacaatacaaatatattttcattgcagaacagtgtccaattaaaatcatagcataatacaaggtaaatctaactaactcacttgcattgataactccctcgttggagaaagaacaagtgcaagcggataccctgtacgcaccccacgaggtggcctctgcacaggttggcccctcatgattccactgataatcgggaaacagaatgcagcagtctttccagaaccagtctgggcacaagccatcaaatcccgtccagctagggatattggtatagcatgccgctgaacaggtgttggcttcacatatttgcaccttcttatgttctgattaagtgcttcacccaaatcaatctctgcaaacgtattcacaggtgggggcacattatcaccactggtctccactggaatgtcttcatatgcatcaaaatttattcctgtattctcctgctcactgaatgcctcttcagcattatcctcttcttcaaagggattgacttcccgttccctgccacgatcccaaccaccacttttgtttccccatccacctgtgcgtccaccaccaccaccatacccaggacgataatcatttctgggcgcattataacggtatccagaattaccagcaccagaactagagccagcaccagaggaagggacactatatgctggagcaggggcaggggattctcctgctggctgacggttcctcagatggggaggtacataaacaggtcgcgtaggagctaaagtgctaccagttccaacattgttagcagaagaaccaggacctgcgttttcagctgcagaatttgcagccaaatcagcccatgaagttcgcatagtcaataacaattctcgtagtcaacagttgtccgcaaaattcaaagggaaaacccctcctttccaggatcgggataacacctttacaagtcgcccccaattaaaaaaataaaacaaaaaaaactgctgaaacagataaatactctttaaaacgaacaaaattgctcagaaccagccctgcaaagcaacgaattccgatcaataaccgttgcaaacatatttacatcacgatatcacataaagcagaagccgatcagcagaacacatcaactacaatcgacaaagtctcaaaaatgcaaaagcacaaactaaacaaatgagaagaacaaaaaaatggatgcataaaacgaagttcattctcctcgaaatctcaaatagactatagcataagcaaaatggcgaaccaaacacaatgtctttgaaagacaagcacgaaaacaaccaaaacgtgaaaagaaaaacaccatagccgaagcaacgaggaaagaatgatagcaataataatagaggcatgcagattgcagagagagagaagagccatggatgcacctgggtcgtgttgggaaggtaaaaccctgaaacggtgagagcagtgacaaatgaagaagatcgagaaaacctaatttttggtttggttgcagaaagagaaagagaggagaagcgccttcaaaggttagaaacaacaaaaatatcttttctctcttttgtagtgtttttctctctcttctcaaaacttcaaattcaaaataatatataaactaacagtgtagaaaaaataaaatttaacattattactatcattcaattgtctataactataaaggaaatcagatagtttggtatccacatttattttcctattttttatgtcagtgtaataggatatataatggtagctttataatttttattatttgaagtcaataaatttgttgtcactaatttgaggtgtgtttatttattattttataataacaattacttaatatttatttggtgtctgtatttacataaagtataacattttagtatttttatttattaacagtaattcaaggatttgattgatgtgggattactctccaagatccttcacaactgtttttatgttgtatacatttgtgaaggtttttttttttatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcttaaaaattgtgattgttatttttttatttttgttggttaatagtgttttttttaagattaatacatagtgtgtttaacttttgcatttttctattatggactagctttttttatatatttcattcctactaaactttttattttctcctattcttttttgttttacaaattttaaaaaattgttttcaaattttcttaaatcagtttattttttcaacgaatcaatttaaattttaatatcaaaattaaaatggttagttttaatttttttttaacgaaacaagttttgattttaaaatcaaaatttcagtttttatttattttaatgaatcagttttaaaaacaaaattaaaatgggtagttttaaaatcaattgcaacttttttaagaaatcaatttcagttttgaaatctataacaagtaataaaaaaaaactnnnnnnnnnnnnnnnnnnnnnnnnnnnnnnnnnnnnnnnnnnnnnnnnnnnnnnnnnnnnnnnnnnnnnnnnnnnnnnnnnnnnnnntctaattgagtataatataaccagtggaaacacataacactaacagcctgtgtcttcatttctatttttataaagtatttttattacattaaatttgatacattataacatttttttcttattaatatgaggatgtgtgtattcattttgttctaaatatatatttacatgttacttaattttttgatatcacatgtaattaatttatcacttgaaaatgtgcaaattatatgtatatttcgtttcaagatttttgtggaatctatcactatagaaaatttatttatttattaaattgcacgtgacctatttaaagttaaatcataaataatcaattttctttctgaacaaataattaaaataaataataaatatataataagactagataatattgaaatttaataggatattgtgatgattaaatttgacatgtgcatattatgttggaaagacaaacaaacaaaaagaggataaaataaattaatgagaatttctggatcacgccgtcccctgagtcaaggcccaaagctgcatcaatctcattctcattattggcaaccaaaatcaacagtcccaacccaaacattaaaacatcatattctagttttttagtaagattaaaatatatatttgttttataaatatgaaaatgtttaaaatttatttttataaaatgattaatatatttttcgtcataataaaattaaaacgtgttctggaaaagcaagcacacgatccagaactcatataataaaaaataaagttaaaacttaaaagctctatacggggtattttttggaaaggggtaaattttaaaaatctacggaggtgcaggaagcaacagtcaagtttgagagttgggctttccggatcgggttgggcgacccaatttgacccaaaagtgacttaatccaaattttttgccctaacgcgattacgcgagtcgttttctgattctacgacatcctcacgaagacgcgaacagagcactcttcctctcgtctctcagttgctcctttattgtgatttgtgagtgctctgtatctgtatctgtaccattctttgttgataagaatataatatgatagaacttggtatctgctaagtttttagtactttgttctttagtcaacttagactttttggtaatgaatttgttgtgctagtgtagtcctagaagctttctgtggcatcattctgtgaaatagaaaatttattttgctacatcttagggggataaatttagagagatagacttgtagagaaatttttggaacaactctgatctcctggtttaataatcacaaacatcaatttgcattcagtgtgaacattgcttttcttttatttgttaaatttaaacccctttctgactttcatctgttcagaataatcttttgtccaaaattgttgtttcagttgatatcctcccctccaatgtcttacattttcactgattttattttatttccaatttgtctttcctcagattatgttaagtcccaaataatgtattcaaagagagcctcatcagttacagttagttctcttttgaagttgtgcaaaggatgttgctcacccaaaggccttagtacattgagtgctgttagcactgctgctgaaaggacagatttacagttttctggtggttatcaaaatgatgattcttcaggttaccagcaaaatcgtgttgggttttatcaggaaagccgaaataaggttgagtctaatgagctgttgaataagcaaagacctgattatgtttcccgagcaaatgcagagcaaaattcttatggagctggtcagattgcagacggaggtcctataaatgtgacccgaaacgttcacaatagtttggtgggtcataatggaagtgtcaatgggtactttagtcaaggcaacatgaaaatgcaacaaaaagttagggcaggtgttgataatgcatggggctctgggatgcatgcaaatcccttggttgagaaacatggttggacacacgaacctggacaaaggatgcaatctcccaacacatatagttcacctaggcatttagagtcacagggaaatcttagaggggacataaatcaaaacattgatcattttcagcagccacaaaatgctcattacaaagggagtcatgaaatgcatcaacagtacccaggttctggacagtttcagcagagtctaaaagatggtcggtatttgccaaacttgaatattgcacaaagatcagtggttggctctcatctatcaaataacgcaaatcatgatggcgaatcagacaatgcatctaatgatagtccatatagaggtacacttgaggaattagataatttctgcattgagggtaacgtgaaggaagcagttgaagttttggaattgttggaaaaactaaatattcctgtggatttgccccgatatttgcaattaatgcaccaatgtgcagagaataaatctcttgaagaggcaaaaatcgtacacaggcatgcttcacaacatctgtcacctctccaagtcagcacatataataggatattggagatgtatttagaatgtggttctgtagatgatgctctcaacattttcaacaatatgccagagcgcaacttgactacttgggataccatgataacacagcttgccaagaatgggtttgccgaagattcaattgatctatttactcaatttaaaaacttgggactgaaacctgatgggcagatgttcattggagttctatttgcatgtaatatgctgggagatattgacgagggaatgctgcacttcgagtccatgagcaaggattacagcattgtaccatctatgactcattttgtcagtgtagtagacatgattggcagcattgggcatctggatgaagcctttgagttcattgaaaagatgccaatggagccaagtgctgatatatgggagattttgatgaatctctgtagagttcatgggaatactgggctgggggatcgttgtgctgaactagttgagcagctagattcttctcgtttaaatgagcaatcaaaggctggccttgtacctgtaaaagcctcagacttgacaaaagagaaagaaaaaaagaatttggcaagcaaaaatcttcttgaagtaaggagtcgagtccgtgaatatcgagcaggagatacttctcatcctgaaaatgataagatatatgccctgcttagaggtttaaagtcacaaatgaaagaagctggctatgttccggagacaaaatttgtgttgcatgacatagatcaggaaggcaaagaagaagctcttcttgcccacagtgagagacttgctgttgcttatggtctccttaacagccctgctcgtgctccgatgagggtaattaagaacctccgtgtttgtggcgattgccatacagcactgaagattatttctaagcttgtaggcagagaactcattattcgagatgcgaaaaggttccaccattttaaggatggactatgctcctgcggggattattggtgaacataaacttaggtactgcctgcctctttctttttgatatttcccttgttatttgattggtagctaataaatttatcggaactgaaatgtctgatttgtgtgagcaaaattttatacttcagaagtagttaagctcaacttacatgaaacaaataatccactttctgctccctacaccccatgtttgttgttcaatacagtatgcttagtttttagagtatgtactatgtacaattatgatatgagttttgccagtaaaactccagcatagaggtactttattgcgactatactttttccaagctgactaaattgttagtcataaggaaggctaggacttattaatacagaagagtggatggtatattctcaaagacttaaaaactgtcagtttgttagcattacaaactcttaatgctttggtaaaagcaaagagtgcatgacagatacatctccaattgatgcttaatatatccttattctaatgttgctttctaaaatagatcaaaatgggatttccattttcacttctaggagttgctgtttcatatttgggcttatgatagaaaatggagtagaggccaatgtgaatttgtttgaacaaatgtgaaatcatgggtcctgattttggatcctttccttttcttattaagaatggggcagtgttctgatttaagagacaaatatactactagtgtctatgtatgactggtggactgttgcatgggtaatggtggtaatgtggatttctatgatgctgtttttaaccttttatcttacttggccttttggtatttttgttaatcgtgttatgaagcaaaattaaggtaagcctcacaacaatcttgttatgcagatgtatcctgattcctggctaccagatggattgaatagaatggctgttggtaggtaacccctcaaggctgcagatagggaaattgttcatatatctcacggtcattaaattaaaatcgatctttatatccgcaaggagattggaattttgtttaaccaggctcttccacactattaatcaagcagtggatgtgcattcaagttgcagaggcattattcattgagtagttttatataattggttgttttagcttccatataagatataaattattattgccactccaggcaagggaaaaacttgtgtagttgatagacaagatttacattcaatggtataatttcagacaacttttttggctgtcaaaacctcatcatttacctcaatctcaaaatccaaatcatctcatttatagtctaaacttgtttgtcttgcattcttgcttgcctcttctgtgtcaaacttctcgctggtgtgcataattggacgtttcctgcttgcatatatgtgtgttggcagtttgagttttgatatggcttgctaagtgggagatagctgtcttattgtttttggtgcttagagaactagggatttgtaggtcaaaactagtacatgggtactagtctacttgctgattaaaaaaagggtacttatctactctctttttttggtgttgagcaagctgcttgcagaagccttgttggagcatttaggatgcttcgatggtggggtgcctctttcgtaatagttaatcatgaaggaatgatgaggtctctccgtgtgacaacaagttaatgtttgtgataacgagttgaataggaaatgggtaagatgtactttaatgaggacattgacacaaccacgtgtgattgttgtcttagcaacatacaaactcgctttaggcatgggagcagggccagaaaattattttaggtccaatgaaagacttatgttaggcttttcaagggagagggagaaaggataataagaaaatggaaaaacactgaagcgcgtatcaagtgattgaattattgtataagcaattcatgtctcacaactcatactaatggagctttccaaaagtactcatataggagaagaacaaaataaaattaatttcttcaaaagttaaaattaacttatatataagttaatttgtaaaaactttgtcgtattaattctttcaaaaactaactttttgcttgtgcataagctgatggtgatggcggaacacctgatggtggatttcgatttggacatctaagttggaagagatgacaattttagtgttttttaaaataaaataaagatgataacgtttattagttattattttaaattaattatttcaaaatttaaaattctgacaatcttaacagaacactaacattgacagaaaacaaatgatataattaaaatgatattttttaaaaatatagatgatgaaaataagagttttgaaatttaatggacaaaaaaaatactgacatttagctttctaaaaacaaggtaaatattacgagttcacttttctatatcttcgtcttatgtaaataacttaataatagtaaaaactcttttttatttttactaaaatcttgtgtgacttaagctttcgatataaatttacaaattcattttaaattttaaaatataaattttagttacatttttttaagtgttctcggtgatattttcccattaaaataaaaaattatttaataatatactttgatattataatttagaatataaactcaaagataaattttcttattagtttcactctcacatagatttttaatatttttttgtgtatttcatatgttaacaataattctatctcaattttcaactattttaagttatcctcgtctcatccttctatgtatatttgatcttttgtttgtctgtttcaatttatctttcataattttttttaaatgttaatagtaaaagaataacttacatcataatttaaattatttattatacatataaaatataaaagaactgcccctaaagttacattttaaaagaacttaacaatttttaaaatccaaacctcaatacacccaccgagtcccaatattgttgttgagcatgagcgtttcaattatttgtaatttcaattttgcccccgaaaaaggagtggttatcgaacaaaacgaagcctccaaaacgctttggtttcttcaccaccaccatccttctcctctctctctctctctctctctctctctctctctctaaaaaccagaaacaataaacacaaaccgaaaaggcgaaaggggttttccgagtgagatctagggtttccatcgatttggagagaggatattgatagaacgacctcaacgaacaaggtcaggaggtggagtactagaacatggattcggtgcctccgaattcgcatggaaacctcgatgagcagatttctcagctcatgcagtgcaaacccttgtccgagcaagaggtaacgttattcccgaaaccgcttcatctcgctccgttttatttctttcgttattatgaaatgcgatgcgcggatcgggaaaatctcttgttatttgtcatcagttttgtgctttttgctccaattgcttctcgtgcatcgatccgtggcttgttgtagcgaaaattgaatcggttcctctttgtgttaaatctggtttctctcggaattggaatggcgactggaatgcgcgtttgttcgaatattccgttagatttgcagaattcgtggtagcgattctagtttttttttttataattattttacattgattttgattatatcatgttattgtggtttttcagttttagacctaaatcaattggtcgcaattaatggtgtttttcttcatttaaggtgtggatattttagattgttaacattgactgagaattatttgaggaggaagaatatatttctttctctatgcttgagtgtacgttaattttttatacgataactttttacctgtcttattagggagggctgtaaatactctggattttggatacttcctgttaacttaagcgtactcttgcaactttacttaaggcagagtttagttttttgggtgtaatagtggaaatgttgatgcaagttaggagctatgatttgctacttgagctcctaagaagtagaaaatacacaatttgtttgtattattttcgtcacaaaaagttaggatagttggatttgctctaagtttgttgatccacggattgttgtttatgagttatgagtctatgcttattgcttaaggaagggttagttttcatttttgtccctagttgattgcattggtttttgaagaaatttaggcatagttttcggtctagagtcagggatacagctctgacattacatacgttgcatgacgtttgtcttattttggtacttacgaaacagcagttatttaatgacacatttattttgtctcctttgaacacggaaggagtcagcaaagctgaagggaagtattaaaaactgctggatccttgaatggacttgttaataattaataattaaatgagtaagaattccttgctactttctcctactgagtatcttgtaaagcatttgtattaatcaagttaaacatttccaattagttttgcttttttttgttatttgcacgtgccatcatatttgatcggtgggattcagggagttagaggaaagttctacctaggtttttgcgggttcagatcaattttcttttttagcagagtaagttacttgtggcaacctgtgctgcttttgtggtgatgtggggcagaggatcctatgaccactttaatgctctgttgttttgtgttttttgtttctcacagatcacggctgaggtagcggcctttcacagaaaaaatcacacctattagaagtcacaactctgaacaggatgaatccttgtttttctcttcccttcttattatggccattgatttttagggatttttttttttacagtttaaactctttgctaaatcagagggatttagggttgaaaacattgaatctctacatccattaaagtaaaaaataaaaacccagcattcccaccctcgattcacaattcagtgttcttttgatgtattttcctggtttctaattaacacttaaaagcccaaaccatagttgtcaatagtgtgtgattattgtgacattgtgtcatggcacttggccgcaacagaaaagaatgtcttctttctggaaatagccttgccattgagatagtgttgtgatttttttgatttagcgatccaactctgatttcactttgcacttgtgtgtacaggtaagggtcttgtgtgataaggcaaaagagattttgatggaagagagcaatgtccaggtgagtctgtctattttttatcatttatgttagcatgtttatatttgtgctaggtgtagggatttttttaaaaattggttcatatgtcaccaacattgtttgcatcaagcccctttttcctctcaatttgtgaccattatctgttaaggaggtcttattatccaccatttatattggtttttactttgtttaatatgtttatttgtagggcttttagctttaactcatgatgattttgaatgactgaaaaaactaaagagattatttcatttgccaataattgcagcctgtgaaaagtcctgttacaatttgtggtgatattcatgggcaattccatgatcttgcagagctttttcgcattggagggaaggtattctttatgatagttggttttacattcaacatgcatttattaattttgtgacacattgactacatagattttataattatgaaatatgtagtacttggaaaatcaggaaattccatgctccttagtgttgtattgcgaaattaggtttggcctatttcttatttcatagcagaaagtctaattttttattgagaaacaagctgcagtgttattgccaatgagttgcatactcagtctctcattctcttatttcaaatttgagatcaaatgtgctatgtgcttattttattctcggttgaaccattattttttagcatctcacccttgcatatttaaatacttttttttgcttttagttgaaatatggaacctctttgttaaatactgattcttgttaccatttttgttggtagtgtccagatacaaattacttgtttatgggagattatgttgatcgtggctattattctgttgaaactgttacggtaaatatttattgtttttttagaattcaacttcgttctgacatatttttattgttatttattttttataagatgttatgggattatttggttaggatgttctactgaaatcttataggtcttagactaattgaccaagcttgaattgtatttttttttaatcagtaatttgatatctgcttagaggattagaaaattacttggtttatcagcagtagttttttacctaaaaatttctgttttctggaccataattctaatattcctttctttgtgtcatactcctacaatgagaatgattcattactattcatgctatatgccatgtgtatgggggtttattggaattattgggtgccactattaaacttttcgtggttgtgcattgtgctatccaaaataaaaaaaagtaccatgattatgttgtatgtgtaaataatgcattatgtctgtagtataagtgggataccaatgtaacacactgacatataagtaaacattgctgagcaaaataaataaatattaacatgcagagatgtgtatgacattcaaactgattttgaggtacatgttgatattgctattttttaattgcgtagtttagatggtgtatattttgcttccatatggtatttgtttgataacattttgggtgctaattaagtcataatgcagcttttggttgcccttaaagtgcgttatcgtcagcgtatcactattctgaggggaaatcatgaaagtcgccaggtttgttcttttttaaatcatgtgatcttcctgttagtagtgaattatagattagatttaaaatcctattttggtgattggaggcatggtcacttgtcagtatcagttgtttttgacagattttttcttatcaatatactacccataagttcatattgctgcaatgctgccaatcaaatgctttcacacatccagatgaaagaaattatgtagtattttgggaaccaaatatgcttgtattaaaaaatgataccatggatttgataaagtagttggagttagaacttcttacttttaaagcaacttaatatagcactgattacagcattgacttaattgtttgttcagttgttttgtatgctttagctttgaatgataatggctgttcttacctgtctgttgcagattactcaagtttatgggttttatgatgagtgcctgcggaagtaagtacctgctaagtccatggctgaggataagcaattataaaattgcaaaatgattccaaattaaattttgtaccgaaagttgatctggaattcatattattttgctaatcttttttttctcattttaatccttctttttataactttcattcttgaagttgtgcaatcctatattggtgaatatttttatttcatttgcaggtatggtagtgctaatgtttggaagatctttactgatttgtttgactactttccgttgacagcattggttagtatactattacataattttggaaaggactgggatattttgttagatggtcattgttcttagttccaaggtagtttgttcgattcaatgatcctgggcaaccttagtatgttggcttgcatttaagattagaccatggtggaattgggtggtatcactgtgctggattgtggaatctgttggagcagatgaccccactgtctttcaaaaaccctatttccccctgattgggaaccatttcagatgacctggtgaatgaaaaattgaatgttgccaactgagattcttggtctggttgtgaccaattttggaaagaaaaaaaaccttgaagcttcatctcatgtgacatcaattcaatccaattcttctaacttttcaatcttgttcaaacccatctagtcctatctgttatttgatctgttttggagctttcttttgaagttctttggtctgttcgtgttctagagcatccttgtgatctatttgtgctctgcctgctatgtggaacccatggctgtctgaagaagctagcattgtttttgtttctgaaacctaagaaatgggtttttttatatttaaaataaacacttgaggatcttcagactgaaattttatgttccatctccttcagcatcttatatttttataattactatcaatataaaagtaaattgaaacattaataatttttaataacaaaaatatgaatttatatgctctcacacatatattatgaattttgtatgatcttatgatccttgctaatgtgccatgatttatgatctttagcccttcccaatcctgagtaggatctcaatttaatgaccttgtctagttccatgtgcattttgttcttggtactctgaattcagtatgcttcttttgagctttgtctagtttaattgtgtctcttctttttgattaagcttcatgatattcttctccatcaattgcagtgctcatatttcactggatttctagttttcaataactgagtgttgctaaagtgtgatatgtttactttcataggttgaatctgaaatattttgtcttcatggtgggttgtcaccatctattgaaaccctggataacatacgtaattttgatcgtgtacaagaagttcctcacgagggacccatgtgtgatcttctatggtctgatccagatgatcgctgtggttggggcatctctcctagaggtgctggatatacctttggccaggtagtcctgtttgttatgtatcaagcttgattgttttcatctgtcaccattgcttttttttattgcttatgcatattgtttttgtaggacatatctgagcaatttaaccataccaataacttgaagctgattgctagagctcaccagctggttatggaaggatataactggggacatgtaaatatttgatatcattttgtttgttcttatattcattcgttgtggtaagtagttgatttatagtcccttgttgcaggatcaaaaggtggttactatatttagtgcacctaactattgttatcgttgtgggaacatggcatcaattcttgaggttgatgactgcaaaggacacacattcattcaggttgagcttccttctttttgttatctactcaagtaatatgttgtggatctgtaactcttttttagtcttttgtacatatgttaatattttttttaatctcagtttgagccagctccaaggaggggagagcctgatgtaaccaggagaacgcctgattacttcctatgatactattttggtcgagttgctgttaccagcatagcaactaatgccctgcagtaatgtgcaagctcatcttcttgtccaaatcagccatgaatcacattgatacttatatttttgaagttaggcttcgctggatgtgttatttagttgaattataactgaatctttccaagtggaagctgagcagcaggcgatgctattgtgggcatgtgtatcattccagcttgcagtgtatcagttttaatgtttttcccccattttttcccttttctatttatttgcaagtctcttgacctttcttttctcaatttagtattattgttaagggggtgggtttctgtagattgataatgcttttaacatatcttttaatggtgttttatgattttttactcgtcttgtaagaattatattctaataggtagtcttgtttttacatgaaatgactttcaatttttctaattatattcgtactctgcgaagcttggcgaaaatcaatcgagtttttgtaaactatcgtatgacttttttgaagagaactattgtatgacttgataaactttattgttatcttgacatgatcttctgtttgattattcaaagaataataatttgctgtcctctatgcaacttatggctttttgatacattgggaaaaactttttgttgcatttaatttcagaatggatttctcattagttgcaaactattttttagcacgtgttggaaaatgaggtcgagatgggtggacgcactagtgcagttgatcgaatttaatttcccttgatagaataaaaatgtgggaaaggttctattgtctaaatgataatcttggtacatcctcaagtggtaacatttccgagtgtttctgtggttttgggcaagatctcccacatgactacagtcgtatgtcttgattcagtttcatcgttcaatagaattttccataaataattaaatttagaacttatatttcttacattacaatatcgttcatatgggttctgtaaactcgaagtgtacttacctgccaaggctatccttgtcaaccaaaacatatcattagccgcaagttcaacagaaacttaccctggtaatctgcacttcgtaaactccccatatttcaattaacttcttgagaaaacatccttgagttcaaccaaactggaaaagttcatcacaaagaaaggtagactcttaatgcactgaaccaattactagtatttgtggttgagtttgttaatcgggcagaattagttggacaaataataattatcttaaccattgaaaaataattttaatcagttgatgtacaaatttgtacttgtcagtgcatgccttataaaccttaaaactaccactattggtattttgatacgtatcacctctgatactaatatgggatagatattatagtaattggacaaataataacatgtttttattgtgttcacaataatcagaaacaacttataaaacattattgtctttattctaacttctaattcatgcttttatattaatattacaataatttcgttatattaatttttagaaacttgtaatggtgatcccatatctcatatttgtacttgtgtttccttaaatattatcggtatttaaaactgaaacttgactaattttttaaagaaaagaaatggaagaaataaaactctccctctattagagaaaaaacaaaaacaattggaaagagatttcaagaccttcatttctcttctccatcccttcaaactccttaaccgaaaatgaacaaattttatcaaaatctcattcccctgttccattcctttccagccgaagagtatgtaagaaacacttagaatgagcactatacagcaacaatagtcacggtattgataattgtaagttacacctggtttaaaaattaaaccacttcacaagcgacaaaaagtacaatgttacatatcacttggtaactttgaatccagtgttataggcttgaatgcagccaacaccacagaaactttacatgcaagaaatcccaccattccaactatgagatcttttggtgttagcatcacctgaagatctcctgagctataccttgatgcaattacagccaagcctagagccaatgctacacttgctattggacccttcactcctctgaacaaagcatcagttctttctttgtcattggtgattaattctgaagctggcaattcatccactgatctctgcaacagtaaaagatacaagaagcctccaattccaccaatcaagaaagcaatcccggtattttccccagccaagagggaagcaactgatgtaccaaaaagcatcagcatggcatcataaaataacaatgagaacttcaaatctgcgtattctttcatgctctcttcatttgagatctttagaacttgagagtaagttagggtcattaagtcctttgttgaagatgcttatgggatcaatcccttccagctcagtcacaaggctaggtcttaattccaacatggacagatcagctccctcaccaagcaacacatcatcaatctgaaagtcatacaggaagccagtatacgttggtaccccatcttccggtccagatggttgcccttcacaattaataaccattaaggatacacttcctaggcgccactgacctgaccttagagacagaagaagggtattgttagaaagcctaggtttaaacagataaatatgggatgaactaatgattgtaccaacaattatttcttcatgtttcacaaagagcatattataagcttggtggagggttagacctgttgtttagtctttttactcttcatctttcccctccttcttttccccttctttgcttttgtctttttcttttcaacctcctcgtatctatcattggattcatctaccactgaccccaattagctaggattaaaggtgttgttgatgttgttgtttcacagagagcatatattggttgcataggattaaaggtgttgttgatgttgttgtttcacagagagcatatattggttgcataatgatttaaaaactggaattcgaatctaagatgccagaagaaatataatagtatactggcttcctagcacagaatgcagaagggatattttccttggtacttaaaaacaagtttctcggcaggagtactagcaactcattctctcatacactttgtcctaatgatttaaatttattagaaacttttcaaaatcacgagtgagactcattaaataagaagtaaaacctacaacattgtgatttctaatatatttcaactaataatagtgtattaaaaaaagtgtgttagagagtatattgttagcatttgtcttgtgggtagacaagcctgttaatcaagggcactttaaaattgtaggtcaggaatgatgtctatgaatattttaatcatttgaaaacaaatagacaataataacataactgattcaacactgacccaaagagccttaagttgtgcaattttaggaccctcaaaaatgaattcatctaacctctttggaaatgaagcatgtcaatattagtcatatcccctgattctgtagaatgatccatcatcaaactcacagcgatcctttgcaatatggaatttccattttcatctatcaagcatagtagaattccagcatttaagtcactaatactagagccatatgcgttgcttgtaactaacttgaccctaaataaagatgtggatccatcctccttcaaagatgatgaaatgttctctactgatgtatttgtgtacactttcacttcagaggctggcaagagatgtgaaggcctcgcatagctctgaaaatctgtggaaggaaacatcagagattgatgaataaactaaaatattatgcaacatcacaagtacttctttagaacattaatgatcaaaatgtctactttaatggtcttcattgaaatggtcttcattactgaaagatgtgttattacgtcataaccctttcccttaccatctttcatcacaaattaggagtaaaaaaatagagaaccattgcatgtgaagggaaaagaaatcactcgggtctgcatttcaaattaaattagttggcaacctagataatcaatggaactacctctgaggctctgatcaatcccataaattagaaaagggaagtacattttggtaaaaaaaaatgtggaaagcaatccatgttagttaataccaggccttggacccaacaaatactaaactgattagttttgccaatttaatagaagttggttaaaccaagcttcacgtgtgtatgactcaagttaaagctaaaaaaagaaggcaagattccaggatactaaagtgatcattgactacaaatttttgaacttttacataaattaccctgtaaatgcataaatcagatgaagccaacaaacacttggacaaccaaaaccaaccaattagcttcattgcaataatcttttacactataatacctggcaagttgcaatcataattgcagcattaaaaatgtgaaggatttgattaatacttcaccccactaaagcaaatgacgtgactatataataattgactgtgaagtctatgatcaaaaatcataattgattatgatcattgacttttagggacaactgaccagatagatgcaaatccgtataaagagtaaaccgtatcttaacaaccagcatgtattttataactggattaaatcctctcatgagatttttgtacgaaaaaattatatgaaaatttatatttgattcccctaactttagaggaaaaagtcaatatttacaatcattaattgaaaaattaaaagattatatgatgataaaatacattcaaatatataataaacaaggaaattattttaatcttaatgtttgattttctatgagtaaatcattgcttttgtatatgcatgaagtgaatccaccgttttaaaggacacaaaatcttaaaaattgtatttacataagtactattaaaaagacaggatgctattaaaattcgttaaaaaaaatattaacagagaggtacagagaatatcatccattcccataatctatcaataacgaagcaaactaaaattgaaattaatttggataaagctaaaagttaaacgtttagatttttaataaaattctgcagaaattgttacgtgggtaccttgaaaatcagaaggagatagtctggcccgaacagcaaagcgtaaatatctgttgtgggtaggaacccttcttgttgatgaagaagatgatacttgtatgattgttttcctttgaaaatcatgagagtgacacgttgaagctgaaggtatcacagtcctcacatgaattccctccgtgcctctatactccaattcaggaattgcagtgcagtttagagacgcaactgaactacagacatttgaatccatgaaataatcaaagagattattataaagataattttaaagaaaattgagcaacttcaacaagcgtttgtagtccaacggttaggataattgccttccaagcaatagacccgggttcgactcccggcaaacgcaaatttttttctcgtttactttcgttcttcgaaacaaatgttcttactaattgcatttttagttttatttcattagttttaatgttatatgttgataaattcaacaaagccacaagacccctaacacaatatgaattcttgaacagtatttcaccggttttattctatatgaattatcaattatcatgatgttacacttaaaaaatagtgtatttgataagatatttaagttaatttttaattttttattggatagaaaattttttaaaacttttttatgaataagtttttttatattttttagaatattatttgaaaaataatattttttaaatattagcttttagatttttattttttttgtctttaaatatttattatattttttaattttttaatttatgttaatattttattatttttatcttttgtataattttgcatttttagttatttcaacaaataatttataaaacacttgtgattaaataagataattttttaattttcaactaaaacagtttactttttaacttttagctaatttttcatataagtttgttaaacataatcttaagacaagatattttaattaatttataatttatttattaattgaaaattttgtttgattgttcactaaannnnnnnnnnnnnnnnnnnnnnnnnnnnnnnnnnnnnnnnnnnnnnnnnnnnnnnnnnaatattaccttttaatttaaaattttttattatttttctttttatccttgatatatttatcaaaaaaatttattattctttttatataaatcatgattttattatttttattattattttatctatttcaactattttaataattaattttatcaaacacttatatttaaaaaagataattttttaactttgaactattaattttaaagtaattttttattttttagttaattttttaattttcaggtaattttatgaaagataaccttattcattagttttaatgtcctaaacggaagggaaagtgctaatgtgatgaacttgcggttggaattgggaagcatgttacggtctgcacaaggtattaggcaccgactaggggcaattatagctcaactcaaacaacccaaataaagggacaggggatggatggagttgtacctatcaattcatttgagaaatgaacattaattgcttcaaagaaactatattgtattaactattcctttttaattgttcatgtccaaattgtttcaactatactatattttttttattagtattaaatttaatgtataatacctaaaaaaatgtataaacttatagtacacgtcttgaactttcctttttaataaaaattataatcaacatatttttgttgaattgttgaacaatgtcaaatgtgaaattaatccattcaaacatatttttcaattttattaagtatgttggaaatgattgatttttacatttagttgatatatatcatcctttttattgatattattatgaacttaatttttatgtattgacaattagtataaatacgttttatattgtgaactaatctaaaaacatactgaataagacttttaaaataattattataaaaattaataaatttattataaatgagaatttgcaattaaatgttaatatattttttaattctattaatgtggactatttagtgtattattatttcttttattaattatagtcaaacatatttgattaagaatctaatattatattagaaaaaagtaatacttttttgtttttctaaaaattataaaaaataaattctaaccttattatcatatcatcgaatatattgattaactagtatggannnnnnnnnnttagaacaatagttatgaaattgtttaaaattttgagtatacaatatgttttttcaaaattcagtacacacaatcttaagttgaaatttgagcatacaaaaaggtaattttggtacactgttagatataatctaatacacacgcgtaaattagctaagaaaatattaaaagtaacaataattttatcatcttaaatttcaatattcggttatgtttggtaaacaaaacaagcaagaaattttataaacaaaaaaagtgtaagatataaattaattttttagtataagtgatgttaaaaaattttaaaaaatgaaaaattcatgactcatcaagtcaactaagttattaattcaaagtcaaatcacattgaatcaaattaagtcattccgggtcaagtgcatatctaatccaacatgtgatttgaattggatatttgattctcagtccaatggattgatctccacttattattggactgatctccacttatctgaaccaaatttaataattatgttttgaagtataaaaaattaagagatatgatactttaaaacttaaaaaaaaaatactttaaaacttttaaaattctgtgataacaccataaatttattatacatttaatatatttttaataataacttattaccaataattataaaatgtgtcctttactagttaagtttttttnnnnnnnnnnattaattaaatacacatgtggtcataaaaaaaactagtgtcatcattatatcatataaaacaagttgtgtaaaaaaaaagtacaaaccaagttgttatcgattgagattacctacaattaccagagatctcatccattaagattgtttattagatgataaaaaaaatagtgtataactatatttcaataaatttgatgcattatataacacattaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatctatcaatactttatatttttagagatcatatttttagatatcaaaataagtatttattcacaaagatttggtttgtttttcaaagtcaaagatatgtacgcaataacctaaagcgaatattctacatattgaattaatatatttagaggaaacatattgaattaatatatttagaggaaacatattaactccattatatgttcaataatcaaacctaaatatgaatgtggtttattctgaactcgaattcgtgggttcaactaaaaaacttaaatattggatattgatatgatttataatgccgtacaagaaaaattatagattaactcctatatatttaattcaatgtccaaacctaaatattaaagtggtttattcaaaactcatgggttaaaataaaaataaataattattggatattgatatgattataattccgtaagagtaacaattatatattaactcctttatatttgattctatgttcaaacctaaatattaaagtggtttattcggaactcgtgggttaaactataaaaaatattggatattgatatgatttatatttataatgccttaccagaattatatttaactcctttacatttgattcaatgtacaaacctaaatattaaagtgatttatagaaagaaagaaaaaagtctttattaactggagtccagtccaaaacctttttgcagtgacacaataccgtaatgtttttcagggagagatactcttaaaatttaagggattataaggaccgataacaactccctgagcacaaacaaagtacttgacggagaacaaaattaacaataacatgagaagctttctcaatgggcacacttgcttttcctcctcccccacttaaccattgtaaagcacacatcaaacaaactagccaaaaattccatatatttcaaccatgtgaattcccaaattgagtgggttcacaataaatgattgaaataattacaatgatgtgaatcaaccaaatcatttgacataaaccataaccatatgtttcatgtttcatgattaggtgagttttaggtggtattaaaaattaaaaaagaaaaggtatagaatataaaaaaaaaaaaacatttaaacacaaaataaaattaaaatcatttttccttaaacaattagaacaacttgacagagaaaatcatttcttcaattttatttttgatgaatatttcttcggttgttgcataaaatgatcaaagttttgctccataaacacgttccaagtttgacgaagttctttagtaaaaaaaaaagtgttcaactaaatcgaagcccggaattaagaatttccccacaaaaccgggaccagtaattagagtacacgtcaagatatcatgtattcgctttgttggctacgtttgtagttggattattgcaagcataattaattaaaacgtctttgtgagattacgcaaaggaatatatatatatatatatatttttatttttttatttttttcaattccaaccctttgattggtatcttcatcttataactagaattttgttgttgaagtcaatcattcaataacccaacatggaggattcttccctctacacttcaactccaggttcccagcagcaacatcttctaaaccatcatagagaagggtcagagacagaacaagatggttccaagaccaaatcacacaagaagctagcacttctccctttggtttttcttatctattttgaggttgctggaggcccctatggtgaagagccttcagtgggtgctgcaggccctctgatagccatccttggctttgtggttttccctttcatttggagcattccagaggcacttctcactgctgaattggccacaactttccctggcaatggtgggtttgtgatatgggccaatgaagcctttggacccttctggggctccctcatgggcttctggaagttcttcagtggggtcatcaacttagcctcatacccggttctctgcatagactatctcaaattggtgatccccgctttatcttctggcttccctcgctctgtgtctatttttctctccacttgtgtgttgtcttttttgaactattctggtttggctatagtgggttatactgcagttgttcttggtgttgtttcacttttgccttttgtgttattgtctttgttttctttgcctaaaattgaccccaacaagtggctaagttttggtcaagagggtgtggagaaggattggacactttacttcaacaccatcttttggaacttgaacttttgggacaatgctagcactctagctggtgaagttgaggagcctcataaaactttcccaaaggccttgttatctgcagggctgcttacttgtttgggttacataattcccttgtttgctgccactggggctatgccacttgatcaacaaagttgggttggagggtattttgcacatgttgccggggtcattgctgggaattggttgaaaatttggatggaaattggtgctgttttgtcaataattgggctgtttgaagcccaactaagtagtgctgcataccagcttcttggtatggctgatttgggattcataccaagaatttttggagaaagatctaagtggtttaacactccttggatggccattttgatctcaacagttatagcacttggcatgagtttcttgaccttcacagagatcatatctactgtgaatttcttgtacagtttggggatgcttttggagtttgcagctttcctaaggttgaggaggaaattccctgctttgaaaaggccatttcaggttccattggggttctttggattggtcataatgtgttttgtaccatctgtgcttttggtgtatgtgatgagtgttgcttccaaaattgtgtatgtgactagtgccttcttgacctgtcttgggattgctttatattatttcatgaatctttctaagtctagggagtggcttgaattcagtcgtgtgggagataaattgggtgaaaatgattatgttttgtagaagtttggtatggttgctttttttttatggaatctttgccaaaagtatttgtttggggtagaagaatctttgtttatactgtgtgtatatttctgcgggagaaatttgattctcctcagccattatgttttaaagtataaatattgtcatgcaaatgtcttgatgacgatttaaaaatatgttaatattaaaataaaaataattaatgaagtatcaaataattgtacaattatgtaaaatattgtaaacagaatttactatttataaaaaatatcaagtgtgataaattaaacaattgattttgagtatacaccaaaagaaatagacatgtacccaaaaaaaaaataaaaatgagtcagtcccttttgtccttttttgcttttctctcgtgtacgtacgaaatgcctatttgtaacgcttaactgcttcctcaagtggccttggtaactgatggtgttaaagctgaaaagaaaaggaaaaatgtggacaatattaatgttgtggagtaattgacttatatacattgataattgggaaataactaatgtgtatatatatcttcgaaaaaaaaaattgagacatatatttaaaattactaatataaattttatataaatattcaatgtattatttattgtattgttaaatataatatatttattaaatttaataagtatgatccatacggattggcccatacagattggtcaattatccgtcattagtcgtcgcagctatgctcagaccacctccctcaacgccgtctccgccctcctctccttcccctccgccctcttctgtgatgcctgctcccgcagctgctcttactccccctgcctccctctgtgattcttgctctcctgttccccatctctatctctctcatccgcacaccacaatgccgtcgcacgccttatctccgcgccatcacccttaagatactcgccgtcgacaacgccatggagtccgtgaagagtggcatggtcctcggcttcagcattggctccacttcccacttcgtccttgacctcggcatccccttctccgtcctcgaccacaatccttgccatgatctctccatcgacaatgccgatgaggtcgttgaggcgatccataatctataaggttcttacatattcataattagtaagattcttacgaatttgtcaatctgtatgaggttacggattcatcagtaagcccaaacagattggcaaatccgtaagctcatacgaattgatcaatccgtaagaatcttaaggaagggcatttttaattttttgctgtcttttctgagtgtatgaagaaatttgtgttgtgcatgaagaaaaatccaaaaatcacacattgaaggagcaagaagtccgaaagcccaatatattcatgtgcacagaggagaaaatcttctaatttgaacaactagcccaattctctctctttgtcaaaaaaaaaaattacttccagcaataaccaaatagtttcattttgggtgttaaccattaaatttctgttattcaatcataaataattgtttaaattattttaatataattattttaaagatcaacaaatttatcatacataatggattataattaaataattgtataatttttttatattgtacataacttttttttctcattttaaaatatatgcaaaggtaattcaaatagttatataataagttagtttcattttttaaatgaaattttattttcatcctaataaataaaatatgagtactgttttttaatgcaagagttccaaatagttatatttgtacatgtaaataattttaaaattgacttttgttttcaaaagaagcttataagaatgtatacaaataatattaaaccaacattacattgacctgactaaaattaggtttgaactatttaaacaaaattacatatctaaatattgtgaatagaaaaaatattattaataaaataaaattctaaaaaaaattgaggattttcatatcataagttgttttctattttaaataattaaatcaaccaggataaatctattttaaaagataaatataatattcaatatttatgtttcattcacaaaattagaacataacactttatttaataaaaattaattgtccttctacataactaacaaatattaattagaattatgagaataatagtaatttgattttcaaaaaattacttctgatagtgattaatattaaagaagtgagttacttttttcatgagtgaatgtgaaatcgtatggaagtgggcaagtaaatcaagggaaagggataactcgtgactaacagcgttatccctagctggctttcggtggaaagtaacgatctttcttcttcgggaaatgattgttagagaaaaacaaaacaaaaacagttacctgactacactttcagaatcaagtcgaagctccacagcatgaaaacccatcatggacatgcaagttgcgccaataccacataaaataacaagcagttgcccagagctcactccatcaacatgcatatattcaaacttatccaatcctttacatatatggaaccccaaaaaatccactatcaacaagatgaaactagtgtcccctccattgcactcacattaaatttatatgagtaaattttatattattttaatttattaatatattattagttattcattattcagtttaaatttaaataaaagtatggtagtaaatatattaataaatttttaaatatattttatatacccacatgtttcagaaaaatgtttttataaggagtattgtcctatgtaaggttctttttcattttagtgatatctcgtatgctcatttttttttattttaaaaagttaatttaattcatttgttttgtgtgatttgcacacttgatttgaaataataaaaattgggtgaaaatgtttagttacaatgtaattcctttttttatttaatttacccttttaatctttaaacttcatctaaaaatgttttaaccatacaaaaaatgttattaataaaacgtcatctaatttcggttggaattaaaggaaaaaaataaattagattacataaataaatatattaagtcatttacctacgtaaattttgttttaatcttattatggttaattaaatctattttaaattaaattagttccaaaaacaacttttttattaaatatttttttgtcaataaatgttataagaaatgaaactttattaaaataaataaataaacatttttttgtcattaaatttcaatcaaatattcacggatggatatactaccaaaaaaaaaaacattcagagtttctctttttccttaacctgctattaatcaagtggttgatgctcatagttatagaggtcttttaatttgtctttactatacaatgtgctcttcctgttacctcatgatcgatcattttccagtgtttcctggtcccatctgcagatctgcttgtccaaaatggcgaactttttcaagactcatatatatcttcggttttgaaatattataggaacgtttaaaagacaattataattagcgtgtcgatttgctaacaaaatctttatacattcataatgtcgttaattacctacatgataatggtaaggttgattttaaggcaattgtcaagaaattaagaactgaaaagttacttacttaaatttgaataaattgaaatacagcaatgacatgaaaaaaaatacaatatactcaaattataatatgataaacattattaatatttataataattactttgagaatttactttataccactgttgttttaaagaccaataaaagaatttccgcacaccaaaaagttatcttgtaattaggataatagggcaagtttggaatgagaaaaatgaaaaagaaatattcaccaattttatttataactaattttattaaggaatttgattttttaatcatatttttttatttataagacttgagtactaaactttatttaaaaggaccaaactcataatcacttaaatcaatgacttgctgattatatattttcttcattaaatatatttacgttgttatatatatatattattttctttcttgtcaaacaatctacaaacctatttttctgtctgagtttaagagacatgtattatatgtgtaaaataattatacaatcaattaattaaaaatcatttttaattacttttaaagaagttattatcaaagtctaaaaaatatttatacagtaatttatggttaataacagtgtgaaaaataatacacatactattttttctttttcttttttttcctttttaaaactaaattaacgtacccttaatattcttaaacacagcgtttgactcatgtgtatacagtccaatattggtattatgaagtttaattggatttgtcctggtcaactaacgacggtgcagatggaggctcttggcacatgaaatgtcatttccttttttggttcggacaaaagaatcagctagcataggcaaaccaacttgaaaaagaaaaatttcaaggacaactaaaggaggtaattaaagatatgaagtaccaaataatatatatgtatggggaaatgatgtaccctttttgcaatattaattaactaccccacattcttccaacccaacccaagtcaatgaatgttttcaattgattttgactgaaaagagagctctccctttatcttttctgaaaggataaggagaacgtccctgtcatatttattttgatatatatatgtaaactaaaagtaatacatgcgtggcgtataaacctccaaatccatagtgaaaaagtaaaatgcttcaagaattttaatggataaatatttgcttgtttgtactgtcgaaaatttcaaacgtcctcccattaagattatgcgagtcctgtacaccagtgagggtgtggtgacatggtgtgaccggttgaaacctgatttttaaaaacctgttaattttacgaaagtgcccccaaactgtattttacatgtttagataccaatttcttataggataaaatacgttttgtttgtatttgtagtctcttatgacttgttttttttaatctttgatattaatttcaagaaaaacaagaaccgattgtaacatgttaattttataagtgtcccaaactacattttacagttgtagataccaattttttatagggtaaaatatgctttgatctttcgttttacctttattttttttagtttttcataattttttcactatttttagttactcataaattgtataaaaaattatcattttacttatgcaaatttaatctatatgttatttgaattaaaattcaaaaatcaaataagtatgaagtttgggagcagaaattgaataatttgcatttcactaggcgaaattgactcaatcttgtacaagcaaaaccatacatcatattgactctttttttttaatgtatttattatatcttgacccctccaagcatgaggtaaacaaaaaaattgagtgtatttatttgaattttattagtttatttaactataaaggtataaacctttgtcaaagaataataactttcacttatttttactttgtatgactgatgtcataattttattttatcgtaaatgtatttatttttatttaatagaactaaacaattaaaaaatatttaaaatatgcaaaaccacaatagataattaaattacatatatagtatttaagttgtacatnnnnnnnnnncttaagatagaaagtgtgtttgaatacaaaatcttaataaaattataaatttatttttgtttcgattgtattttagtggattattttcctctcacaatctcaatttttgggtaattttggaatatccatcaactaagagttaaaaggctaatccttcaccatattgagatccatataaacaatatcttttccaatacaagctctttcattctcatattgaattggaaatcaaatacttgatcacatatttaagagacataattatctattaattgtaacgctccgtatgcatccggttcattaacattgatttatggtcgttaagcgcagcaattatcacatacaatcaaaatggaagcaataaataaaatgacatcatcaaacgtcattaacaacatcaactatacatcatatatggtgaattcttataatatacagtatatataaatcataactgtacatattcatcaatgggtacaaaatcatgggcataaaacaaaagtagaaccaatatgctctccaacactatgcctaaggttctcatataaactattcctgctcaggcttcttgccctgggacctatctttgaatatcacctgcaaaacataatccccaacaggggtgagataataatctcaataaactcagggtccttggaaatttttcctccccctgattcactttcatgcatataatattaaaattgacattataaactagccatcacagctctcaagccatattaccacacacacacacacacatatatatatatatatatatgtctcaagggttcatcattatctttttataaaatatatcatcatcatttaatcatcacactcttaacacattacatgtacatggtatatatatatatatatatatatatatatatatatatatatatatatatatatatatnnnnnnnnnncagtgggaccataacatttgttcatagaattaggaagtttactcatgtgttttaattactatgttttacatgaataacaaattatgatattataattttaatttagtattataccagtcaatcaacttatcatttataactttggattaaaagtatttatgaaagtacttatgtttattttattccgaagacaggaaaaaacacataagagcttgaccctggaagatatcatatgtaaaataatgtcttatttcactcaactaatcccttataattacatcaccactttaatctttcttgcaaatgaatatagctaatgactaatttgatgataaacttttttacttaagattttatcnnnnnnnnnnnnnnnnnnnnnnnnnnataataatgttattatgtataacatttacaatttaatcacaacatttacactatcaataaatttgtatttaatttaacaataaataaagtttgcatttaagttaatattttgtgaaaaaatcttaaacatagtttcatataaattaatttctctaaaatatatgaccttttaaggttttttttttataaatattaagaaatataattaatttactgaattttaaaaagatacattaaataatgtttttaatatttttttatctttttaattaatgatttcatttattttttatgcattacttccataaagtatttattaataataatttaaaaaatatttaatatatcattgattctacaaatgacatatattttgaaataattttgttttttaaaatgtcatgtattttttaaacagagggagtatcttgcaatcactttagagttaatataagaagtatacggctgaactattattctataaccactcaccctatgattcacactactccaatcacgctcatccgttgccaaatcaccgatgattccaagtttccaaatcactttcactctctcctccctctttctgcttctattactactttcaagtcaaatcttctatttcgatctttctcacataatacatttccgtttacaaaaatcttaaattatatttatatttatatttgttacaaatcactagatgtccatattgatgcatccttcttttttttacatgcatcctttgttaagagttaataattatggcattttttaagcaagtgcgttaaacattagttacgcgtcctaatgatgtcatgaaagtgtatttataattaaaaagattactttaaaaaaatgaacgatggtaattttacatgaaatgcaatcattgcatgtaaacaattttacaaatgaattttaaagtaaaatcaaaccatgaaataggatatctctattaaaataatttaatggatttctagtgattaaaagaatttatcctgtcttccctctgatatagtatttttttcctttctgttttttgtttctgggccattcacttttgcatttatctgtttagaaaatacaactattgcattgaggtttatgtacaaatttcgtcataccaatatattagcaaatggagagtgaatggataaggtaattgagattatcttgttttgcacgtcacatccttccacgttagatttcaaagtaattgtatttagccaccacgcaattttttaatcattaattaaaaaactatgactctctcttaactctttttaaactattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttagagaatgcttgtgaaatgcatggatatttgataatctaattttatactaaatatatatacaattataataatatatgggtaattaattttaaaatcatcatgacgttttacaggaaatattaattatacaccaaaaaaaggaaatattaattaaaattgaactgtttttttaatcagaagtttgaactattctaaaacaaatatttttaatacatagaaataaattacacgagcacaacacacaaatacatgtatttttaggaggaaaagagggtttgagactcttgggtaatgaaaggctcatttatcaaaatacagtcaaacatcaaatgcatgtatttttaatttttctctctgaatttgactcctgcagagctggttaaatgaaatatatgtatatgtatatatacatattacggagtaatattatttattaattaaaatagtaattaagattaagattgtgatattatattattgttttttttaggaaactattatgttattattaaagtattctcttaatttcaatcgacacatgtaatttttttttaaaaaaaattctcacttgagaaaaaaaaaagtaattatgagattaaaaccaagacacgacaccctggatgtagggttgggcacagggatgtattatttttgggttatttaattattttttgttatgagaaggacaattcgacaaagttacagagaaagatagaaattgttattgactattgtattattcctcgctgtctgattaattttggtttccctacacacgtatgcataattcatcctntaattatgagattaaaaccaagacacgacaccctggatgtagggttgggcacagggatgtattatttttgggttatttaattattttttgttatgagaaggacaattcgacaaagttacagagaaagatagaaattgttattgactattgtattactcctcgctgtctgattaattttggtttccctacacacgtatgcataatgcatccttatccacttctacgcttttggcagttacagtaatttacaggaaaacaaaaaaaaaaacaatacataatggaatcttttgtcattaacactaactttaatatatattaataaattataaattgtaatttaattataaattattatgtagatgaatttgttaatttttataataaattatcttaaaaattatattaataatattttttaatgaattaatagggtaacaaatttacgcggacaatacatgaatttgtctttcaacgactaaaataggatttttaaaagaaaatactcctataagcttcatttatttgtataataagtttagtgtttcaaaatttatacttcctaggaagagaatctgtcccaaccactctgttggttgtaaaaaatgtgaattcgtttgttctacaaattttttaagtattagagtttatttttgaaataaaataactcgaactatgggtcttaatctccttataattgcacttgataattaaaaccttgtttcagcttaaattgaacctcttcatattttttaactcaagcaatgcacacgataattgctaacaacatatgggatgaatatcaatccgaatcaatagatgaagatcgaatgatagacctgttactgatatctgaaattgtatcgttctcaagtgcattaatgcaataaatccaacttagtccgtttcagctcatacatttgcatatataatacactcaaacgaaaaacgacgaccacacaacaacgcttgtactctaatacataggacagggacacaccactttttgacggactcccaagtggtgtaaaagccacattttcagtacttaattaaccgcaagcctgcaatgaaaacaacactaataattttaatattctaatcctctagacacgcctgtggagtgtcagtagtttgggtaagcttgtagggttttattactgcaaaatacttattgattttatcccgaagttgaatgacctatctttggtataatattttttcatcaataaaatccaaacttgacatcttacttaagatatctggattcattttcattcaaactaatgtcaacttttatatatttgaaaacaaaatacatataaaaaaagtgtttgagaaagaaacttgtctaatgagtcataagtataagtttactattttttacttttaaagaaggaactagattgttgttgagtcttcatatataattttgaagtcatgaattaaaaatttataatataagagtcaaaaatatttgacaagactaattaggttgttaaataatcatgtgtgcagttatgcatgcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgattacagaataaccatactcatgaatgcctttcttttagactatagataaatataaaattaacaagaaataaataaatgacaaaaaaacaagaggaaaacaaagattaatgattctatattgagtttaaaactacttacacatgacaccatctatgtagtcttcttcacttgttatgagtgtttattactcataacttgttacatacttgtaattttattatcaaagacgtgtatatatgaaaaactatgttataaataaatatatttacaaataaatacttatccatctatcaaagcttttgattttttttatgtgctgttgatgtcaaatggagcaaaacaatgtgataacattttataattggttatcataaatataaaataaaataatgaatgtaataaaaaatatattatataaatagtagtataattcatgatattacatttatatcataaatatatatatatatatatatatatatatatattagaaggtgacgtttaatgttagtaataataaataagatgaaaaactgaaaatatctgaatgcacacagcacagatggcattatccgtgtgctccaaccagttggaggtgattgagtactactggagtatgatgacctatctaacggcttctttctatctctataaatgcttcttcaagcgccacttcatctttcacacacactctcattactcatagtgatggataataatacgatctccaactttatcgagttcaacgagttgatacccaggttaccgagcgaactcggactcgagtgcctcactcgtttgccccactcagcgcaccgagtcgccctccgagtctgcagccagtggcactgcctcctccagagcgatgcgttttactcccacaggaagaaaaccggccacacccgaaaagtcacgtgcctcgttcaggcgcgtgaggagcaactgcttcaggaaaaaaacaagtcggtttacgggataagcgtgttcgacccggagagcatgtcgtgggaccgggtcgacccggttccggattacccgtccgggctgccgctgttctgccagctggcgagctgcgacgggaagcttgtgctgatgggagggtgggacccagcaagttacgagcctctgacggcagtgtttgtttacgattttcgcacgagcgagtggcggcgggggaaggacatgccggagaagcggtctttttatgccatcggggcggggttgggtcaggtttatgtcgcgggtgggcatgatgagaataagaacgcgctgagtacggcgtgggcttatgacccgaggagtgatgaatgggccgggctgaacccgatgggccgagagagggacgagtgcgagggggtggtgattggggatgagttttgggttgtgagtggttattccacggagaggcaagggatgttcgatgggtcggcggaggtgttggatatcgggtcgggtcagtggagggaggtaaacggtgtttgggaagagggtcggtgtcctaggtcatgtgttggggttgggaaagatgggagattggtgaattggagaggttcggatccggggctcagggttggggtatgtggggttgcggttgggtccagggttatgttgagtggatccgattacgaaggtgcaccgcatgggttctatttggtggacatggaggaagggcagaaccgtaaattgagaaagataaatgtgcctgagggtttctctgggtttgtccaatcggggtgttgcgttgaaatatagtgagtgatgtacaagacaagactcgccacttgtgaagatgctactacccttccagaattggaaaagccaaatttgttactagttttgttttcttttgctaaaatggagggggcaaaggcaaagtttgatttgtgcatttgaatttaccatacaaatgtaaatgttactgtatagtatattgttttgctgatccaaggaaggagtgttgaaaattagaacattgagattatccataataataatatttggggccactaagattggaccactatatatagtcttataaatggaccacataataatgaccggttgatgggaatccaatgcgatggtgagtgtaaaagattgcttccctagcgagtatagtattttagagatttgacgaaaatgtgacagttagggatattttttaggttttttaatgatgtgtatgtgtagtggcggttaaaaaatataaaacaaatcaagagtagtcctcgtccttccctcatcctcaccgcctcaatctacccaaaccaaccgcgtcgagatccagcagtagctccaccacgtcgggcctgacgtgcctcgccgccagggcgcggttgatgtctaaggcttgtttaggttcttctccgcgctgaaagacgaggttgtttgcggcctgttcactgacacagtcacgcgaggagcgcatcgcccatgtcctcgttgctccgtcgccgcaggaagcaccccgcgccgctgccggagctcttcattgcaagatggggaagcctcaggcttgagtattaaatacttaatataaagtatcagattaaattaaattgagtattaagccttttgaggacctcaaacttgagctcgttcgtcactttcctgcacaacccttcccgaagtcaatcagtcttctgatgccaatggcatggctaaatttggattgtattccctttgtcctctttgtgcttttttatttttcaccttgtttatttttttttttttgccttttgtttggctcggtttctttctctagaagttcttgagttgagtttaagccatttaactcataatatataggactagataatttcagttacagttgggttgaagacatgactccttgtaattacaaatttactttgttctacgatgaccttgatttacataactaggtggtctaataacgaaatgccttgattctgggcccaagaatcacccttgatttgcctataaaataaaataaaaaaaaaagaatcacccttggcgagctattcacaggatgaaagcagatgaaagtgttactgttcttatccttgtttggaataataaaactcttgttgtagacctgaagaaagacgggttgatggcaagccatacttaggaaactgcttattgttttggaaatacagtgacgaatgtcagatcctctgtaaaaccatcactcacataggccaacacatcgtaatattgaaatacctcaattttatcccttttaaatagaggtaatattgtcctatgccttctaaattcatataatatttatgtaaaataatcaccttaagatagaaagtgtgtttgaatacaaaatcttaataaaattataaatttatttttgtttcgattgtattttagtggattattttcctctcacaatctcaatttttgggtaattttggaatatccatcaactaagagttaaaaggctaatccttcaccatattgagatccatataaacaatatcttttccaatacaagctctttcattctcatattgaattggaaatcaaatacttgatcacatatttaagagacataattatctattaattgtaacgctccgtatgcatccggttcattaacattgatttatggtcgttaagcgcagcaattatcacatacaatcaaaatggaagcaataaataaaatgacatcatcaaacgtcattaacaacatcaactatacatcatatatggtgaattcttataatatacagtatatataaatcataactgtacatattcatcaatgggtacaaaatcatgggcataaaacaaaagtagaaccaatatgctctccaacactatgcctaaggttctcatataaactattcctgctcaggcttcttgccctgggacctatctttgaatatcacctgcaaaacataatccccaacaggggtgagataataatctcaataaactcagggtccttggaaatttttcctccccctgattcactttcatgcatataatattaaaattgacattataaactagccatcacagctctcaagccatattaccacacacacacacacacatatatatatatatatatatgtctcaagggttcatcattatctttttataaaatatatcatcatcatttaatcatcacactcttaacacattacatgtacatggtatatatatatatatatatatatatatatatatatatatatatatatatatatatannnnnnnnnntttagagaatgcttgtgaaatgcatggatatttgataatctaattttatactaaatatatatacaattataataatatatgggtaattaattttaaaatcatcatgacgttttacaggaaatattaattatacaccaaaaaaaggaaatattaattaaaattgaactgtttttttaatcagaagtttgaactattctaaaacaaatatttttaatacatagaaataaattacacgagcacaacacacaaatacatgtatttttaggaggaannnnnnnnnncttgcaaatgaatatagctaatgactaatttgatgataaacttttttacttaagattttatccattaaatatattgaaatgcttctgaaataattatacatttttttatagttttaaatattcagattctacgtgaaataattatacacaaatcatttataattgtaggtattttctttcaatttatcttttaaaattcatttaaatttagagaatgcttgtgaaatgcatggatatttgataatctaattttatactaaatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatatatatatatatatatatatatatatatatatatcatctatatgggcacatttatcatcaggacttattcaaacatatatttattcgattcaattatattctactggccagaataaatctcattaatcaacacacatagtctcaatccatgtatatcaagtacatgatttcaatcaaaatagtaacacacaatttcaatatacatgcatcaattcatacaataatcatcactccctttggagtatggtggaacacaaacaagggaaacactcccaagaacaaaaagcttacctgctctcagcgctacaccggctctcccgaattcatggtcacaaccaccagtaatatcaatatcacaccctacacaaagcatacaaacaatcaatcaataacggttctcaaccgttagaatgaaaagaaacactattcatttccattacaacctctatgttctctatcttaggattatcagagctaaccaccttataagcgattcacagaccctcaacaggatctatctggacctaaccaagatcttagagtctccctagactctacataaactagttcaaagcattcagttgcttaaccactctatacctcaagaataaccaagtcattcaaaacaatcaatcgaacgcttaattaccttctatagggtctcctgaacacttttagtaaaagcacatatgctcattcatatcatgatacccgccatttaactaacattcttcctactcatacatatctcagagtcaaaaccaaacttcatcaatagtcatgattcaaagctcaatattcctcagaacaacctcctgagcatatttttctaaagaatccacgactaattccagccctaacacaattgggttactattcatcccaagaaccatttcacaaatcaatcggtaaaacttgagtttcttacctctaaacagtcgaggaaggctggagaatcacttctccaagctttagcgtccttgaatcgctttctttcccttccaaaactcagttttacaaagtcccctagagaacgggatctctccgattgatggttctctcgaagaattgaagctggaacctagctcatgaaggaattctaatcaactttctagttggataggaagtgtttagatgaggtatggaggagatatgaagcttttctaagttgtcaatggtagaaaagcaaaggaagaagaagaggaacatttttcctctcccaaaatgagaaaatagccttttataggccccagtccgcgttcccacgctaatggcgccacaccccatgctaatagcgccaagaattcgaaagaaagagcttcctaaagcattttggtgctaatcgcatcatctctggcgctaatcgtaccagatattcgaatcagggggtctccagggccattctggcactaacagcgccataactggatctaatcgcgccacatgatcgagtcatgatgctaacaatgccgctcctgacgctaatcgcgccaaataaaatattaatatatttttcttcgtcatggttattatattaatcatgccataatttcattttgatataatttttttttactttttttatctctctatttattcaaataatataagaaaaatatatataatttctattttcttttttcttaattttagaaagtagataaattaatgcatcaatcctaaaaatcaaacaaggtagtataaaaaggaagtttttatgaatatatttgtacaacatcatttaagggatgtatttaagtaagattttaaaagtaccctaaaaaaagttttaaaagactttttttgtaaaaaataataatataatattcaattaacattatttaatttttttaagaagtgtgatgaaatccaatgatattcaattaaattgaagtctaagaaatggactattataaataataaactagatttaggccttaaattattattttattaaaataatttatgtttattcaagcaatacgtcttatttaacttaacctatttttgcatctattaatatgtcaaatttaaaatttaaaaattaattttaagtgatactatttaaaagaaataaaaaataaattaatgtaaaaaaaactacctaatttaacttaaaaacacttatattcaagagtagccatgaaccattcaaattcatattataaaatggatataaaaattcatattataaacacgaacaggcatgaattgatttaaataatttttcattttaaaaaataataactcaaatttaaatcaataattcttcatatttacatatcaaactaaatattaaatattttttccatggaaaaataaaaaataaaataaaagttgtgtgtatggaacaaaatttgagcaccaattaaaggaaggtgaatttgatgttaaaggatcatttggtggtctcagtgagagaatagatgttttacaaccaactacaagtttcatgttggatacaatactcatatcggcgattatggtcaagaattattttatcaagtgccatttacattagagatatcgcttgacacttttttttaaagtacaataagaaatagcaattctattttgaaaattttcatcataatgtaaatataaaagactaataccaaattggtaaaaaaaattaggagaagcgaaaaaatgcaagatcatttgtctttttggctagtcaaacatcgactaattcatatatcattgggtttcgattaccaaggaatcaagactttacaaataaagtccaaggattgacattccattgctatcattttatatatacagttacaattatctacgttcccagtgtgcctatgatgtagcaccatgaggactattagctagtgtatattgccttatgagactagagtatggtacatataaacttgaagaggtctgcgcctcaacgcatttcggggagaaccaactagatctaggtttgagtggcatttcacccctaaccacaactcattcactgattcttcaacatcagtcaattcgagcctccacttagtttcacccaagcttcatcctggtcatggatagattacccaggtttgggtccataagcagtaataattgcccctggaagactcattttcgctacaactccgatggtttcccttaaccaagccattgcctatgagtcgtcgattcattcttcaacaagcaagcagttagagtcccgagcctctgccaaaattctgctaaggtccaattctaatacgataggataagatatacaagtaggataagaacaatatataataagaacgtgataaactttaattgtattgaatgtttggtgcatactagataacgaagaagggtgttcacgggtatgagtcactcgagaacccgaatcgatccgaactaatctgaataatttgggttgggtcatttatgtatttgggtcaaaatcgaactgaaccgatcaaaattgtttatgtatgagttgagtcacgggtttagatttatacattcgttggcctattgacccgatccgttaattcgtaataaaaaaataaattttattatatatatattaaaattttaaaactaaaaaaatattttgacaataaaaaaaggtgtgttgggccgaatgaagggtcagtccataatcatctcaactcatctttgctgtgaaggtgtgatacaataaatgtcacaggtttaggtttctttttcttttgcacttctgtgttctctcgcatgtcatctcattctttgcggttatgcaccaactccttctcagttctctcatcttatctcattagatcgatcaagcatcacgttttcctttgcgctttcttttttctttttcgaagctctttaacttctcgtgattattttggtttgtattcattgagatttagatggaaacaaggatgggaagaaaagaaataaccttcattgtcgagtgttgactcgaatttttgttgttgtatttgatttaccattttctttttcttgtttgctttagaattaagctaatctttgataaaatcttataagaggaaaatgtgcctgtttggattaaagattgagagaattagtttcagaatgagtaatagtcaggacctgatttttttttctttcgttggttgatttattctttgagagtttgatttaaatgatgtctttttatttttcttttgttcttttaacattctttgaaagtttgattcgaatgctgtctttttttttcttcttcttttgttcttttaacattaaggttacttaaaaatcagtgttcaacgatgccaaaataatgatattacgttttttgttaatgattgaaatgatgtcatttcatcataaaagcaaaaatattatatttgtataaaatatcaattaagttttgggctaacggggttgtatttaaatttttagagtcgtttgtttaactttcaatactattaatattagatctccaagtgttgaaattgcaagtgttgaaatttcttaatgtattactttcaggtatattgttatttgtttcaccctttttttcatattaatttgtgagaaatagttgtgattcagactattatagtaaatattgttcaagaatcttttgttttaatttatattataagtctattttagaacattatgttcatagtattaaataaatcaattttactactttcatacatttgataatattatgttaattatattgaatattcgaaagaatcatgatataaaatagtagttctaagaaaaatatattaaatgggtaatctgttggccctaaccgaaccgttcatgaacgggttgagttgggttttaattttttttaaaaactgaactaaaccgatcaaatttgattgagttgaatcataattttggtcaaaatcgattcaaaccaatccgccaacaccaacaaaaggacatggttaaattttaaaaatattgtttcattaaaattacctataatttataaattttttttataaactatgattaaaaaaaactgaactataaaaatttaaattttatttatgtagttatttttttacaattatataacggttttaaagtagtcaaatattttactttgaaaatatttgaataataattatttaattttattattttaattgataatttaatttaaatttatgttttaaaattataatatatatatatagagaggaaagagagaacataactcctattctatcttgtcgatcataattttaatcaaaataagaaatatattaaaataaaaataatagaatatgataagcaataagataatactatcatattatatttatgtaacaaaatcgtattataataagatatggtaactatcatatcgtattccctcttattttggccaccaaatagactcgaagggaacgcctaataggagataggtttttgtttatgaggaatcatatgttgggaaacttatccatgtttgatatgcatttttaaataacattcctagaaaagtatgttttccataatgtttttttagtaaatttgtcatgaaaacttttttattggaatgtgaaaatcttatttatttttttagtttaatatttttattacagtcaaaacatgacataattctttgccaaattatataatgtggtgaatcattaaaataaaaaaatatgcataagtatttaatgtcataagtatttaatgtcaaaaatttcaatgatgaatcaaataaattttatttatttccagaaatcatgattcatatatatgaaaaaaatttctcccctacacatgctccctaagagtatttgacaacatataaaattaaagatttaaatatatttttgattcataataaatatttattttttgtgttcacttgttattaattttattttttatatggaattccttataaaataaaaattttattttttattcttgacattattttttagttcatgataaattaatgaattttgtattcatttttaataaattttttaatttataattagtcaaactaaaacaaaattagttaaaatttaaaaactaactatacattaaggtttaagcaaattctaaaggaaggtgaggcttgtttggttttgggtttgggtttgcgaatgaacgagtgagtgcgtgctgtatagaatccgagatttgattagtcagggaaattaaaacagaacagaaaccctccgaaaacgcaaaaccctgttggcgtcgtggccatggatttccaagtcgtcgttctcggcggtggcgtctccaagaagctcatccctctcgtttcgcaggttccgaacgcgaatgcttcaaaccaaacaaatttcgatgctattctattattctaaagcgcttatttctgttcgcaggagcttccgaacgcgttgcttccggtggcgaatcgccccgttctctcctacgttctcgagtacttggagcttagcaacctcaaagatctcattttggtattttcatttcttgcaatattttagatgttattgaagagggtaaatagtgaattagtaatgatttttttaactgtaggtggttgaaggcgaagaagcggctcttcatgttggggcttggatttcgggggcttatgctgatcgcctccacgttgaggtaatcactttttggatattagaaaatttaccaaacatgattcattgcctctatatatgtctcagtagtgaccacaaacataaggatattatgtaggttttataagttatagtaggaaaaaaaaaatagaatgaattcgcctgtgtggataaacttttcaacaagcacttttagagaagaaaataagaaggtaaagtgaattatgtttctcccgtaagttaaaattagcttatgcataaattaaaataaacttttaaagaagcaagatgggagagcttctataaattagcttatgcataagcagattttaactcatgcaaacagggtcttatttttaaatttttttatcggcaaatgttaatattgttagtttgttagtttttttttagcaggagggaccgaacccaccacctttctctccttcccttctttcttaatcatccaaccaaccttatatcttccttaagggtcttatatagtttgtacttaaaagtattgatactatgtccaaaggtgatgatttgtgcttaaattttttccaggtagctgcagttcctgaggatgtggggacagtgggtgctattcgggccatttcacatcacctaactgctaaagacattttggtggaatatcctcccctcccctgcccctgaactctgattaaaataatgttgttctttatggttgtattgattttctgcaggttgtcagtggtgatcttgttaccgatgtgccacttggtgctgttgcagctactcatagacggcatgatgcagttgtcactgctatgctttgctctgctcctgtaagtggacctttggagtcagtatcctctggtgggaaagacaaaaccaagaaacctggccgctatgatttgatagggctggatcccacaaaacagtttttagttcacatagcaactggttagttatctagctttcccttgtatatgtcattttgttgttgtatgtatgctcatgtggaatcttgcaactcttttcaggtgcagaagttgaaaaagatcttcgaatccagaagatcatgctccctgcagttggccaggtactttttctttcttgtctctgaaccttcctagtttgttcctcctgcttataatttctctaatgttatgagtttatcactcttctagtgtgagatataagtgtctattctataccaactttagtattggaggtattttctgtttgttacttgtgtagagatggaaattggttattgtgcttttagagtaagaaaattgttcaatctgtcaatcttaaagaaatagcattttctgtgaaaatatgaattcttcatctgagtaatagaaaattaaatgcaagacttctgcaatttcttatttctctttgtttctctttattgttatttgtccttcatgtagatagaaataagagctgatctaatggacgcccacttgtatgcattcaaaaggtacattcacttactttttaactttctcctttatttgcagtcttggattactcatgttgtatcctgaaacaaacttttcttgcagatcagttctacaagaagttctagatcagaagagtgcatttcatagcttaaagcatgatgtattgccatatctagtccggagccaactggttagttgttaaaggtttttgcagagataggctaggtaatgttgtacttttaaggattctaaccttattcatattttctaaatgagagttagaaatcagaagtattattaaatggtatgccacaaacagaagaaaacggaactgaaaaggttatttctcaaagcaatcaacaaatgctatctcaaatactcgctaatgcatctgaaccaacctttcatctgcgacatgcactgggtccttatgggtctacttttgatcgaagaacccacaaatgttgtgtatatattgctggaagcagcaaatactgtgctcgcttaaattctatacaagcatacagtgacattaaccgtgatgtgagttagttattgttatgatctttatcaggcacttgctattgccttacattttttctttgggtatagttccggttgcttgggcgttattcattttttactgtgacaggtgataggagaggctagtcacttatcagggtattccttctctactcaaaacaacattatccatccttctgcagagcttggggcaaaaacaactgtgagttagttacctaagttgtgtgctctggtacagtttctggagcaatatttttggtcctcccattttaagatttatataaatagttgcaatttgtttttaggttggaccacattgtatactgggggaaggttcacagatgggtgacaaatgcagtgtgaaacggtctgtcattggccgtcattgtcggattggtgccaatgttaaggtggggtgatattattcttacaagttaacaagttactttctggtcttatgatttgtctgtgacacttatgatctccaaccctcgatgattggtcagcaacactgattggcatcttactaatgagttgtattcaataatgttaatgccaagctttttcttgacttgcttttatggatgcaggttgttaattcagtagttatgaatcatgttactatcggagaatcttgttcaatccaaggttctgttatctgcagcaatgtacagctccaagaacgtgctgtactaaaagattgccaagtaatttgtttcacctctctctggcaatttttcatgatcgcaatttgaattggaatgtgatattgcctgtcttggcaggttggagcaggttttgtggtcactgctggtagtgagtgcaagggggaggtcttggcaaagaaatgaaactagaatgtgaaaatcgaggctggggaaatacatagcaaaatgacttctattctgcttgatcattgcttggagcaaattttgtgctttttgctgttagcatttacaatttggtgatcttagcaggaggagcaaagaaattttaatacttccaatttgtatgcatgtcctttgcagtttcttgcaatttgtttgaaaatggctgcaatcggtgttgaatattcatttgtgtaaatgactactaattgcttcctctgcatcactattttctgccatccaaatgcatgttgcaagggactttaggttggtatcttgctgctgtactaaagctgtataatccagcgccatcagttttgtattcgagcaaatgtagtactattgatgcgttttggctttttcagttttgtacttttgtttttgtttgagatatagtgataataatgcttacttgaatttgatgcttgctttgtaagtaattcgtttaagctcacttttttcctccctttttttgcgagagagaggggtggttctcaaagcttggtagcgtcaaccagcagatcatctgatgggattgggatgaggtgtgaatgttacagaattactaaatggtctctagagaattgcgagtgtctttgatgccatttacacatttttgttggtaaaagttgccatatgcattttggttttgcctatgtatatcttttgttcaagagtaccttataatacctgttttagattgctttcactacaaactggcgtttagcaaaagggacaaaatgtgttgatagattatgaaaaataaattataatcaattccatgaaatagtttttatgtttgaaaatatttggtaaaaagggatatttaaataaaagacatttcctatagtaaaattatattaaaaagatatttttttaaaaacatccaattgtctagataaaaaaaaaaacttaataacttataataataagttttaattatgagtaattctttttataaaaaaaattgaagattacaatctgaatatcttctaaaatgttaatcacataaatagtagttacgtacttgaaccgttttttccgtgcaaaaggcatttattcccttgaaaagaaatcagcattgccaaatacacttatttttttactttaattgtgcacggagtctttattttataggtttcgtgaacgtaagggttaattaacaattcttttaaaaatatattacactagtttagaatgtgagaatttcttacacaagacacgttcatctttacttggttacatcataaatagacattagtagccaatgtttattcaggaaaaacagttaaattaatttatgaaatctatatcattgatcattattctttgaatgataaaagaaatgcttaaagtccttgaatatttttttttttggtcaaaattaatccctacgtctataatttgtagattggggtataaaaatttagaaaagaaaagtcttttctatgattgggattgacaattaaaatcactaccaattcaaattgagggaccgtgcgccgatacgaaacccgcatatgaaaaaggaagagtacgaaaatccaacatctttccgtagctgtgtttgactccctaccttgggctgtgttttttctatgctggactatcagatttgctctcttactttgtactctttgttggcattcttggttgtggttatctttggcattgttttggcaattctatgattcttttcaatgctggcatatcattggggaaagacaataggtcctaccatgtgatgcagcattgtgcatttaatctcgaaactaagggtgtgccttaatttccatttaaaaaaaaaaaaaactgtttttagctttcaaaatgcaactaaacaaagttgctcacataattgatggaggatagtgcaagcacactgcaaactgctaagtgtggatttgacagaagttgctttcaaaattggagggtagtgcaagcacacagcaaagtgtggaatcgagagagaagttaaagaaaatgaaaattgacgaagacaggaaaacatttctcagctatttctatttttttgggttttaaaacaattgttttgaaaacaaatttcaaaacttaataattttaaataagaaaacggttattgagtaatgagcagtgcaaagttgttttagaagagaatcaaatattgtgtataaaaaaaaagaagagaatcaaatatgtccatgcccttaagtttctagttttcctgaatgcatttaatataaatttaattactattttatttctctaatttattttttagatttaatttgttcatcttattatttaaagatttaattaagtctttaatttttaaaaatgatttgatttagttcctttacttttaaaatattcaattagatcctttattttttaaaattaattcagtttggtcttattttctcttttatttgctaagaaagttttgaaaaacacaattgaatttggtttatattgggaccaaattgaaccaatcttaaaaaataagagacctgaaatttttaaaaataaaaagatctaattaaattatttttaaaattataggacctaattgaatcttttaataacaagagaactaaattaaacttaaaaattaaattaaaggatcaaaattataatgaaacgtttaatatactaaaaaaaaaaattcaacacatttacctaaatactggccaaatcgtccctcgatattgttagtagatagtcaaaatatccaaatcaatcctctctctagttttaaaaattatactattgttaattactttagttttttttaatttttaaaatctttttaattcttaacttcaaaaaatatatattcattttagaatgaataatatatgtattgatagtgtaaaggattttactttatcattcaattacaaataatcataatataaatttgttaatttttataaaaatcataccaatctgattaattaataattaataatgcaaacttctttacacagattgtacataaaaattaaactctgcattttattcctttttactttatattccattattttacattaaaagaagaccaaaatcaatgacaataaacaatgttacgactttataaagtgaaggatttcccactaataatatcaaatgttcaccatttgattgcaaagacctcacccggtataaattgtattctagacatagggaatggactgaattaataatgttactaaagtctgctctgaattgatagctcacgcttcatttgatctctcaaaactctccttagtaatttgttggaagctgttcggggaaagtcgggcacaattttaacaaggctcacctgtaaagtaacaaaatgagttgtgaacatcaaatcagtaacttcatcataagtcaggttaaaatttgcataaaatttcaatttcctttcaaactaagactttcatgaatctttaaataattaagttattgcttttcgtgatgtattcaattcaaaaccgtagttgcttaatttctacaggagaaacactgattgcagctgtctccaaaatgccttcgtcggccccatcacagacacgctcaatttctacagaacttgtctgcataacagaacagaaaattccaagtaagaataacggtcagaccacggatatcaagataggaatttatgaatttctgatgaatccatgatcagttacaagtacggaagtaccttccattcttattaatttattcaggacattgacatggaaatatttaggattcttacaccatgttttatctagcagaatagctttcagaagcttcatctccaatcagagtagaactgggagaaggagctataataaacataaatatagcggatgatacctttattccgccaagattcattgtgtcctcagcccgcccttgtacaatgaaatggcctccagcagttcttttgattatatctccatgtctcctaagaacctgcttatatcatgttagacaggataaattatggataaataaaccagttgaaaaagtagatgacaataacaatagaacgagagtagttaatatttcagcaacaaccaaaaaaaagagtagttaacattacaaatttacaaggcaatctaataataagttatgtaatttacaagggactatctgaaaatccttgatggaagatctgactaatccacacttctaagaaacatttagatattgatcactgacataggcaatagcattatttgacaaacatccaaagttgagagttaaacagtaatcctatcctctctaatttctttctttatttaactgaatgtgaaaatcatacctttcctttgtaaatgggcattcccttaaagaaaacctcctcattatccgcattaagcaatctatcagtcgctcccatatatattggaaacaagcccacttcaccaacacaagcaacatcctctggctgtcgcattggtcaaagagatcaaacaaattagatagcttaaaaaataagttgtctataccacaaaaattgctattatatatcacaatgaacatttattgaagatagtttggtcatctactagaggaaatgcaacccacttgggaagagtaaaaaatcataagagaattgaagagtgtaagttataggagaaaattggtggccaaagggttagtataagaattacaccattcagaaacaaatagtgaaggagaatccatatggacattctaactgatgaccattagaagtcagtcttgactcttgagattttgagactagcatttccaattagccattattggttctgagtccggattatgtaatacacttgacatccattatccattgcagcaacaaaattatatgtgggtattggcatgatggaaagcagtgtcaattcggtggcaacatatatagtatcacatgatcaaataatagaaactatcaagaaaacattcttacataaggaactccattttcgtcaaggatgaccaaaccagttgccattgatgccgtgctaaatgctccaaaagcttgaggctgcagtggacttcccatgatgtaagaagatgcaagctcagtgcctccacaacattcaatgattggtttgtaataagattttgaagaaagacagaggtcatcatcaacatttgaagtttctcctgttgaacaaaatgttctgtgcatataaccacagtttagtgcagtttttcacattagttacctgattattcaaacttaaaagaaattactttatttttgtccaatccaagcctccatgcattgtgtacccttccaagtttttactaagctcggaactgttcccaaaatagtaacaccagcatcctgaacaattgtagttgaatgatgttgctttgtgcaatgtatcaaattctattgatgcagaatacaatataatctacaacaaataatgacgctttttttaatttttatcttgtttcatttatgttggacttttgcccccttccagaccttatttaacctctttgtagctaagtcaagttctagcaatgagtgtctagctttctaaaagttttttacccctttcctttacatttttaagaataaaactcattcagattgcatgtataattcatccaggcctatagtgcaagggttaaaattcaactagaagcaccttgtccttgagggtctgcatagggacacctcattttcttttttaccataaaataattgcaaaagttgatgtaaatgcttctatgaacatagctcaatgagacaatatattttttctgtcatcacaaacttcatcttattaatgctattttatgtgacaaagcattttcgaaagaatgagaaaagttttttgaccttgttatgacatcagtgtggcacacagttgcaaattattttcgcaaaagatatgaaagttcttgggttatctcactatagataacactaccttacaaccattaccttctacatcccactgtatcatattacttcattgcttccatgattttgcagaaaaaacaactagtctagttcccactcagttctgctactagtcagcacttactttgtttgatttccaaattcttaggttattaaaataataatgaccattttgtagaataagacatgttatgttaattataaatactataaggactgaaatataagagttggacaaatacctgaacgaactttccaaaaccatggcctagaggagatccatgatacaaagcaagagttgcacccgatagagagcatgaatatataagagttgggcccatcacccatcctaaatttttaggccagcaatagacatctccaggttgaatatcaatgaaagcccatgcatctgcagcacttcgtatcggtgaaagttgagtccaaggaattgcttttggctcccctgaaaagtaaaaacgtaaccagaaaatcattacaatgttagtttctgcttgatgtgtttaagggagaatgtttacctgtcgttccagatgagaaaagtatgttagtgacagaatcaattgattgatagattggagagtagtgatgtgacctgtcacgattaaaatgttatggtgagacaatactcaagagaaacaaagcaacttctctgtctcttttttctgtttttggggtcttttgcaaagactattttagttcacataattacaatttattaggatgaatatatatggcttaatagacacattttgaagtacattacctgggatgctgtctgctagaagaaagataaaccttccatgatatatcgcattctcttaattgcacacctagatcatcacctatcacaggcagagcgataactttacatgcagctgcttcaatgactcgactacaaggagaaataagcagaatgaggtcagtggtcaagaaattttgcatggtaaaatattctgaaagtggcattcaagtaagcattagttaggaaattaggatctagatacaaagtttggccaatgagaggcagtaatgcattcgttctaagataagttctttgtaacatcagttgagagttgaccaaacaggtctggatactcattcccggtcagattgccagttcaatctggtcttgacaactaagcttgttagaatcctgagttagaatgtaaataggaaatacacaaaaaataccaagagtggctgagagtaggatatcatttttataagtgaaaaatataatttgtcactaaaataattcctttgtgatcccattaaatatctattaactaaagtcacgcctcgtgcctataacaaacgccataaaacaaagtgaggcagaaatgagaaaaagaaaacagggttctatagaaagcaggttccaaaaatacaatgtgtttgatgattttctgttccataatagattatgagttttcccaaaatagcccaaccacgtatatctatgctcaaacgcaaagacttctcaccagcatgtggaacatagcatcgaatttgaacccaagcagcaataagacaaacataatattgaaacatttatcaaaggatactttaacagatgatcattaaataacaatagcaaatattaagttggcaattgtgccaaaagttaaggataatgacaaataaacttataaagcttaagatgccaattatgatcttttgaacagataaactagacagtatgattttcatattgcaacaaatataaatataatgttaaatttttttacctgtacaaagggaatttcctgccacctcttgatatgaaatcccaaaacaaatttaagctgagtaaaatacaacaattctaatttgatactttggaagttcatcatgtaagtgcttatatcaaagacctaaatgtgagggcagcaaagatcaaactctttaccactggatcaggagacttttataccatgccaaggaccaactctcctaaaagcttaggctctatgtttttatatctaaagaaaattcaaagggaacatctacatcttattttgcaagaaacgttttttctctctccctccttaaagaggagtactatatgtatgatacttactagaatttggacttgagcctaactcaacccccaaaagctaactcatattttaatcatattactagtcaatgtggaatattcaacacactccctttatgctgaaggctaaacatctcgaatgtgatgtttgcaagattggataggagaatttggagttggagcttaacatcattaagatttcagtcacttgatttcctaatttatttttgcttaactctacctaaaaggctaaaactcttggcaccatgaaatctattttcaccagtactgttttgagcactaaaactgctatcacacatgacatacaataagctttcaatgcagctacttttctacctaattagtacttattaaaaacctgatctttctcaagcttatgaagtcttaattgcattattgcaatgcacatcattcacaaagactaatcagccagaacaagatccaacttttgttaatactgaggatcaaagctatatgatgttgtcagtaccctcatcaaacaggtataagcctaagttaactaaaataaggtccaaggaatcagtattttaacaaattctccaaagtcagatatctttgcacggactattggttgaatctcatcaaacgggaaacacaagttagacatttagactcgaatgaagattaaaaaattttaagccactaacaatttggtaattttgttattccttcacacacactgagtagcattacgcacaaattggtaacggagaaagaacaaagtcaaagacaacatcaaagattgaatagactcactttgatcaacaacagctttacttttaaagtcatacgcataataccaaatttaaaagataacctgagtgaaaataccctttgctttagaaacatgcagacgagttgcaatttcttttggtgcaaagctatcagctattgatacgacaacacatcctgctagaacaatggctaaatatataatcacagcattgactgtcaattgcatgtaaatagcgattgcatctcctttcgagaatgtggcatctattgcatttgctaccaacctgaaacgatataatttcacacaggaagcaaataaagagattatagatagaaattacttctagagtaaaacataacgcagaaagatcaaaaaccaaaaagtgagatacaagcacgaaaagaattgaaacaaaagtaaaatagcagaatgatacacaaattaatcccgattaatttgaaaaaacacacatcaaattattgaattaaccgacttagcacaagttactagtatgatgatgagtaacataacttaggtggaaaagttgaatggcttacatcaattagtgccggagttgtttaagcgtgatatgattaacctcggaatcatcaaaaccttcatctctccaaacaatggctaaagtgtcatctgttttgtgggggtgtgaactgggttgcaaacagcaattggcaatgttgaggacagaaccggggagccaagtcccaccatgtttagaagggtcgaaagtatccaaaatgcacttgggaggttcaacaaaggaaactgaaagttccttgagaataagggaccagtaaagctgcacaaacaaatgatacccgttgaaaacacaatactagaataaaaaaagggaattataggtgggagggtagtaggcttgcctgagggtgttgaacagaaaacttgtgaaatagaggataactagtaatagggtctttgtaggaaggtcctaaaaggtcaggggtatgagtttccatgagacggcccaggttggtgtgtttggattgctctctgaaatcaaaaagcaaaaaatgaaagatgaattagagtttgtgttgaggtagtggtaagtcataaggcatagtaagagagatatacagagaagggaagcaatagagtgggagggaagaatgttgagagtggtaaacagactagtagagaagctgatgcaaggagtgagggtaagatggtttgagcagtctccgagtgacaatttggcgccatatgtgtgaaggagactgaaactcagagaggatatccctcaaactcaaagcatgatataattcattgccttctgacactgttaagcctcctgcattcaccaaatcctccactcccaaatcccgcacgctcttccccatctctcgcgatctctgatctttccaacttgcagaagggttgttgagtacttgagtttgaggtcacccaagttgaacatgcagtgccttcacatcacctaacacttccaggtaggtaggtgactatgtgctgccaacgaaagaaggagaaattattactatatgatttagattttagatatgttctttagtagtactaatattaaaaataaatggggtggtccacagtccacactatctataacaatcttcaagcttcaaccaccttcacagggctctgtcaaggaaaagtttcttcgcggtgaacgggtgaagtgatgtgcctgagaccctgagttgaaaattgaagttgagcacctagtccttttattacacctaccacagttcttacttctcgatatagttatattaggcttttaaataaattgataattattggttatgttattctgttattagaattaaaatccattaatttaaaatctaactttgataattataattattttagcctcccaattatataattgacgttgaatgaagtgagatccagatttaagtattagagttggaataattgtccttgttgtgaggaagcgaggaagaggaagaagaagaagattggggcatggttgtgcgaagggttttggagtgggaagtggtgagaatcctggagagatgcagcagcctgaatcaggcgaaagaagtccacgcccaaatctacataaagaacctccagcaatcttcctacgtactcaccaagctcctccgcctcgtcaccgcgctcccccacgttcccctccactcctaccctcgccttctcttctcacagctccactccccaaaccccttcgcctggaccgctctcattcgcgcctacgctctccgtggacccctctctcaagccctgaccttctactcctccatgcggaaacgacgcgtcagtcccatctcttttaccttctccgctctcttttccgcttgcgccgccgttcgccaccccgcgttgggggcgcagcttcacgctcagacactcttgcttggtggcttcgcctctgatttgtacgtcaacaatgccgttatcgacatgtacgtcaaatgcgggtctttgcattgtgcgcgcaaggtgttcgatgaaatgcctgaacgggatgtcgtttcttggaccgggctgattgttgcttacgcgaggagcggtgatatgagggccgcacgggacttatttgacgggttgccggttaaggatatggtggcttggactgccatggttaccggttatgcgcagaacgccatgccgatggatgcattggaggttttccggcggttgcgagatgagggtgtggagattgatgaggttaccttggttggtgtcatatctgcttgtgctcaattgggtgcgtctaagtatgctaactggataagggacattgctgagagttctggatttagggtaagaaataatgtccttgtggggtcggctttgatagacatgtactcaaaatgtggtaatgtggaggaggcatatgatgtctttaaaggaatgagggaaaaaaatgtgttttcttacagttccatgattgtggggtttgctatacatggccgagctcgtgcggctattaagttgttttatgacatgttggagaccggggtaaaaccaaaccatgttacttttgtaggggtgcttacggcatgtagtcatgcaggcttggttgaccaagggcagcacctctttgcctccatggaaaagtgttacggtgttgttccaactgcacagctttatgcttgcatgacggatcttcttagccgcgctggatacttggaaaaggcacttcagcttgttgagacaatgcctatggagtccgatggagctgtgtggggagcacttctcggagcatcacacgtccatgggaacactgacgttgctgaaattgcttctaagcgtttatttgagcttgaacctgataacatagggaattatttgttgctttctaacacttatgcatcagctggaagatgggatgatgtgtctaaggtcaggaaattgctgagagagaaaaatttgaaaaaaaatccagggtggagctgggttgaagcaaaaaatggtatgattcacaagttcgttgctggtgatgtgactcatccaaaaattaatgagataaagaaggagttaaatgatcttttggaacggctgaaaggtattggataccagccaaacctaagttcggtgccatacggtattaatgatagagagaagaggcttttactaatggctcatagtgaaaaactagctttggcatttggattgctgagtaccgatgttggttccactataaagattatgaagaaccttaggatatgtgaggattgtcatattgtaatgtgtggagcgtcaaaagttacaggaagaaaaattgttgtgagggataacacgagattccaccactttcttaatggtgcttgttcttgcagtaatttttggtgaccgaggctatatagccatatgcgggtgaaaagttgacatattgatgttgaaagaaaaaaattgaagtgagagggacctttttccatttgtgataaattagaggcttgtaaagaactgttttgttgaaattttagatcaactgcatacttgttcatcttacagggttgttcaatttattattgaagagtgttaaaaatggatagggaagacaagtgatgccagctagtagacaaatttgtgtcctcggcaaagcaaatgtttgtatagatacatgatcaatgttgttgtgtagtaacattaagagttgttacatagagtgagaaacaaggattgtaattggggaatgagagaaaccgtactgcattgattatggtgccatcctgaaacttttagattggtaatgacaaataaagcaatgcttagtaatagaaagcaaggagtaaagagatactgaagaaacaagctaaaataagttaaatttgatcttattattaaaagattcaattagaatttttaatttttaaaaatatttaattatgtcattttatttttaaaagtttcaattaggttttatttaaaatcaaatttgatttgatttttaattttttctgaagcagatgaaaaaaaggatcaaattgaatttattttaaaaaataaaggacaaacaaaacttttaaaaataaaagaagctaattgaattatttttaaaaattagaggaaattgaactttaaaaaaaaatataaaaaaaaggagaatgttccaaccagagataagtcaaccaccagtaatgagacaactaatatatgtcatatttatgtgatgaccaattattgttcaagaccgaaacatggcttcatggaggctccacttcaaatgctcgttacagttcattagtgattcggattttatcacgaaatatattgtgcttgaagaaaatacataattaaggataatgcttttttagaattgtaaacacgaatacagattttgagacaaaacaaaatttaaaacctcgtggcaggctctgagatagtgtcatatgtcacattctacgactatgaaatataagtggtgtgatttcaaggtggaaaaaacgtacagttatcttctttttatttttctataaaataagcccacatgcactgcgcgggtgccttgtacaaaaatctataggattattaaatgatcaactgcgagagcacattaaaatttatatgcctgaaaacaacattttatgtaagtggtcatcacgaattaaactttgtttcaatttggttgaccaatccaaagaactaaggcatgaggtgaggacaaccactacagctacaagccaaatacaaaccccacattagtttaggcattagccaagacttccaagattttagataaaaaggatacaagaaacaaaatacgagctctccactactctaagccacaaaattaaatttaacctatgatattttcctaagcctctcacatgaacctatatatatatatatgtatatatatatatatgtttatgttatctctaacttgattgctctcatacagtatggagtatcaaaaccaaagggccaaggagggtagattctgtgagaaactcgagatcaagaataagccgaagtttgtaggagtgagacaaagggcttcagggaaatgggcagcagagatcaaagacacatcaaagaagattaggctttggcttggaacttatcaaactgctgaggaagctgctcgagcttatgatgaagctgcatgcctccttcgaggttcaaacactcgcaccaatttttctactcaagggtgtggcattgctacaaattctccgatatctctcaaactcagaaacctgcttgatcgtaaagccatgtcaaatcaaagtcaaagtcaaattcaaagccaatcctctatgataagttccactttccaaggtgctgctacttcagctagtccaaatgttagtgccatcaataagatcatggttatggaaaactactctgcttgtagtagtgaaggtaagtctttgtttttggttcagaaccaccaagtctgtgataacccgtatggactagatatgaatatgatcaactgttcaatgggtatcacaccaaatacatcgcagtttgattattcttggccattagcccaacaaaggattaacgaattgccaatatcaaaagatgattttggtttaaatgtagaaaggcaattgtcaggatatgccaccaatgagtgccatgaggaggatgcgtatgaatatgatgtcaattatcctctctcccactttttctgcttcacttgatatctatcttaatcttcctatctcttcttaaaacatagtttctataatattgccttgtttccatgtcattttccctgagaggataaatcaagagtcaagaccattgaatttctaaacccacctctgcttcaacaagtgcttataggaatcagtaacaagatttttggtaccatggtactttgcccagagtgaaacaatcctttttaactcctcaaagttaacccattggatattttgcaagctcgtgatcacttacagtcacaccccatctcagtataataaggaagactaatgtgccaagtcaaatgtgtacgcactatatatcagtcttcattcttctacaaatgtactcagtgcttacgatatattcaatcccactccttatggttggataattagatgaaaacggatattaagatgtattttacttttttgtgttacatatcacctttaaaataatttctgcacacacatgtaagtgcatctcctagctaggttcacttatgggtccatattattttgtgatcaagtcatgtataatacaagtatttttgtttaagacttttgtaaaagctacctcaaccctgtcctataatattagactggtcctagtgggttatgtataatacaagtattaaaatactgtaaaagaaaataatgtttaaatatgaatgtccttaaaataaacaaatgactacgataaaataaataaatgctttgtttaacccgagggattgactagggtttgtggagttaacctcctgtctctactaagtcaaatccaaccacttatgttgtgatcaacacccacgtcgttgatgaggtgtctggaatagatcgtaagaagtttgaaaatgagtctttggtggagttaaacacgtccccacttccctcggggataggacccacgacttgctaactgctaagcatgattgagaatggtcccaccgcttaaaatttttggaataattgatcatgccacaataattatgttgaagaatcaaataaccgttccaaatagttattgacttaaagaatagagagacattggtcaaagtgtcacaaataaaaaaaaaatgtcaaaatgtcatactccagaaacaaattgtcaaactgtcatgccacgtaattcgttagccacatcagcgaattacgtgggctgacgtggcgtcgcgtgagtgaaggacataattcgctggaaggggtgccaaattaggtatgccacgtggcaaatttttcgtaattgtgtagaagcttcggaaggtcataacttttgactgggacgtccgattcacgcgaaattggtggtcacgcgctcgaaattgagaggagaaggcttaagcaagtcccctcaagggacttgcccaaaattttttcccaaaagaggcctctaagtgtctcaaaattgcgatttagtatttggacaccaaaaaaattcatttttgtctgattttttaattatttaattatttaatttaatgttattttttatttttttcaattacttctctgaatttcgagctttttgacatatcatacgctttcatcggacatttctatcaaaaaatatcactgttcaaaggttatatgaagtttatatgcactatcaattaaacagtgatatttttggctaggaatgtccgatgaaggtgtatgatatgtcaaaatgctcaaaattcagagaagtaattgaaaaaataaaaaataacattaaattaaataattaaaaaaagcagacaaaaatgaattttttggatgtccaaatacaaaatcgcaattttgagacacttagaggcctcttttgggaaaactttttggataagtccccaaaggggacttacttaggccttctcctctcaatttcgagcgcgtggccaccaatttcgcgtgaatcggacgtcccagtcaaaagttatgaccttccaaaacttctacgcaattacgaaaaatttgctacgtggcatacctaatttggcaccccttccagcgaattatgccctccactcacacgacgtcatgtcagcccacgtaattcgctgatgtggccaacgaattacgtgacgtggcaacttgacaaattgtttctgaaatgtggcattttgacaatttttttttgatttgtgacactttggccaatgtctcaagaatagatatgcagtaattctctcttgaatttttaagctgtagaatggggctttgtgtgcgcctgagcttgaccggttatattacattaacactaatgataccaactgaaccgttttttttttttttctaacaccaactggaacttttttaagtctgctaccgacaacttcatcctattagccccattcgcatattattttgaaaggcgtgtgtttgagtgactttacaaatttgattttggatgatcttgatttgttttaattaaattaatcttaattaaaattgaattttgaaaaaaggaatttatatttagaattatctcaaccaaacttgtaatataggtacaaattttcaatcgaagtaacgcctgccaaagtcacatggttttgtgaatttacagtattgaaaaacaactgagggatgcttaaacaaaccacactaaccgaattattattgagcagagcttcccaacagtgtttactacaagttttactaagctcagatatcttattaccatttattttccaactcatgtagagtttattttccaattcatttttccatatttaggccaaaccaaacgcagcttcgtacttcccaattcaggcgtttcaagtttcattctgaaggttctgattccctcaattccatactcggaaattgttatctggaacatccgtattcatacttcctaatttttagtaatgtcttttttccagatagccttgcttgcaacagtttttacgcgccttgacttcacccaacactgataataataaacttaaacaagcgtacaaaaatcacaaattaatcacatcgattcccagaatgaagcgaattgcaaaaaacatacaaggggtacgtttttcacggttcaaaaagagatcatcaaaacggaaatctggtaaaatttgcgacataaacataagaaatcaacttttgacatggacaattctgaatacatgactgaggatcgcaaacaacaggtcctaaaccaccaaatagaagcataatgttgatcacttcacagtttgaataatggagaactatatcacacaggagtaaaaacaaaaaagaacgaacaataatggttcagggtaatgtaacgaagcatataccctttttactcggaaactgataacaaaaaaaagccttcaattatcaatagtcctctccttcctcatcatcttccgctccttcagctccaacctcctcatagtccttctcaagagcagcaagatcctcacgagcctcagagaactccccttcttccataccctcaccgacataccagtgaacaaaagccctcttggcatacatcagatcaaacttgtggtcaatgcgagagaacacctcagcaaccgcggtgttgttgctgatcatgcatacagcacgctgaaccttagcaaggtcaccaccaggaacaacagaaggtggctggtagttgataccacacttgaatccagttggacacctatcacaatcaacaacaacaaattcacaatgttagatcaaaaattgaaaaattgattttataattagaattgatccttaagtgaaatgaatcatgttgaagtgttcttattctaaaatgtaagttaatggcaaatctcattataaactttctgatccaatgcaaacactacctaaggtttgcttcaacctaaaagttaaaatcaattctacacccagaatcaattcatcaatgagagaccaaacaagtgaacatttccctaaaatcatgttaactcgcatttcaatatgatattagatctctcaatgtgagaaaccaaacatgaacttgtatgtttggctccaggttccaggttccagatcacagatggggtttgttcatgttcactgataatccgacagttatagcctccacaactcaaaccagtttacaaacacaaatctagtgatgaatattagtaaatgtgagtaaacatgacaatggacaagagaatgagagaaaattataccaatcaacaaactgaacagtcctcttagtcttgatggtggcaacagcagcattgacatccttagggacaacatcaccacggtacatcaagcagcaagccatgtacttgccgtgccttggatcacacttggccatcatgctagcgggctcgaacacggcattggtgatctccggcaccgacaactgctcgtggtaggccttggcggcagagataaccggagcataggacgaaagcatgaagtggatcctcgggtagggcacaaggttggtctggaactcagtgatgtccacattgatggcaccatcgaacctcaaggaagtggtgagggacgaaatgatctgggaaatgagcctgttgaggttggtgtaggttggtctctcgatgtcgagggatctcctgcagatgtcgtagatggcttcgttgtccaagaggaccgccacgtcggtgtgttccaggagggagtgggtggagaggacgctgttgtagggttcaacgactgcggttgaaacctgtggggaagggtaaatggtgaaccctaatttggattttttgccataatcgacggagagacgctcgagtaagagagatccgagaccggaaccggtgccaccgccgacggcgttgaagacgaggaagccttgtaggccggtgcagttgtcggcgagcttgcggacgcgatccaagcacagatctacgatctctttgccaactgaaaatggggaaaataaaaaataggtcagacaaagtgaaaattaggtcagataaattgaaatagagtgagggagggaaggaggaacgaaccggtgtagtggccgcgggcgaagttgttggcggcgtcttccttgccggagatgagttgttcggggtggaagagttggcggtaggtgccgcagcggacttcgtcgatgacggtgggttcgaggtcaacgaagacggcacgggggacgtgcttgccggatccggtttcgctgaagaaggtgttgaaggcgtcgtgggctacaccgaaggaggagtcagaaggcatcatgccatcgggctggatgccatgttcgaggcagtagagttcccagcaggagtttccgacctggatcccggcctgacctatgtgaatgctgatgatttctctcatctttcttcaaaggctgagattcgattgagatttgcaaagcgtctctctctatctttacagctacttactacactcactcttaagtcttattgtcttaacatcctcctcagggttcaaaggggaatttcataaatctttacaatccgccccgtttggccccagcctatccgaccccactccatccattccgcatctcacaaatacatccacaattacttttttttttttctatccttttaaaatagttttactaaagtaaaaacttaatattaatttactcctcacattattttaaatgatttaatttgattttcaaaattttaaagaatttaatttcattctcaagtttttaaaaataaattaatttgatttcaaaaatttttaaaatttcaatttattcctcaagttttaaatttttttaagaatgtgagaaaaaattgaattattttaaaataattttggaccaagttaatttattttaaaatttttaagattaaattaaatcttttaaaaattcagaaatcaaaattattcatttttaaaattttgaaaatcaaattaaaccgtttaaaattatttaaaaaccaaaattattttctagtattctcttcttttttctttttttttacaaagagaaaagttttactcactttctctcaaatccgtaactatctttttagtcattttcacccaataaatccaaactaatctaattttattttcttttaaaattttatatacaattgttaatctcttactaatctaaaatttaataaaatctcccacgtttaccaaattcacaaaatatcttagtatgaacaatttccaaatttctaaactctaattattcgtgctgtaaaaaaaaaaactctattttttagaacaatttattatgtttcaatcaccacgaactaagctcaacatgaatcatgggacttcaatagtactaatggttggcggtctagtaaaaagagacatgaaatagcatatgagaatctcaagctccaccgtttttctactaattcaagttggataatattaagcttgatgaagaacaaccaactaaaaaaacaaagagcaaggttcaccccaagggatcataaaattctcatccaaacatggttacatgttttcaatgatgcagttgtaggggtgaagagaattaaagggatgttcttttgcggtaagaattaaagagaaatacaataagtatcaggcctatttgcaagtgatggcagcagttacacgactaaaatatcaatgataaaggttgaatagcatagttaatttttttgcaaagtgataccaacaagcttgcgaaagaaagaaaaatggtagctctaagatgacatcaggagatatgcatataagatttattctcatgatgtagatcaacgattcaagtagaagttatgattgattattattgaaaaaagagacctaaacgatcagatacattatttatagagctagttagagaagaaagtttttatcttctaaagtatactcgtctcttctaatattggacatcccatcaagtaatgaatgacgaaattaacaaatgtcaaagatgaacaaatcaagttgaagcaattagagttaaaaacgaggggagattttgggttagagatcatcttcaaggatccatcctagatgatagaaagaaaataatgagattgtaaaatattgtgttacttaattatagaaaaacatagaattacgtaatgtagtgatgttagtcaaactattttttataacaattttattataatataattaaaataattacaacataataaaaaaaatgttgctgatgtaggaatgtaaagtcacttgtggaactcagtaaaaaatataaaattgtcgagttggagagaagagttggatagattatataaaataaaaataaatgatacatgtgataataagatcatttagatgtgtttaaaaaatggtattgaataaaataattagataaattgattaagtagaatgtataagttattaccgataaaaaaaaaaatgggattcttaagatttaagataggatgtagacacttctatctactaggattacataagttgcaaaaaaaaagtagttatgtaattttaaaaaattaaactatcaaatatttagattttttatatataaaaattaattctaaaggaaaaatagaatttaaatgttatatttcaaaactagaataacaatgaattattttaaaaacattatttaatttgatgaataaaataaatattttaaatatattcttatatatattactgtcatcctcaccaagtcattttattaacacgagtgttctgtataagaaaaatctaataactttatggaatagtggtagaaagattattacattccgtcttagactttaagctattcattttaactatgataatagttcaaaatattgattaatagagaatcaaaatagattatctggcaaaatgctatgatctttacatcttgaagactttcaaatatgaaaatacttgacattccgtatgagaaaaaatgtattttaataaacgaaatattacgaaattgtccttatgtcgcgaagttggattggtggagcagggcggccatgtgctgccagccactgcccattactgatgcttacaattattagcagacaacgaaacaaaataacagcacagcacagtggttctacttgcttcgttttcagtttcctccatcaccaatttaccattcactcctccttcctgcatctaaaaaatatctttatttcttcaattccaacaccaaccttactaataaaacaaaacgcatcaaccatttcaagcctaatggtcaaagagtatatttttaggccatttatgttgcagtttttgttttaaaataatactattttttaaaaatatttgcttttaaaagttttttaatactatttgtttcacaagcgtgattaaaatttatttatcaacatagtgtgacataataattctattctttaagtatgtagttatgagttatatcccaagttcgtaatatgaaaaaaattatttgttcaaagatatcaattttgtacatatataagaatatatttaaaatatataagaatatatttagttaacattttatcaactatgaaagtacttattggttattgatgtaggatatcttggattcataaaaaaaatatagttaacattttataagaggattaaataaaaaaagtnnnnnnnnnntgatccaaccaagagaattactgtcttggaagctctccaacacccgtatatggctggcctatatgatccaaggtgcaaccatcctgctcaggttcccatcagtcttgacatagatgaacattggggagaaccgatgattagggaaatgatgtggaatgagatgctacattatcaccctgaagctgcttctaccaatgcatagattattaattcttccaaggctttctagtcccgttgcttgtctcaagggatagttctgatttgccctagataaactgtaatcttaaaaggatttaactaccgaattttgtactttgcatgagattactttagaacctttttaatttgacgtctccacnnnnnnnnnnttcaaataaaaagtaaaattataaaaacatctacaacgtataaataagaataacgtaaagcgatttatcatagatttgtgaatctatatgattaaaataatattctaaaatcccttgatccatatagctttagtttttttgctacacctattgctttagtttgttaaaaaaattaaattaatgttagaaaattataataagtaattaaaatatattcagtctatcataaataggtagaatagcatataatattaatggaaaacttgctagattaaccgtttttaaagattttagataacttctacttatttctataatttgtatttacgtcctttaaataaacataggttaaagaagcgtttggctattatcaaagaacatgatttgttagtatggatgttaagattttgggaatccccaccttaaggacttaaattctttgacggtgctgtaaatttattcctatacacctattttatttttttttttggactctgtttcttatgttgcagtggcaaggactaaataatgtatacttcttgctgggttggtaatgttgttgatgggaaattccctacatgatgttttgaggcatgcatgaatgggtagttgaatcttgcttcaaaagaggtgaatttgtgtttgtgatgttttgggtcatatgcttctatataggataggggtggatccagaaaaaaaaaaaataaataagggaggtaatagtggcggggtttggaggcggcgtctccgatttttttttttttttgtgaagaaaattnnnnnnnnnnattaagttgaaaataagaaaaagatggagaaaagaaaagatagaaagagaaaatgataaaagtaacaggtgatatgatgaaatagaataggatatagaagtaagatggaagaagaaatgaacatatataataagtattttcataaaataaagaaaataatagtaatgatatataatcaacttgtaaaaaaatagtaatgaaaatcatcaaattaaatttaaaattaataaatatatttgaaagagataaaataaaaaatttagttaaatgttgaattttgaatgttgaatacattgaatagcatgggcggatccagaaaaaaaaataaggggggcaatagtggcggggttcggaggcggcgcctccgaaatttttttttttgaagaaaattaaaggaataaattattataacaaaagtgtgaaaaatgtacaatttaaaagagaaaaaattaacaaaattagcatgtgatgggtgctcaaaagtaacaagagtgtagccactgcattcataaaagttacaaacatacatatccacgctcactcctttcttatttttcattttttttattattctttttctatgcttttcaattttttctcttatacaaacgtttaaactattttttattttactttattttattattataaaaaaaaattctattcttgagaatttaaggggggcactgcccccccccccaattgttaacctacatccacccatgcttctatgaatgagtactgttataatagtttgacaataccttaatcaatgttaaaaacaataaaaatcatgcataagaaaattgttgaaatatatttactttttgagggagagcaagttttggctttaatcataaatggatggtgctacggcgggaatcgcaatagttatatgcacagttgtaaaattttctcatgtcattaatttggttgagataatgagttagtggtttaattgattggtatttattttgattcgatatatattaaaattttcaaattatatatgtatctatatataagtatatgcttagtattatttgagtaagaaaagtttattaatactccaaaattcaaaatatatttttaaaaaaaaatccaaattttttataataaaaaatccattttttttttataaaaattgtaaaaccggtcgggttggatcggtccaatcgaaatcggataacctaaccggacaaatttgatcggatcaactatataatggatccaataatgaaaccgatcaggataaatcatcgggtttcgatccgatcggctgggtcggactaagttttacaacaatggttatatttgaaattttctttaaaataataaagaaaaaagagaattgattatttgtgtttataacttaagaatgaaaagactgaattgttttggttctttaaattgagtttttttttttttaaagaaaaagcaattcatctccattttattgggcatgttttattttaaaattattttttgaaaataaaaaaagtgaaagcttaccatcactctaaagataccttcattataatttgttagttgtttaatggtaaagatattacaactaaggtttagcttaacctaatccgttgaattttgaatctctccccagtgttcctgtctccagcttctctccatctgttttgtagaccattgggttgatctcatggctgaaatttatagttaatgattgggaaatggtgacccttggatcaatccaatggataagaaattataaataaaatagaatgaaagattgcagaaggcaaaagcatcgaggctcgtgaacacgaacaataacgtgaagtgcattatcccacactaatgtgaaatttttagaagtcttacattatttcatgattgtacaatcaatgtcactgttcgtaattatgcaagagaggttaaaaactacagccacacaggttattcctgtataagatatgaaaattacaaaggaaaaataaataaaaagcaaaaaagtgtcatgagcagaactttcgggaaaagattttgcaaaactatggcatatgcttttgatttcatgatctttgccatttggatttgcatttccctacataaatttctctaataccattatcctccactcattctcattttacttttcattctttattttacttataatttctcatccgttagattaatccaagggccaccatttctcattcattaacttctgtcatgagatcaatccaatggtctaaccaactggagagaagttggacagagacacgcaggagaggattcaaatcccaactctgtttgatgaacaagttaaaagttaaaacaacaatttaaagcaaatatcttttatataaatctccattattagtgactcaactttttttctttttccatatatactattttttgaactgaaaatcgcgggagagtaaaatatattaatcttaagaaaaatcgataaaatgtactaaattatcgatgcgataataaattaaaacaaaacataaagatgataaaatatcaaattctatagtccaggtaacagaaaataaagtattttaagccaaattataagaaattaaaatgtaacttatctttttttaatttaactgacaaataaatattagaattatctacttttttagagtatttttagtggtaaatcttaaattaaaatgttagatcattttttggtggacactatagtaccacataggattgaatatctctcaagatttttctaatttatttctttaatggtaaatctcattttgagatttcaaagagtaagaaagagaaaaaaaaattattcttttttaaagaatatacaaattttaagagttcttctataataattcattttttatattagaaatccctttatcttgaaagatttagtaaaaatcagatcttaaacttaaaatctttattcaatagtaacactaaagttaaagataaagataaagatgctcttacaccaccatatgaaaatccgaagttgggaaccattattaagtttcagccacatatgagtcatgatagaactgtatgtattaaaatacaagatcgtaaataccatagtcgcataattcttcgttggcatccacgtggcatgatacttgtaggcatgtgcaggatttgtaggcttcatttcattcaaaataacatcaatgaatacaactaagaatatatatgatcaaaaatattgaatgctaacaaaaagacaatgatactctatctaacttatgaacaatattattatcttagcttccttataaaaattaccaatgataggacctctctacacttaaccaaaattatctcatatgttttgttgccattgcagcacattaaatcatcgacaacagctttacactcaagctcaatgctaatgttctggtatccaagctgctgaacccatgtaagaccttgtaacaatgtcatatgcttctacttctgttggacttggttctccaataaaaagtgaaaaataacaagataatgtgaaaaaattaataaattgagatttgaagaattataaaaataagaattaaataatagtgaagcttatgtatcaccaaaaaaaatataacataataatctcatatacacatccctgcaccaaatttgaagtgtagtgtttcgaaagatagcagcatctatatttaattttaacgagcctggttggggaggagaccagctgtgatattcgtgattttggactgcagtaggtctgtgaaacatgtttcatctagcaaacttccattcgtgtaagaactgagaagagggggagatagatatttgtggatgaattagtgtttcttccaaagttgctggtttcttcgagtccaaatagtccaaagaatgatggctagctgctccctatcctcgtgtgagagagagagagatccttaataccttccgccacctgaaccttctgctgacttttaggccaaaatcctgataattgccaaatagaaattgcatgatcacatccaaagaacaagtgccattcattctcaaaacctgttccacaaaaaggacaagcatgggtgcatgagaatcctctcgtttgcaatctgattcttgttggcaagcaacctcgtaagatcctccaaagaaaatgctttattttgggaggaaatttaaggttctagatttgcatccaatcaccagcttccttgagatggtcagtttggatgatggatttcataatgcgaagataagctgtccgaactgagtaattaccatttttaaaatttccaaagaagttgatcttgatgcgtcacattcagcaaatgtattttttgaatttcatgaatatcacgatggcagaaaaaattatgaaaaagatccatacgccaatcattggattgatgttcaatgagacaacttacattgagattacttaagggaccaagtggaggtgatgatgaaggatagaactatcacttgcctttagccaaggttgatcccaaatgcagacgctattaccattgcttattcttcatcttttactttcatttgtcattactcctcaagcatggatactaaccaaacttggattgtgccccaatcgatccaaagtgtggacttcgttattaatgataactgtatacgatatagtagtatcattgaatatgagttttttttttactcttcttttttttatgagtattgataaaatttattttagttaaaattaattttagagtgatatgatttatgtttaaatatctttattataaaatcaagttaaaaataaaaatacaaaattttggatccaacttaaaaattacttaaaattgttttaatccatatttaattttagatccaaaatcaattttaattttttctctaataccaaacatatgaaaacattttcaaaattaattctgaactcaatcaattcttcaacttgatatcaaacatgcacttattccctcagtcttaaaatattatacagttctacaatattttttatgtctcttttaaaggaaaaatttgtttatatttatacattattttaatacattaagatgaaatttgttattattgtttttgttattttaattatatttttacaaataataagaagaatatatgaaatttcaaaataataaaaaagagatataaagaatattaaaaagttacaaataattttaatacaaatgaaaagatcgttttcttaatgtatatgctagaattttaaactagagataaagaaacggagaaataggcaaatagctatctagaaaataattttatttatttttaaaaattacaacagtaaaattaaatgtcaattttttctattatttttatttcttaaaggatactggttaagttttctctctctcctgtaagattatcttaacttatactactatcgtttttcttctgaaggaatatgactatcgtttttatttggcacttttaaagaaaatttttgtttttataggctaatatttgttagggagggattcactaatcacaacatacaacatatttaccaattgttcgacaccaacataatttcttggatacaaccatttgcatatatatcgcctagtgctcattactaatttgccacaataaaaagtgtttccaggaccgaatgtataaccccgtgtatgccagttatggatggtgaagctttcgggttgctgttggctatgaatttcttcatttctttgggactgcaaaatgttgattttgaaactgactgcaaaggaattcttgataaagtcaataggaatcattctgatatttctgatttgggcctcattatagctgaatgtaggagagtactgtctttacatccaagtttctgtcttgaatcttgatgttgtaaggagataaggcaatggagttacatatgctttggcaaaagtagctccatcttatactggtttccaagtttttttttattatgtttccctttgtattgttcatttgatcattaataaaattcattgaattgacttttgttataaataaataaaaagaaactttaagttcaagttgaaaaagcttcgtgaagcacttgaatcaaaatcataaaaaataatataaattaaaaattcattatgagcaataaaataatcattataatctgaaccaaatcaattaaaattggtttagttataaaatttatctttttcaatttgaacaaacccaatcaattattttttcacttttaaattagattaaattgtaatttcgatacttttataatttttattttatgatattggtcctttcattttcattacaaaataaaaagtcaaatttataacatattagttgtctaatagaatgtctactttgtttacaaaactcatgtacaatttttttaacatgctacatgtataaagtatttatatcgggtccagagttaaatttaagttaatgttttcctttcaaaataaggattgtttttttttttattttgaaacatgattttcagtccttcttttagtgatgtaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgtctggtcagtagggtgcatttttgctgagattcttggtagaaagccaatcttccctggaactgaatgtctcaaccagctgaaactaattataagcgttcttggaagccagcatgaatctcaccttgagtttattgacaatgcaaaagccaggaggtttatcaaatcactgccctgtactagaggcagacacttctctcagctatacccacaagcagatccattagccatagatttgttgcaaaaaatgcttgtgtttgatccaaccaagagaattactgtcttggaagctctcnnnnnnnnnncatgtacaatttttttaacatgctacatgtataaagtatttatatcgggtccagagttaaatctaagttaatgttttcctttcaaaataaggattgtttttttattttgaaacatgattttcagtccttcttttagtgatgtaaaatgtaaaatttttcatattaaattcacttagatcaaaattatgtaactcaagtattcaactactccagcaatgtcaaacccaaaaagggtatatttacaatgatttttatgagtaataaaaaataaatgaatatgatattagaatttttattttctagttgcttgtgagactttttcatacaatttttttattatcattttttgctatttttagttaaattattatgtattgagttagtcataattataatcaaaattgtgtcccaaaataaataaaaatgatcattatttcacaagaacaacataaattcaaatttgaaagttggaaaaccaaatcaaataaatttttataagataaaagaataaaagtatattttatcgtttttttaattagactacgtagcaaatcaaatagcacaaatcaaatatttcaaaaccaaaccaaatcaaactcttcaaaatattagacttggaatcacaagttcaggaaaaaaaaatactataaaaaaacaggagtgatgtatggatagaaatagcactacgtagggcaagaataggaggagtcgaggaggtaacgcactttccctgcccgagttaacattgaatggcttttggttgtacttgtagccatagggttggtaccgaataattttgttagattttctacagattagttgagttgaaaggaaactagccaatttgtttgcacctgaatgaaaataataatgaaatttaagacgaaacggctgaaccaaaatctgtgaatgttaacgttagcgtggaaaagaaaaaggcaagacacgtttatattttagatttagatttatagttcccaaaggccaaacacccatagagtacatacttacgttgtcgtattttacattctctcttttacgggaaaagcaaagcaaacccaatcattattaataataatgccgtgtgggttggggtcgttgtcatgactcatgtgagtcatggggtatgccgtatgttaaaaatgttaatgtgcttatttcactttctttcccaaccataccctaaactaaaccctcctttgatattttattttattctatgcctttatgcctaggtaattattattattgttattattattattattattattattatatggatacgttatgatatatttattaatatgatgactatggctatagcctccttttcttctctagcctgatctcgattaaattggacatttattattgtttatatgataagatttgaaatgatatgaaatccacttcttgaaatccaatccattatccactctattctatagattattgcttgagctgtgcaaaattgattttttgtacagaatgtttacttgaagctccatcaattgaggagggattcttcatctttggattcgcttttggtgcctcggagtcagagctgcaaggaaagtggagattctgggatgaaagctgaattttgtggtatgaacgcttttctcactcttttggaatcaatttgatttggtttctttgttattggggtgtgtgtgggttgaaggctgagatcaggtgaagaggaaagataaaattgaatctttgttatattttaagaaaaaaaagatgtccaaaaagatgggcttggtgagaataggttctaaaaagagacaaggtgacatcaaaagatcaaaacccagatgtagaaatagcaactaagaattgattcgaaccttctctaacatggcataaaaaagtatccaatgattcaccctttatcctgcaacaatgccagtggatgtatatatgcattgtgtttctgatatttgtttgataccagctttaacagactgttgattgcttgtcacagttagtaaatgcatgattcatgcctataataatgaatttactgttgtgagttttattattagtcccctgtgtgtgttcacttattgagaatatattgtgttgctgttaatttgcagggaaatggcaactttagttgaaccccccaacagaattaagccaaaggggaagcattattacacaatatggcaaacattgtttgagattgatacgaagtacgttccaatcaagcctataggccgaggagcgtatggcgtggtgtgctcttccatcaacagggagaccaatgagaaagttgcaattaagaagattggtaatatatttgagaattctattgatgcgttgagaactttaagggagctgaagctgcttagacatattcggcatgagaatgtcattgctttgaaagatgttatgatgccaatccacagaacaagttttaaggatgtctacttggtctacgaactcatggatacagatcttcatcaaattattaagtcctctcaaccactttccaatgatcattgcaaatatttcttgtttcaggtactagccagtttgttatggtattttcctttcctttagctcttctttctaatttctaaacctttgtggttgtgacttttcttgaatttgcagaaatgtataaatattcatttgaaggagattttgttgggggttgaactatagttgcaatgcactcttgcagtgttttaattggcattgccatgcttcaaagtgaattccccattttcaattattaacgtacaacttaaaagtgaattaaatatcgaatatcctctttcatgaattcttatactatatcatcgggctgtttttgaggagttgggacaatttgagttgtggctttacattctctagtttgaatgtattactatgtttcctgagtcagactttagtgtttcagttccatgatttttcaggtgaagtctagggaaggggtctgtattctcttcttccggctagatattgtcatggtactagacaacgaaaatcattggcccaaattgggaaattgatatgaccttagcattgtttgattgaatgatgaagcttcttatgaaaaagaaccctattatggactattcttgtcaccctcatcttttctacatttttatgagttttgcagagaatgttgaacagaattgacaaataataatctacaagtagaaagcagttaacggattctttatgagcttctaatctttgcatattttaactattcttgtgaatgatactaaccatatactcttactttagctccttcgaggtcttaaatatcttcattcagcaaacattcttcaccgggacttgaagcccgggaatctgctcatcaatgccaattgcgatttgaagatatgtgactttgggcttgcacgaactaatggagttgatggccagtttatgacagagtatgttgtcactcgctggtatcgcgcaccggagctcttgttatgctgtgacaattatggaacctctattgatgtctggtcagtagggtgcatttttgctgagattcttggtagaaagccaatcttccctggaactgaatgtctcaaccagctgaaactaattataagcgttcttggaagccagcatgaatctcaccttgagtttattgacaatgcaaaagccaggaggtttatcaaatcactgccctgtactagaggcagacacttctctcagctatacccacaagcagatccattagccatagatttgttgcaaaaaatgcttgtgtttgatccaaccaagagaattactgtcttggaagctctcnnnnnnnnnncaaaaataatattcttagttataatattttttaaaatatgattcttgagattaaaatataatatcttgacaaatactcctataatattattattatttaacaagatagagtcgcatttgattcgttcgctgtttcaaaaattagcaaaatataaacaagaatcactctgacttaatcacatcttcatgtgacagtatgttcgtctttaagcttgagataacaaaaaacaattcaaaaaatgttgttaccaacgtatataaattagtaagaaatttataatttataatttattgtcaattgtcacaatgaacagacagatgacgtannnnnnnnnngatgtctggtcagtagggtgcatttttgctgagattcttggtagaaagccaatcttccctggaactgaatgtctcaaccagctgaaactaattataagcgttcttggaagccagcatgaatctcaccttgagtttattgacaatgcaaaagccaggaggtttatcaaatcactgccctgtactagaggcagacacttctctcagctatacccacaagcagatccattagccatagatttgttgcaaaaaatgcttgtgtttgatccaaccaagagaattactgtcttggaagctctccaacacccgtatatggctggcctatatgatccaaggtgcaaccatcctgctcaggttcccatcagtcttgacatagatgaacattggggagaaccgatgattagggaaatgatgtggaatgagatgctacattatcaccctgaagctgcttctaccaatgcatagattattaattcttccaaggctttctagtcccgttgcttgtctcaagggatagttctgatttgccctagataaactgtaatcttaaaaggatttaactaccgaattttgtactttgcatgagattactttagaacctttttaatttgacgtctccacgaggacaatggcatcttgtaacttgtatatagccatgcacactgttttttggtttttcggctaaaaacccatttgaactagtgttgttcatctgttgtttcctaaaatttaacagaaaagagtaagataatttgtgctttgaaatatatccatggttatgagatgatgttttccttaaataacacggctacctggatttcaatcgtgggatcattagtgaaccaaatgtgtttaggttcagacaaaaagcttaagaaccttcaatagattcttataatgtgcttagacaagcaataaactgaagtaattcttttcattcgagatcttattcacaagcttaattaactacggaatttatcgaaatatgttgaaaataattatagaaaggtcaaaaatcactttcataaccctaaatatagtctttcaaatgcctccttagttgatttacagttctcacattgtaattacttcatttctaagggactagtatcagtggcatttgcattgtggcacttaccacaggtttgaaaatcttgtgcttgtgctttaccggtacagcatcaatatcggaaaatgtatcagagtgtcatggaaagttcatcattccgggtatcataggcacgttttttgaaagggaaagttataaaacaaaatgaactatatttttttgatgaactttatgtgacctatgaggagtgtaatggtattttgaagtagaaacagtaaggagattataaaacatgtaaagacctcagaagtgcattttacctttttcttgcaagttgcaatcatattaaccattaatttggttgctgacttgactaacatggaactgctaatgtagactgcagaggaaggatattttttttggccttttgtttccttttatgccaaaatataaattcatattcagcattagcataaatttacatggtaatgaaattaacagtcttttcccccctctagaaatgttaatatgtgtgtggaaatcttaacataagccgatggtactaaagagaaaaatgatccatgaacagttagtgctcgcattcacctacagagagaaagatggagaagagagaaacgtaattggactaaaaattaacccaagaatatactctaaagagaaaatttaggataaaaaattaataacactcaaattacttgtcatcatgtaaaaattaatagcaataatagtttcataccacctagtattttattgaaaatagaaaagagaaaaaaaaaaaatataagcatctgaggtcgagtgtttactctgcagtaggagtgtgtatatcatttctctaatgataagtcggattccaagaaaatagttcacaatgggatatgtttactctgcaacatttaaaggatatgtttgccacactgataaacttcctgcaacatttaaaggatatgtttgccacactgatattactttttacatattttaagtaagttccatcatcacatattaaattttactttttacaacttaagcaacatttctcagcaaaacattaacttttatttattttttttaaataggtctcataaataattatacatcctcatattttatcatattaatttttattagttactttttttttttaatattgatgcgcctaaataagatataagagcctctgcttatttaagcaacttgtatttgaagaatgcttggtaatggcacgttaaagattggtttagtttgtgaaaaacaaattcatatcttataaaattatgagtctaaattttattgtcaatgtgaaaattttgttaataagtaatatataagtatatcggtaagtatttattgaaattatattcatcttgacttgatgagtcattccttaaaatccaactcacataaatttttcagaaaaaatcctattaagcaccattgcataataagaagaaacaaaatgataaacacctcattgaggcctaactctctgtaaaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatttgaagatatagttatcaaattttagcttatactacatgaataattaaatgtctagtttctcttaggaaatgggtagtctaacaattagctttaacttttttgttcttactaatctaatcagtgtcttattacattggtcaaaaaattaaaataaaaaatatttaatatgaaaattataaaaaaatcataaacaacaaaattttatacatttcaataaaatattaaaaaattaatttaagacaaatactaatcgatatttttgatattgattaaaaagttaaaagaattttttgattaaatgtataaaattatattaattataaatttgtacatacttctataatctttataataaatatttttttaattctttaatcaatatcctaatattttaacgacagattaacaatatccttaatttaatatctcaatattttctctcccgtacgtccaaactccaatctcagaaagtgagggggaggagtgggcaatggcccaagaatatgccagagaatctccgtattatcatgtgagactgtgactgtaatgcgatgttctttaccgatgaaaacgtcgtgaaaagaaaagcaactaatagcacccgccagacgcagggagtgctgacaacgtaaagtaacataatgagcatttttagggtggtgctcgtacgtctttgtatttggaggagcacccatgatatgatcagatcttgtaatagtaatatacagtatttcgtttttctaaagtgaccaaattttagaaaataacgtacacttataattattgaaaatagttgagtattgtaataaaaataaattaaatatatacattaaaatatgttaaagaaagctctatatatgctttcggtttatcaacgttcttgttgagaatgacaaattgaccatggatatgcatgattttggacagtgaggctgcgagtctgttttctataacactttgtggttacataatgttttcattttcatctcatacttcactttttttttttttcacttctgaaattgttggtgtcttctattttttggtcatagttggatatatgaacaatcaatttcgggtaccgtgcgtaaagtaacatgtcttccatttagcaactgcacacattcaggaaattttctgaagggtgatcagtgaaagcaatttgcggctctgtttagttgaactttttttatcagagtagtgtgtgtgagagagagagagactaggcatacttaaacacattcatcttttgtttttgacgattacttctcctagtcaatcaggtttgtaattcttagttctaactacataaaagccgacaaagatacataactacagaaacaggcgtcgaaattgtcataagattttaagaacatgtttagggaattcagaacaagttatttttttgactggtcacaagaaattaccttacttttaagttaacacaattgaactttttcaacagctccttaccaatacaactcgagtttctttattaatcatgtcaagtaaacattaacagttgagctaaaaatctgattttgttttggaaggggattgagattattatcaactcagaaatttccatcttatcggtagtattaatgatgcaataattgtgcaataaaatcattaaaatgtcatatataagagtagtctttttctaactaaattggactatataataagtttaatagataatcgacgcaatggagattatcggtcaaagagaagatgaactgaagcagccatctgatttttcctaggataaaattataacatcttatatcaattggcacaatgaagattattgagtcaaagaaaaaatgaacagaagcagccatctagtttttcataggatacaattataagttattctcccacgttgaaagcattagtaattttcctgaaacaggagtcataagtctttgaaaatattaaaatcggatttgctggcgctggtgatgtcaatgacttaagcggtaaggtttatatgcatagttgtaacatcatgaatgtaaccagaatcaatggtaggactggttcgatatttttgtctcttaattaaataatgggatattcattttagaaatgaaatcacaacttaaaatatcttttatcctattatagattgattcggtgagaaaaatattagttagatgtaaaatagaaatctaatatgcttattgattaaaaaaaatgcatgaatgtaagattagttgaagcttccgcgaaacaacatataaagttgaaaatgagtgagacccaactcaaaagggttgttctgcagacatgacttgtacctatttgtagaatatagtgttattaaaactctgcattcacattgaaaaatttggatccttctagttctagcttatggatgatgcaagagagagagagagaggaacctagctgacaaatgggtctcacttgaatcttgtatgatcttgctttctcttaactacatcaagtaataaaccaaggaatatatatactattctcatttcttttcttttctttggatcagttcacttgtagagaaatcgagcaaaaagagaataaataaacattaaaacgaaatgagattcacacttacattttattttaattcaaaattttatgttatttcattttttttttactctatggacgggtacctttttctcttttcttccttgtaaagtttagtgtaaacctcctctttaaaaaaaataggacaaatagctgggcaacttggactggcatggccacccttctggattttggtcgggaacctttttctttcttttccaacacaacccgtaactggaaccatgtgcttaatgtacatcgtaaatgaaataaaatattatggtggtcaaaagctggctctattgaaaaaagcatcgatcaccttcggtaaattaaataccagtatagtattgtgttagttatggtccatcatgtgacaataattgatttaaaattatttctgcagaatatggagtatagttaagtttgttaatattcgagttcaactcctctcaccaaaacctcacatgaaacgctgtggaaaaaattagtccatgtggaaaagatttcttaatgatgatagtaatattttagtaattaaaaatgtgaatgctgtgatttcaagatgtccatatttttggtagatagaaatataaatataatagcagtgacggattaatttaaacctaaaccatcttcaaattatatatctatatataacactacatcatcaatggctctaaacaatgtggaagttttatcttttatgcaccttacttttgaattaattatttgattcgtttatgtttacttaattattctgttttatagaatgttgaaatgattagagagagttatttgttgttttttcgtgagttctaaattctgtttcggtggtatgatttgtgaggaataaaaaaaaccattttaagtgattttcattaatttttgtattaaatttagataattaaagacaacggatcaattgaatgtaaaaataaattgtgcatatgagtggattatttctgtcgttaatatttttgacttggtcatatacgtaattttttttatcggcacttggttattatatacgtatttttatgtgtgtatatatatacagtactcccataatactctatggaaaaatgtttaaagctcttgatgtttcattaaaataacagggtagttaaaacatagtattatttgttgaagtaacttatatattttaaataatgataaattttaaacaaacttaaaagatgtttaatacatggaaagaaaataatcacacgttgaaattgattatgtataataataatttgagtttacagtaagaggtcaaaagcttttaattgtagctcacccaaacaaataataggtgattggcaatataaggagtagaatatcagacgccaaggagcaccaataaaaaccagaaaatgattattatagaaaaaccagaaggaactgcaactacctaaaattccactaataaataaatatttcaaatgggtggtccaacatctacgaagtagatcaccctcatattgcgtttccacttggtaaatggcaacatatatatactaggattatatatcaacatctttaacccaaattatatatgttaagtataagtaaataaaaataaaactgcgcgtgctcatgaacagaaacagtgaccatcgtcgtactgtgtgaccctttccaagtcctttccctctttcaccttctcttatttctattgacttttttaattttgcagtacacagcaaaaagcatgaagtccaaagaccaaaaaacctcactagccaattattttattgtattctattattacaatgggctatttttttctctataaattccgccccatgaatcccttcaaaacctcttccccttctcatcttatcctcctcctaaaaattggtcaaaatctatccaatctctttgcatattccttcttatcatcatcatcatcatcatcttctctgttgcctctagaattgaaaagttcttcttcctgcccatagtctttgacacccttttccaacctctagattttttcttccctctataattatctccttcacaccaaccttcttattccacatatcatcaattaccttgttcctctcaaagtttgattatttttctcttggattggattgctataatttttgttcatacttacatgttatgcagttatgaatgattgagaaacaacacaaatgtcttctccagtgatctccgagatcctcctctctggcttcaccataaactcttccctaagacgcaggacacacttggtgcaatctttctctgttgttttcctccactggttctacgttttctcatgaactaaataaattaacctcgtacatagtataaacatagtacgtacccgtgttcttttttcaaattcaatcattaaatctagctagcaaattagagttattattgttcaaatagcatactattgcatggcttctcctggtggaagtggaacctattcatctggttccagttctcttcaaaactctggttctgaaggagacagagacatcatggaacagaggaagaggaagagaatgttgtccaatagggaatcggcacgtagatcgaggataaggaaacagcagcacctggaaggtctgagtgcccaattggatcagcttaaaaaggagaacgcacaaatcaacacaaacatagacatcacgacgcagatgtacctcaacgtggaagctgagaacgcgattctgagggctcaaatgggggaactgagcaacagattgaactctctgaacgaaatgatcagtttcattaactccaccaacaacaactgctttatgatgttcgatgaggcacaggaaacgaccactcagctgttcaatgactgtggcttcatggattatgcttggaatggaataccaatcatggcttccgctgagaatgacatgttgatcatgtattgatcttgattgtaacacgacacccacgtcttctcttgttttaatttgcttttgtgttttacttgtaatagtaatgtctattgttttcagtttatgttatgtttagggttgtcttgtcttgtgcgtatttcaagaggaagattcttttttcttctcgaaaatgtaaaatatcgaccttttattttccaggtattattttcgttcatttccactctttattttattaaatgtctaatttatttttcaacttttaacttagtactatgttttacagattaaaagattcttttgaggaatgtgagcttgaaaatataatattccatatttgttgagaattttgttaaaatatatttctaggcattttttattcctagaaagtagtattatcatgttttattgtacttttatttctaaaatgagggttgaaaaagtcatatttttcatgggaacgtgaaaaatcatttttcaactcaattataacttctacttttattttttgttataattattttcatttttaaaaatatgtttagaaatattaaaatttaatcaaacattttaaaatatatccaaaaataatattcttagttataatattttttaaaatatgattcttgagattaaaatataatatcttgacaaatactcctataatattattattatttaacaagatagagtcgcatttgattcgttcgctgtttcaaaaattagcaaaatataaacaagaatcactctgacttaatcacatcttcatgtgacagtatgttcgtctttaagcttgagataacaaaaaacaattcaaaaaatgttgttaccaacgtatataaattagtaagaaatttataatttataatttattgtcaattgtcacaatgaacagacagatgacgtatgtcatataaacaaaattttaaaaccaatcataactagttaatgtgcaagttcttttgattaattgtaaagggggaannnnnnnnnntacttttattttttgttataattattttcatttttaaaaatatgtttagaaatattaaaatttaatcaaacattttaaaatatatccaaaaataatattcttagttataatattttttaaaatatgattcttgagattaaaatataatatcttgacaaatactcctataatattattattatttaacaagatagagtcgcatttgattcgttcgctgtttcaaaaattagcaaaatataaacaagaatcactctgacttaatcacatcttcatgtgacagtatgttcgtctttaagcttgagataacaaaaaacaattcaaaaaatgttgttaccaacgtatataaattagtaagaaatttataatttataatttattgtcaattgtcacaatgaacagacagatgacgtatgtcatataaacaaaattttaaaaccaatcataactagttaatgtgcaagttcttttgattaattgtaaagggggaaactaataaagtcggtggatgcttagatcttttaatttaggaaaagagacaattgtttcatttcatatatatgatatttttcttattctttcatttcgtttcatatatgatatagtgatacatttgtaccgtttcctaaaatccaagtgttaatttgtgcatgtgaatataatgtttgcattattgctgatgcatgttttcaatgttgaagagaataaatgggaaaagatataataatcaaagtgagaattaaatagttagtagttcaacatcctcttaaagaaatgaaaatgggaaagcaaagaattggaatctattgaatattttttccaccataatattaatataaaatatttactaattttattaataattaattttcgttaaaaatctatttgttcgttttttaataatttttttttctaatcatatttttcattcataaaattcaaaactgaaatctaattttaaaaataaatctataactactcaaactaactacttatttaactacttatttattattagatattccttcatgtgtgaacggaattatatcatgtatcagaaaagggcctaagcatggccactcgctagctcatcctgaatccagagaattcgaaatcaccaaactatagcctgattgtttgtgtgtgaattttttaaaaattacttttcattacttatatttttttaacaaataataaatttggaaaaaatccaaaatacaaaagcaaacagctttagattttttcttaaactttataaaaaaagttataaaaaatatcattaaaagttttctttttctttttgcaaactttacgtgattacgggttagtttgagtcatgatttgttttgtggggggaagtcataatttattttaatcgatcttagagaagttccataaaaaaatgagaattctacaataaagtctagccatttatgcaaatcatcgattattataccattttctaaaatataaaagtttaattgtgcattagaatataatattcgcattattggtgaaatggtgatgcatgccttcattgtttcgaatttcattgttggacagaacaagtgggaaaaattcacatattccaagtgagagttgaatagttagctcatcatccgtataaaaatgaaaatgcaaagacggtgtaagcagttcggacaaattatgaagcatgcagatgaactcacatctaaataattttaattttctagaactgaaatatttaatgtgtcgtaactcgtaataagacctaatcatgtcttcaggatcccagcatcgacccagaaaatccgaatcacttgattgtatatttgtattattctcacattcgtttgtgttcataaaataaaaaataatttataaagaaaaggctaaaaacagttgatattttttccagaattaaaaaagtagtctatgaaaaaagtaatctctttaaaaaaaattcaaacttatatgaccagtttgagtcatgattttgtaatgagcaaaagaaaagtaatcttttctaatcttaaagaagttaaaaaaaaaatatcgttaaaattgtaaaataaattataaccatttgtatcatacttccttcccagacaagctatcaagtttcaacgacacaagctatttcaaaacaaacggcaagatgatgataagtgtttaaggattataaataaataaatgagatatgatttagtcaatttatttttaaaaaataatcacttattttcatcaacatttaagggtgttttaaaaataaatgattgtttttatttcttttcaaaattaatgttaatcaaacatgggctaattactatatagaatgaccgaggtagttataagctttaaagaaaaattgtctagaaaaaccattcaaactttcacactaattatttttttgtttaaataaccgtgtactgcaaattagtcactggtctttgaaagagaaaaaaaaaaactttatccgcacttaataaaattatcccaagatgataagcaaattgccaatgttgtagttccttttggaggaggggaagatgtatctttccttttggaagagaagaaggggtatatgcataagatagataaaattgaagtgattctttgaatgttacaagttaaattaaaataaaatgatgccacctaccacaatgtttaagtgcatgtttagatttacgttctaatgactcaaacgttcgttcatttcaattattcaaggagaaatttttttcatttaaatgcattagaatgcatgtaaatgattactcaaacatagtcaaaggcagatgcatgtaaatgcattctaatttacatacgaataaaaacatctaaaatttaatcctctgcaatttcaaagttgcccattgcaattaaagacttaaatttagaagtttctggttagatataaatgtcatttaacatggtgatatatttttattctcaattttatttccttcttatctccatctaaaatagtaaaaaggtttttttctgaaaaaaattctttattctttgttttctttccttattttaagaattattagggtaacaataagtaagaagagcactttcaaaaacaggtattctatcagcccgctaaatgttttccaaacttgttaaatattcaataaccagttaaaattacaacattaataagaagaaaaaaattgtcctactagataaagttgattgcataattcgcacgacataattgtattggttaaagaccgaattctaaatgataaaagcagacatgataaaattaaaagcaaaaaaatataagggctgcttttagcttatttcttcagtataagcattgctttatttgtcattgccactataaagtttcaggatggtaccataatcaatgcagtacggtttctcacattccccatttacaacctttgattctcatctctatgtaacaatattcaatgttactacacaactacattgatcatgtatctatataaacatttgctttcccaaggacaaaaagtctgctagctggcatcacttgtcttccctatccatttttaacactcttcattaataaattgaacaaccctgtgaaataaacaagtatgcagttgatttaaaatttcaacatccttctctaatagtttatctctaggctgacacaaaacagttctttacaagcctctaatttatcagaaatggaaaaaggtccctctcacttcaaattttttcttccaacatcaatatgtcaacttttcacccgcatatggctatatagccttggtcaccaaaaattactgcaagaacaagcaccattaagaaagtggtggaatctcgtgttatccctcacaacaatttttcttcctgtaacttttgacgatccacacattacaatatgacaaaacccttcgcacaaccatctccgaatcttgttcttcttcctcccttgttcattccactaaccttcaggtcacaaggagaattattattccaactcatgcatggttaccagcatgagcatggtgtttgttacgttaaggcccagccaagcattagtgtggcctggatagaaagttgaggaatgtagcgacactctaaaactctcctaacactttttatgtaattggttggaatttggaataacttattattaattttggtaggttttattttttattttgtacatcagtgataaaccttttggaagtaactttgcaaatggtgattacttttaataattctaacgtactagatattttttattttatttattatatatatatttgtatgagatatttatgtttaacttttcaactaatgttaaatttaaatatttttattaaaattttaaaatgtgtaatgataaaataaataaattattttacatttatgttgtaaataaaaaaattattaatgttataatattcgaagttcttcaataatatttaaattttgttgacatgacattacattaaccatgacagatgacttgacatggatatggcagttgacgcagaaaacctagcctaggggatgttttaatgtgagagtataagctagaaggttttatcctcgatcatttctcttgtcaactgaaatatttaacgaaaagtttatcgaaggattattacaattgcataatttcagaacttgaagatttcaattgaaacttgaagaaccaaattagataattgtgatacttaaaggtccaaaagtgaaattaagcgattatcttttatctattgtatgtattttttccttatcacaattgtacattagctaatcaatgagttgcaataaagagtttaatttctatgctttttttttttgtgaatgtttaatttctatgctattagtgcaaaaaagtgcattttataagagaattatcctcgtaaaaaaatcaaccgttaacattttgtcaattctagtcattgttgcatatacatatgctctaaaatctcaatcactgttgcaacttactaatatagacatgctacttcccagcgattcaattcacttttaatgcccatctataacaccgatgtacgtgtccccgactatgaaagcatgaacttttccccccaatgattggatcaatcaatgccctccatcacgggattggatactttaaagtgaaataaacctatccaccctctaatgtaatttaagcaactcacaaaatttagtttgaaatcaagggtgcacacacccacacatttcacttcacatatttttttacatgaggatccaaatcttaataactcgaatacaaaaattttgcaagacccagatgcattcccatactacatacaaatcatatgcttttccctgccctcaagtaataccaaattattgtttgaagaaacaattgtctgcaaacttaatgaataaatagcattaaaatttcatatggtacaacttcatgctgtctgataaggaaataaaaccaatacaataggccaaaactgcaagaattgccccacagacaaccctatattctcacgcaatatggtaagaaaaaacaatagaggaatagaacgagaagctcaaccctatattctcacgcaatatggtaagaaaaaacaatagaggaatagaacgagaagctcccacgccacaattccctaacctcttttggactcaatcgcactattaacattcataatatacacattctagagaaagctccctttccaatcacaattgactctgcattctcaaaactgatacagaacaccatgcaagaatgaatgatggaaaccatcttatggcaaaaagaatgggtaacaaatatagagaccaccaaactggaaaaagcttgttcccaaaaagtgcaagacaccaactgccaagccagatgctatgaagaaatgatggatatgcagcaaaacaatgaaaactacgaagacaggatagattccaatgcaagttgttgctgcggctgcaaagatgaccaagtagaagcgagtgtagagggtggtaaagtttgctggagctgtctgagtaaattaaccatacgaccagctgtttgttctgtcgcaaggtctttaccagcacataaaacctgtcacaaaaaatgttttccattaaatggagaaataaaatcaaacaaatccaatataattatatatattaccaaaaagaagcattcactgaatgcgtccttgtttgatggaacaaaagactgctcattttatacacactaaggtattcacgggactaatgcacgaggaaaaaatatcaattaactatgtatacatgcacattgtcaatatcaacaccaaaactactcaaatgaactatttaaatgattgcatgacatcaactaatattacaaaagtttataataaaagaatctaatggctacaattacaaacaaataattcattgccttctggtatatattccttcatgcaaataacttacagttgcaatcaattatgaaatgacattttactcaattccaaaaatttctagacatttcccaaatattaatctttcatcatatgacagggtgctacaaacaatttttacacttccctggtctccaaaacttaccaaattgatcaaatttccaataaaaaaaattgaaccttggacattatgacctatgtgaaaaacacacttcattgtaggaaattgcctaggttaacaagccaccattggggagttctatacattaatgtattttttctattctatttagagaagtaatcttattctccttactcttgtatacagcttgctttctatttaaattctttcatcaaaaacaaaaagtctactagtgtttctgattcaaccctacaacccaaaaatattaagcaaacaacccttaactttaggcaatgcagacagtcacacagattacaaattggcaaagttgcaaccaaaaactaacctcagcaaacactgaaactatttttggaaggtactgattgtttgggcccaacagctcactgtcagacctgcagatcaacagacaattagtacagtggaaaaagatatgcctgacatcttgagcatatcagaagattggaaaagaagagtagggcccctaacctctcagccattgaacaaagttgatcatgcacaactttggcctcaatcaaatcaccttttattggcaaacagtttagccatgcaggaactacctgcaaacatgacagaacattacaaaaatattaactatcatctcaacctaaaaacaacaatcagactcagaaagaattgataataataatgacaaacataatcaagaaccaaaacacaaaagcaagttataaacagaattgacctgggcagaatcaatactgtcgcgatgaaattggcaaatttttcccaaagcggaaacagcattgtcatatgccattacattatctgaatgaagagcattaggatgctggatcacagcatttaacctcgaaagagcctctgcagtaagccaacaacaacttgttactcaatatagtacagctttttcatagtttgttaatggatcaagcagtatgataggaactggatcaggaaaacaggaaaatatggaatagcaggaacgtttattcacagtgaggcaatttgcctgaattacacagtaacaatggtgatttcgagacaccactctccactctctgtttctaactaactcccttcccttttctctatctatttataatatctatctctctcctactaactactgttagttagctactaacctccgtttcatttaacagctatcaactcttataacagagtcactactaactccccttctatgatacattttgccccatctattattattatatctatcaatacccccccccctttcaagagggaccttgtcctcaaggtctaattgaggaaacacaatactaatttcttctaaactctcccagctatcttcatgatgcggcaaccctttccatttaataagcacttcgtgttgaccctgtgctgtagtcctcttctgcataaccttctcagcttgcacctgaagttccaggtcttcagtcaaagcttgaggtaaaggttgaggctgacaagtaggtttaactgccttcttaagcaaggaaatatgaaatacaggatgaattttgctttccacaggtaactccagtttataagctacttcccccaccttctgaattatcttgtaaggcccataaaacctgggactcagcttctcattcggtttctttgccaatgacttcatcctgtatggttgcagcttcagaaacacccactccccctcttgaaattgcagctcccttctatgtttatctgcatatttcctcatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaatcgcatctccagcgtttcgcgattcgcctctaaggctctctctatcgcgtccactcgagcttccattttcgcacttcccttcgccaccattaatgtccacagctccaagatcggagctctgataccagttgataggaactggatcaggaaaacaggaaaatatggaatagcaggaacgtttattcacagtgaggcaatttgcctgaattacacagtaacaatggtgatttcgagacaccactctccactctctgtttctaactaactcccttcccttttctctatctatttataatatctatctctctcctactaactactgttagttagctactaacctccgtttcatttaacagctatcaactcttataacagagtcactactaactccccttctatgatacattttgccccatctattattattatatctatcacagtacctccaacaagatgtttgaacacagatccaccaaactctgcacaaacaccgagaccatacacagctgcctgcagaaatatgaagcaataccaacatcaacaatcaaacagcttaaaagttaaaactaaactatcataccccagtgcccaaagactcctcactaagcaaagatatgggagagggtaattgtatgcatttccggattcaaacccatgaccaatcggtcaccaagacacaactttactgttgtgtcagggcttgcgctctaacaatcaaacagcttacgcaataaaaatggtattcaaaatgttaacagaggatacctaatgcttacctgtctgacgtcaggagtttcatcattacaagcctccaacaggaatgggagataggtatcataatacctgttcaattggtatataaaagaatgaagttgataaaatgccttcataattatcactgcacaaaaaaatggtaacctagcaaaacaaagagtgcttacttaatagcagcttcacgacactgctctgcaacatcatcaaaaatacaaattgcaattcttctctcttctggagtcttgtcccttccctatatccaaaacattaaaccaagagtcaaaacaatgatgtacatgttttaggctgtgtttggtaccacatcagaaagccaaaaagtgcatctgatatgtgaaaaccataagctctaaatactaacttctatgttggacacgagaatcaacgtgtgtactatggtctaaactaacgtgcaaccaaacattagttctttgaaaattgagtttaaaactaatcagcaggcacaacttgtaagaaatctgctgacataacataatatagaccactcaaattgcagaacagaacatggttaaagtcaatctcacagtttaaacatggtagaatgatacatttcatcggaaaaaaaatcttgcaagctaatgtgcattggagaatgaaaatgaatgtgaactccaagatgacaagtgtaataaaatagtgtaaactggtaagatgatgatagatgtgaagatcagaattagaagtcaaacatagatctatgcaagtatgtggcttgcaagtttatctctaaatgactaaatctatagttaatgttgcacgcaaacacagtaatctttcacacttttgaaaaggcacgagttcaaaattagcaatactgcacagattctacattttgaaatcatatttaaaatttactaggtaaactgagaaaacagaaaaatttagacataattacaccaaaacaaaatacaaaagataatgcttaaaggccagctgaatgaataaatggaaatagaaaaactaattaataatagagttgctagctttctcaaagaacatacccacataggtgtcagatatgatgatagttcatcaaagaagggtaagaaggaggctttgaaggttttgatcaaagttcccaatatctcacccacctgggacaatgtatacatacattagaaggaagaccaggaaactgatctgcataaacttaaaaatacaaagatagtagtccagtacttaagatgtttcaaattatttttagattaaacaactaacttgatcaaaaacttcctcctcttgttcattttcctctttaatcagttccccctcttcatcatcaaaatcttcagcttgggtcctctctgctctctctcgttttctacttgaactagctgtgatcacctgttttatctcatccacgatggatctgacctggctttcatccaaaagcatcccagagatctaaaagaggaagaaaaaaaggattggaacacatccaaaacatatttatagtgcaccataggcactcaagggaaagataaaaaaagacagacaaaaaacaagaaaagggtcgatcattacccaagcatcacaggaacaactactaaacactcatgcacaataaacaaaagcacacattgtgaaattgaagaatataaaccacaaccaagcatcctctgttaattatatataaaccattggcctctaaatcttaatagttttgcctataatatttctcagtcgcactctagctccagtggtaggactaattgacatcttaccaagctctccttactagggcctcctagagaaattatataaagtgacatcataaaaggctgtgccaaagtaaataaacatatgcagtcaccttcacaggaaggcacaccaattttttgcatggcatacctcactctaatactgcaaaatctacatctacattagtataaagtaatgtgcacctagtgtcacctttaatgaggcaggcagttgctaagtgcaaaagacaaatttcgtaattaagtcaactaaacaataatttaaatcctcaacatgccaatcatgaaaagggaaatatttaaactgtaaaatgtagtttttatttgccaattgatcacaaaacctagcagggatagacatcagttagaagaataaataatagcagagtcagtgaggctcttgattgaattctaataatgataagcatcaaacttcaaattataatatataacatcaactatgccaaggtatattcaacactcatggctctatataataaagaaaagaaatttatccagaaaaaaaaaaaaaaagacaaaatatatgacaatgttatctcatgatccaaacctgtaagcattcatttaatgaatccaacatgcttgcacaaatctctgtgtcaggttcctgcaagtaaacagaaatgggaaaatctcagcaaagaaataccaagggccactgacaagtcaggcaacattcaccaccaatatcacctagagtaatcttagtcctcaaacccatgccagaaccgggtctcctaaactaacaaaaaataacatgctgcactcacaaaggattgctttggtttatatgaatattcagaacttaaaatattttcaagacaatttcaaatcaaaaaataaaaaatattcacttccaaaatccaaaaatagaaacttcataacaacacaactaggaatggataaacttgaatatcaatttaccttgtgcaatgcttccaccagagctgggatgatactgtcagtcaaaaatttcaaataggttacatcccggccatgagattgccccttctcgatagctaatttcgcagatcgtaatagctccggcattgctgtagcaatattggaaatgataaacattaaaacagatagagtaatgatataaaacacatttactgtgcaaggaaaaatcatcgaccaaaaaaggatgcaaagcaacaataatttttcatacctgaaacagctgctttcctaacttcctcatggaaataaaatttaaggagtggaactaaagttccagcaacctgcgttgcatacaaattattaacaaggaaaaatatgtaaagaaacacttaaacaagcattaatgtgtaaagggagtcaatgaaggcctaagtctaacctgatcaatccatggaaagaatccttccttcagctcatcagcatagcaacaaagcatgttacatgctgtagctttttcctctagaacactagtcttgattccaattcgtttgtctccaagagtaatagtctccatactgcaatggataaataaaacttaattatatctgtcctgcctaaaaaaaaaatgttttgatgcgtgcttctaattctccataagaatgaaatcgctattagtaaataagaatgtgttagggttttgtgtgtgcgcaattacacaagtggatgtcataatataaagataagtaaagcaataaatgcaccttaactcctaaggcttaaagtcactattagtgaacatacaagaccaaaatgacaagcgatgtgtgataaaagcgatacattatgcattcataatttggtaattgtttaaacttttacgtagaaaagggactaaagttgagacctttcatcatcagaatcctcaatctcattgtctgaatctgctgatgtaatggttacatcaggcttaagtgaagcagattgaagcagtggaggcatgacaaattccatgtaaggaagaaaatcttgtcccagacatttgcagagtctagcccatgcctgtaacaaattaaagttgttagactaaaacatagaccaattggcagtttatgcatatgttgtaaataatatataaaaagcatacctgtagcatgtaacttgttgttggatcatctgtctccatttgagatacttgaagggacataagaacttccataacctagtgaagaaccagcacacagaatattaaaatcataagacatagctaaccagagagagaaagaagtgcttaacagagatgcaggggcagttaacttcctattttcctgttctagaccgactatttttccaaatgatgataaagtggtataaaaggtgaacatataaacaaaaccatacataatacattcttgtttggcaaagtaaaaaaataaacaagaaacacctacctgcttcgcatcagccctaaacttctccttcccaacagccattccaactaaacttatacactccatggacttagcacgaagcatacggttagatttgtcggttgcattaaccaatatagccttcaggtatggcattacagcatcataatatttttggaagtgttcctaagaaagaccataataattaaatgagtgatcaaaagaaaataaattataaatgttgattgaacaaagaagttaacaaaatacctgagaagaatcagcaactgatgccaaagcagttaaggcaccttcttgcaccatctgcttaccattctgaaaaatgtatagaaaatccaaaattaattgaaggaagaattacgataatttagcaaaatgaccatcataacattattcttgagattaattctcaataaatatacctgaagaagtacaagtagtttgctaactatcccatccaagtatggcgttaagatatcaggtgtgcagttctcgctgaagttgagaactgctgaagcagcatgtgcctgtgtagacaatattttgagaataattacaccagatagcttatttaattaaaatagcatgacttcaattataaatcataatgactatataagaataaaagaataaatgaaacacacttcataaaattgaagtatatcacaatgcttcacatttgtataataaagtaacattgcagttactgtttgcattgtattttaaataattggcatctttaatgagatgcaaagttcattaaaagaatcacaagactttcaatgcatgttcaagaataaagaatatcacttcaataaaggggcagctaacctgcacacgagggttctgaaaatcatccatggcaccagctagtgctggcaacactccttgatgatatttaacttgcaaatcaggacccaaatcagtagacagctgcccaattgcattaatagctgcccatcttacacgggggtgttggtcagggaaggagttcaggaccatagccaccacttgctccaaattctttatcatgacctgcagcaattaaaagttggtagaaagtcaaaatcacaagtggtacacacaagttattgcccaacaagaaacaaccaatcacaatcatatcaactataactaacacaaatattctaactgccatttacttgtataaaagcaaaaatccacaagaatagttgacatctccgatcaatataatacctttgaacagccctcagcaatctgagcaagtgcaataagtgcagcatgccgtttctgccattctggagcagccaagtaagcaggcaactgttcggacgcaacaggaacaatggtgtttccacccaaagatatagagagcctatccaagcactcttgtcccacgctataattactggtttcaccagcatcctcatcctcagtctcagcactgtgccacgcaggatcatcctcaatatcaagaagcatcttcatgagtatcgcaaacaacctactaataaactgcggcaacttcctcatcatcccgggggcacgctccctcgcctccgcgagagtaatcacaaactcaatcgccaaatgccgagtcccttcctcaagggattcagcctcggcaatctgcaacatggcgccaacgacatccacaagctggcgccggagaaaacgcggctcagtcccggcgagctcgatgagaagctcaagcgcctcctgggcggtggcctcctggccggaattaagcgcctcggtcaacgtccgcatcattgcgggcagcaggtcctggaaccggtcgcgatcggcggaaccggacaaacactggatgaaattgataacggcgttaagcgcggcaattcggacgtcagggttaacggaagcgttcgtgaggcactgcaagaaaatatcgtggaggtgcttgatgtgaggagtgagggaatcgccgatgtactgcgacaactgcgcgaagattaaaaacgcggattcctgaagcttaggggaatcagaggaaacacactggaacatgaaaggaagaagctccggccaggcgttgtcgggtaaaataccggaggcgagttcggagatggtgtcgcagagcttcttggagatggatttgatgttttccgtttgaatcgaggagagaaggagcgatttgagagaagactgcgtgtgaggggagaggcgcggccagaggtaggagtcgtcgcgcgtgagctgtttacggaggaggatggcggacatggcacgcgcctcctggtgcggcgaggagtggaggaggtgtgccagcttcaaggagaggttatcgggttcggtttgcttgcataggttaaacagcgcctccgcgtgggagcgttgctcgttggaggaggacatgaggtgcgagatcaacgtctcaaagggggagggatcggcgccgaggatggcggcgacctgcgattgctgcacctcagaatccatggcggccacgataaagaagaagaagatgagagagcaatgacgagtgagcacgcgcgggttagggtttttgatttatgattatgtgattagagagactagactcgcgtcgccactcttctctctcggggtgtgtgtgtcgttttatatatactgttgcgggtgttggagcgagcgagggagtgttgtgttgtgtgagttgtggtttattgtcataatatataagtgggaaaagggttaggttaccgtgctcagcgagtgggactaattagggcaaccacatgatttttattagctgtgttttgttttttaggtcacggttcatcattagcctacgctttccttacttctttttccccccttgtggcttaattaaattaaatttatgtatgtgaaaatttttgggactctttggggatcaatttaaaatgcgtgtatgattgtttctttttagttaattaattaatggaactatttagaagattaatgtagattttaagttttttctttttattttaaattttgtgtacgaaattcttttttgaagaataaaatggtgagaaatataaaaatacgtaccagtaaaactatctagcatgtgacaaaaaaaataaaatcatccagcatacaaatatcttatctagttctatcggatatgctatataagacccagtcagtaccnnnnnnnnnnnnnnnnnnnnnnnnnnnnnnnnnnnnnnnnnnnnnnnnnnnnnnnnnnnnnnnnnnaaagtttttttttttttttgtgtgtgtttttgagtttgttcctaccctgtattcacactattattttaaatgaaatgatataagcattttaatgtgagaaataagatttttaaaatatatatatagaactaatttatatttttataaattttaaaattaatttaatatttttttgaaattaatttactaatttattacaacagcaacggcaacaaaccttattgaatgagtttataggaatttttaaattttatttcaataaatgtgatataaaaaaattcaataagaaaaattaaggttagaacttagaagttgtctatccaaaacatcaaaatgagtaatctgacttttcagcggatcaagcttaggtttatagggattaatcttatcgtatcatatatccttaattaattcccaaagataagatataatcatatgtgacaagaaagcattactagataagggaataaatatggattataaaaataaaaaatacaacgatttttaaatttaatcaaaatttatattatttttaagattctaattattttataaagccgaaacaaatgcataaaaatttaaaagaataagtgattattttataaaaatatgacactaacaatataaaaagttttaataaactgtagtacttactcacgaggttttatgaaattatacgatttttttttgttttttattcctacactatattcttaattgattgaaaaatatagatgtatattattagtatatattatttactctaatttatatattaaaaatatttatttacttattatgaactctaatgataatataatttatatcttaaaagtatttatttatgtaacatataaaataaaattctgttttttttttaaaggaaaggggtcggaacccactctcaccctcaccccacttccgccagcctcttcaaagtctaaaaagtaatgcatctaaaactgtggaaaaagacggtgtttttgtaaatactatgattactcaaggtaaataattttttaatattaacaacgtatattttttccttaattcatgtttgaagagaaattaccgttaaataacaaacacgaagtcgaatctatacaaacaagcacgagagttacagtccaatacatgctactgcttgcaaccttttcatcggcataatttgttccaagagatggttaatcacaataattgttgtctttaataattgaggctttgggtcacaaggacttttccccctcgtcttttatcttttccctttatttcgggtcgtagggtctttcttttctatttttttaacactgtcttttcaaactaagctacgtgcatacatacgaaatttcagaataatttgagttatttaaaaaaaattaacaaaaaaaaaagtgctaagatgaaaataaaggcggtaaagtttgatacaaggaagtaaagttacaagtgattgacccgtaacataaaatttcatcttttccgtttcaagaaaaaaaatccatgatttttatttttattttaaagtactattttattcggattcatatatcgacgtgttaaatgatatgacattaatatatatatatatgttagtcattttcatcaaccttaatacaaaaaatacggacactactcatttagcagttgaatgattaggtttataagttattgatatatgtttaaattctaatgataatattattacgagttatctacaagttattatgttgttaggtaatagtttatcaagtggctacgaattatctataagtgattgtattgttaggtaattgcttatcaagtgacaattaactatctatagagttgttatgttgttataacaatcccgacaattaagggtattaagctcccgtttgacactataaataatcaagttctaccttcacttttcatttattttcaactcattcacttacttacttgaatgtcgaaatctttttcgcaggtactccactcacgttcctctggtggaggacacatgcaaattcgacataggagatcatggagcccaatttgacgaaaatcaactctaacgtcaatttgctatagattttggtaagtacatttgttgcccaacatggggtcgcagtaaaacttcccctgcaaccacccacattcatggttagcacacgcttcgaccttcggtaagagccactcctagaaaattccaatcctcctccaacgacaacgacagacaatgatgctctccatcaacttcaagcctgcatcgcaaagatggaacgtcgccatgaggaggaactcataaaattgaaggtcgaccatgacaagttggaggctcgtgtgagatgccctcaaaaggacaaacactcctcccacacggtcaatgagcgcacccagggcgaatcgcatcctcatgagaccaacaataccctggatgacaacaacaggtgtccttggtcgaatctccaaacgctcgtcaaaccccaaggtccacccttgatgagtctcgtcaaacctaggacgaacgcgtccctagtcaaatctcccaaggcttgtcaaaatcaaggttcgtccttggtgggtcttgtcacaccaaggacgaacgcgtccttaatcgaatctctaaaggctcatcaaactcaaggtccgcccttggtgaatcttgccacacacaggacgaacacatccctaatcgaatctcaaaggctagacaaactcaaggtccacccttaatgagcctctttgctactaagtttcatgtttcacatgcacccaagacacactcttggtaaacttattcccttgaaaccataacaggcatagtcaaagttcagattaaacacttgttagtgtaactcaagtaagtccccacggccttgggtaagaagctttgtaaagtgaaaaggaagcgtcatcgggttgaacctaacccaagatgattggacaagaccttcaaccagattgaaatcaaacccgagatgatcagatgtcatctcattctctattccatacagacatgccatgtaagaaaaatcgcacctagcgcaaaggaccactctcattattctacgacaagtattaaaggctaaacattaagggaaacacaacctagacattggcctcatcgtcttcctcgccatcaacaatctcttcctcgtcgagaagttgacagacctttacatctttaaacgggtcaaaaagacataggtcaagaccctcagtgaagaacctggcctgcctgatggccttgaagaatccctttttgtgctgctccacaacctccttttcgaacatgagaagtttctcctctagctccttattcgcctatttctcctttgtcgcctcaagctcagactccttcaacctagtttgtaggctggatacagtgagcttcgactcttttagttaggcttagagatcagcaatcaccttgacagattcatctactgtcgtgtgaagtttctccttctcttaaacggagcgctccaccttgctcgtcaagtcattcttttccaataactctttatgacattcgaacacctcgtcaccatccagtcttatgctcaccagcttagcaaagacatcgttgaccctggatgacaactggtagttagacctaacggcttcagcaagggcgacagtagcattggccactatgagtcgttccactcgctactcagttcgagcattgactctccatttggtgaccttagcctccaaggaagaaatcctactcagggcctacttgtgcctttgctccttttcctccaatatagccaggctcctttgaagaaaaacctttgcaacattgattgagtttgcaccccaactaatcgaataagattttgatcaaaaggagaaacaaagtcaacaactatcctttgctcaagtctaaagcccatactccaaagagaattcgcatgtcgagaactatacacatgatccaatgaagcgtttatcttcaaagcgctttctaacggttagaattgtcaaaaacaggagcttctctcataagaacaccagattctacctgaagggacgaaaaacacactcaccttagacaatctatcaattttaacccggacactgtttgtccaagctggggggcttaacaaaccctcaacccctaaatttgtcgaggttaccaccattgacattgaacaacctatttcgccaacaagtttgacttagagctcgggggcttttgtattgtccgtgtccacaaattgacgtgacaagtgcatgacattaaaatatacatgccaacacccttcgtcagccctagtacaggagcaccgacactacttgcttaggagtcaggtgattgagttgataaactattgatataagtttgaattctaatgttaatgttattatcttttttttttatgaattatctataagctgttatgctcttaggtaaccgcttatcaaatgactatgaattatctataagttgttgtgttgttaggtaatcacttatcaattggctatgaattatctatagagttatgttgttataacaaccccaacaatcaagggcttaaggctccatccgacactataaataatccaattctaccttcattttatccattctcagctcactcaatacttacttgagcgtcaaaatcccttgtactcccctctcattcctctggtaaagggcatctacaaatccaacctaagaaatcatggagttcaacttgacgatagtcaaccctaacatcaatctgctccaaattttgataagcacatatacaaaaaataattctttaaacaattttttttatacaaaaacattatttttcacttatttcttttaaaataaataaataacattattttatttatatattttttttctatttctcatctatcgcatttctcttttctaaacaaaagaagccccttacatgttaaaactaaataattgttgacttcttacttgtttcactcgtttggcgtccacatctttacttgtttcactccattttttaatccttgctttcttttttctctatcgtgagtggttttcatcgacatgcacattccttctctttgattctcatttcttctccttcttcccaactcttatgcccccaggaaacttattttgtaagcatgggagtgatcgggaatattcgccaactccctaaaaacttgcttcaatattgttgacttctgtgcatattgatcaaaagctactgcatgatactggcagtttaaaggtctgttatatattgttttgttttgaatttcatgatgtacgtatgattgatataacttttttttttggaaactacgtgtttcattcatttttgtcactcggtattttgtttgcaattgtatgaaaataattagagatctaagagcatatacaagaaaaatgccgttcttcaagtttaaggtcaatgcgtagtttaatagtattacacttattttcagacatgtctatttatctacacatatgtctatcatattaagcgataacatggttaatattcttgcaggcatgcatctaattaaaccatcttgggtacgactgaaatcattttctaaccaccaaaggatgaagggatttttcatttactaatcacaacttattaaattatgtttttcagtatcaaagggtaaaaaagagtcgagccaagcaactaataaagtgaaggagttagagtttttaaggagttggaactttctttaacatttgtgtaagatttgcccgtggattctgaggcaagatatattttttttaatctccatatcatcttaatacgtttttaaatttttttaaatcgataagcagcaataaaccattttttaggacgattttaacaggattgatatttattagttaaaattactcattttttaattttaattttttttaaatatttgttaattttaaaattgattttgattgtaaaactgtgcaggtcgcctcataattctttatttactttttttaacaaagacaaattttttggtggtttagactgaaaattcaatggactttatttcacacggttacaatttcttggtggcttgttcttctatgatatagatagggatgacaatatgggttgggctcgacgggccagcccgtttagccagccaaaaaaggtgaatcggattgaaaatttcagcccattttggaaaatggggcgagccaacccggcccacaaaaaggtgggccaaaggcgggccaactcgacccgcaaaaaatgggctagaggcgggccagcccattttacacttttttgcttttttttggcttttttcttttaaaaaattttttaaaatttttttttggtgggctggcgggctggcctattagtccgccaagccaccttaaaatgggtcgggctaggattttcagcccactttctaaaagtaggccagtccaacccatttttggcgggccagcccatattgccatccatagatatagatcatattttgtactgaaaaatattggttttctcaatgagtggtatttctccctttgctctatatgttagtaaagtatcatttttgtgtagatatatgttttgtttgtaatgactaatatagactgtatgtttaactataggtcatgagcaagattgatgcatggaattttgcttaccttcttcggtgacccattgatcctgtgaactataattagcattggaaaaaggaagctaaaaacgagatagagaaaggaaaaaatgcaactaccacaggttgtaatttttctataaatttttgtataaattcaatatcaataatccatacggggtgtgccgaatcaacgtccaagtccgttttcttagttaagcaccttggaagaaatgaatgtttcgccaccttcgttttagaggaacagcgccccatgtgcttctgactgaactaattccttctttttgtcgggggttttcgcagaattgggttcgactcccatagtcccgcggcattccccctgcggatcgggtgctccgggactcagagcgtctttgactcttggtttttgggctttgccctctctccaaataaaaaatcagtcacttataaactgaattctaagttctaaatataattatatagtgaaaaaggagcagaagatccaatctaaaccagaatgagctttagctctgaatctcaatcttctggagatgtctattttagtacgataaaacttaatttgtatattcattttcatgcgtatagaacttgtatatgtattctttgaatttaattatatggtactatatcaatatttacttgctctcccttagtctccttggaagttgaatatatattagtattacattacattgatactttacataanttttttttttttttttttatggagaaaaaagaatatattgcaagtgcccaatagtgtaattcgtaagtgatgctaagagaaaaccaaaatacccctttaataacaaactgtttataatcgaaaaccaaaaattggcaattaccttgaccttagtttccaaactttagaaaacacaaatttttatccctcctaaaattttcatggcaaggaaaaaaaaagtcactgtgtttcttttttagatttcaggaccaaattaataaaagttgaagtttcagaagtaaaacatattttatccttttaaaatcagatactaattaaaaataaaatatctaataaaataaagaatttattttaataaaagcaattattttaacaaacatttgaataaaatcagatactaagtttcaggggagtttgtttaaacgtattctaaaaaaacaattatttaataaaataaagaatttattttaataaaatgaaatagtgtgtttgtggatggatttgtttaaatttaaaaatatctagaagtggctggttgaaccagctagttacgaagcagcaaatatatatagacacacttaggttcatcactcattgaccgtgccgacgttgaaaccgcgattgaaccgcttccggttctcggagaacgggagagtagctgcctagctgctagctgcacgaatcgattagtgattgtgaagatgcggagagacaacggtgatagctaagataggtatttaattaccattgcatattcaactcttataattttcttcttcgttcataatgaattattctcctacgttcgcagcagaggacatgcttaataggttaagcagacgctgcttttgcaccgttgctccacgcccttggctttttgtggggttgggcaaccctggcgacaagttcaaaggaaccaggcacaatgtacttttccttttacttctgcttctgcttctatttgcagtttgtttcaagtttttgttatcaacatcaaattgcatagaaagtgttctgtagtgtaaagggggtatagttagttttgaattagcagttttgtggtgaaatatgaaaatatgttttttttttttttggtctgaattaggttggctttgagatgattgatgcatttgctgagtcacaggggattcctatggacactgtccattccaaagccatttctggaaaaggtttatctgctgttctctgtttctcttttgatgtttcttgtaattcatgaattttattaggcaaggtggtggtttgttacaggttttgttggtgaagttcctgtttttcttgcaaagcctcaaacttacatgaatctcagtggtgaatcggtaaggaattaagatgtgctgccttttgttttttctctcaaccatctagatattttgctttagtttctacaagttgtttcatctagatacgttttggtcattttgaagaattgtagttgccttagtgtgttttggggttattttagtattagattatcccttttgttgcaggtgtttttgtgcatggaatttcctgggagagtcttggggcagttgtgatggttaagttttctgtgttttctccgtagttttttgtggtttcttataggggattttactttgtgttccttcatctctgtgaattgacttatgtttttttttttggaaaatcttttcatacatgatagagtaaggttatagtcattgtggaaaggagtatcattcagattagagaataatgaagggaataagaaaatgctgggaagtagggaaacatagcttcttacaaatctcctgtggattaataattctttggtcagatagaggtccttattgaatgctattaatccccttcccctttttcatacaaaaccaaggagaagaggattgaaagatggccatcatgaccatggctgattggttcatctttcatttctgcttttactggttttatactaatatggattccatggcaggtttctgtgtttgtggtagcacgcaaatggtttcatttacttgtttgttgatgtttagcttacatataaagcctcaggcttattatcaatatatgttttactgcagacaggaccaatggctgcttattataagctacctcttaatcaggtgcttgtggtgagttattccatatcgtaccttttcttttaagtatctaatcagtgataggtgtgcgctgtttctttatttaatcatgtattttttgttgcagttccatgatgacatgaacttgccttgtggggtgcttcgtcttcatgacaaagggggtcatggaagccacaaagggtacaacattaaatgataattgtgaagcaaaattactattatttccatccttaagtttttttttactctgatcataagaaacttgttgctaattcaagtgcctactcctctaaactctataaagatttatggtgtttattacgcataattagattgtgtaattcactaattccagaacccaataagtatctgtcttgaacttaacatgtagatgttattggagtcctattccaataaccaacattttggaagtttattctaccttttgttataataagaagatgaggacagactaagaagatgtaataagccaaattagttaacattgtgagagtcctgattaggttgtatattggtttgtggtttgagggaaaaaattccattacttataaacgtttccccctcaatcatacattgattggaactagatatagattggaaaaaaataaaagaactgatatatattgaaggatccccttacaaccaacagagtaatcttctgttacagtatattagcagaaagcaagaaactacaggaaacaaatgacaatgaatggagcaagctccttacaatatggcaaataggaattaggataaaaaagaaatggtaacacccagtgactgataaatgataagttcctctgctcagactaacaaaccccaacataacccttcggaaattctctcattccttctatttggttgcaccttcctttaaataatcattctctctctacttgcctgattctctgcttcctgcattccctcctccattctcaatgccacctgtttattctgttattccccctctctccttccaatccctcgtgtcacatttttcattttttccttctctcatatatacccacaggccttgattttcgggcccactttccttttccttcaccttcttagttcttatatacaccagcctcctgtaagttttatgcccgtgcctaattcttaaaagcttgttccagtccatctggaattaaaaaacagtttttcctgacatttattgttgctatccaattgcttattgaaactatgggaaatgccttctttgcccatttaaagtaggtttaattatcaatttggtccccaaatttttaaaaggttcaatttggttctcaagtttttaaaaattaatcaatttggtctccaaattattttaaatggttcaatttgatcctcaagatcttaaaaatttgagaaccaaattgattcatttttaagaatttgaggaccaaattgattcatttttaagaatttgaggaccaaattgattcatttttaagaacttgaggactaaattaaatcttttaaaaatttagggaccaacttgattcattttttattgaagaccatattgaaccttttagaaatttgaggaccaaattgataattaagcctttaaagtattgaaaaaactaatgattgcaatattatagattatttcaattctattatggacccgtgcggagttatccatgactccaattgtggttgtttggaatttaaatggttagaaaaaatgcataccagcgagagtttatatcaagaaccctgttactcaaagaaatgctctcaatagttgatggttatctttcagtaaatgaacatctattagtactttgtatggaaacttaatcatatagtcattcttcatagtttttctttatctattcatggtggatatatagcttcacaattattcactacattttcacttttcaaggggccatatattgtcatatctgtgatgcttcactgttttaggtaaaaaggaaagtaatttttatgaagtggctgaaaaagccttgtttaatttagaaataagaatacacaaattgaaagaattactttcaattcaaatgaagaaaaaagttgtttcgaaagcatatcaattgctaagattcgaagaaaaaattattactttatatgaatacactaaggatcactatgagcgtgtttataattcaataatattttttataagtggtgatagtctgatggaaaatgagttcatgaaatctttttagctctgatattttcttgttaagtgcttctcgaataccactactcatcttgtacatggtcctcacttctcactgaaccaggctgaagagtgtgatctatcacttcagaggaaatagagaatttcctaggctgagaattggttggtacttatgttgcaaatcctttattctttccctagtttagattattgatgtaatccttattttcaatttgctttgtcattagggattgggagtcctcctgggcaaatggatcctaaagcatttttgcttcaaaagtttaatgtaacagctaggcaacgagtaagttcttcatttactgttaaattcacttttggagttttggttcctcgtgtaatgaaagtttcaatttggttccaatggttcaaattgcagttcaaatataatgggaaaaatgagtggcattgtggtgatgtggtgccaagaggggatggtgtgtggcttcgctatggggtgtgaaaaaatgtcaaatatgattgcagttacttgtctcgttagtgcaatgtcataaatatatgctaatagtcccatttgagaatgaatatactgaactagaaaattcaagggcaaggtttttgcaatggagccatagttattaataccatgagatatgtgtagaggcaataagcaccaccatgaagaggcacactaccccacttctatattatagcaaatatttttacattgggctacatgcactatattgaaaactggccaagtcaataaaaaaatctttatctcagtgatgcttcttgttttttcttgttggacagattgatgaggctttgcaagagggggttgatgtcttgaagctccttttatctaaaggtttggcagtgagtgcaaaaagattcaacaaagaacaaaagtataagcacttaagagtgcagaatttaccagtttgataggattccgtgatggaaagttgcattataagtctgattagttcttcgctttataggttgcaatacgtgtaaaacttaagcgataggaaattggcttaattttgtaacattccagagatagatataacttttaaaatggtttatgaccaacttttttccatcttgatttgttttaatttggatactgtgtctgtaatgtgcattttgcaccgagtgcacaagggtgggataactgatcacgcattaaagtattggtaaattgtgtatagtgtataaacttggtgaaaggggcatctttcaaagtagcatgtaccttttcccgccgagggaaattgttattgataatcgtaatcggagatgcgttatatggtatgaatcatagagtagatagggaaatgtgatatgcagttaaatggggataattcctcaaaatttaatccaagatattcgacttgggtgtaactagaaaatgaagatcagggacttaaattatactttatttcactagctatgtatgtgtcttgatatggatgttagttaggcggtacaaatacctggataaggacaggaaaataaagtatttagaggattgatcatctatcagcattatacttgagttttaaagccatgggccggtgttaaataatttggttggtaaaccatcactcatgctacttgatttattagttgtctttaactaatttcttgtgattctttttatcttgacttttggaagccatttcaggcctgaacattttgtcttgagctaagtttgatttttagtttgattttttatatatttgatttgatgcttgccgtagctaattcaaatttaaaataataaactatacggctaaagattatatgaatttattatcatatgaaataacaataaatatatttaatcacagttaatttttaacaaactgaatattcactaaaattgaactttgcgtccctaaaattcgatccaatcggtttcataagctccatgttttgtttatcacgctgcataacgttatgggccgaataagatattaaaggatttacagtagccagctgttctaagatccaaccatcatgctggaaaattcagaaattcaacaatgtgacgagtagaaaatttccatgtgctccacgtcctaaaggtaccttataaaaaaaataattgacagatttgattttccgtagtaccatatgttttaggattcctcatatttattgtagttatgtttaggattcctcagcagtaatggttcatttatgatgaaatactatagccacaggcaaaataaatgagtacccaccatcattttaaaaaaataaacagatggcataacatgttttatgagatacaacgtgcagatcctttagccattttgtactttttctttggttcttttcaaaagaaaattttatgttgtttgatttattttatatcttcattttcaacattgttactagtaactataaaaatgccatcttatttttattgtgtatattttcaaatattttattttcatcattttccccacaaaatcataaagttaatgtgatttttttataactatcaatgaaaacatatatagcaacagaaaatgaagacaacaaataaatcaaacactacttcgaacttgtttcatttaaggaaatattttttccattctctaataaatattaaaaatatcactattttatttaaaaaaataaaaaaaatggtgaaatcaacactaaaaagtaagaacaatcaaaccaaacaccaatattttgagtaaaaatgatcacatggaatccattatggggtgatgagaatacgaaaaatattagttttgattgaaacaactaactcgcgtcattgtattgtcaagctgtgtatgttgatccagcccatgcagtcatgaaagcctaattaatgcctagtgttgtccgatagcaaattggggacggtacagatggtaggtggtttcttttgtgcatgaatcatatatatacatatatgccagcttgttcatttggtgtggtttatttatagttgaccctatctcgtgacttgtgagttttttagcctttaggctctagcgcaaatcacttcctaaatcctagctccttgtgattttctaacaaccttttcgagaaaattacaatttataattgttaaacaattaactcgttttgggatctaggattaaagtaatgttatagtttggtcaaagctttatagctctttggtggcattgggcttggttacaaatagctcattacattactacaagcaaatgctataaaggatcacatgctgcctgcaatattaatctagtgaggaaattatctgttgatcacctacgaccatttatttaacatttgatttgttatacattcatagtttaattataaacatgaattaatgttgaattattctgaatagcattttttttctttcactttaatttggagagcatcacaaacacggttatatatgtaactcgggattttggaccattcgttaattagagttacaaatatcattggacaattattgacgaacatataattggctcaatgtttatttaattcaaccactgacatagtgacatgtttctgcttgctttagctgtaggtgtttgcaaaatcatataacctgctccttgatttgctatttcgcctccacgcatgacttacacgatcaacaagcatgcatggcgtgctacattattaatttcatgtcttatttttttcgttgatcgtgtccttttatgacgttaaatctaatctaatctaattattaaattttaagtacttacatagataatttgattaagcaataattcttatgctcttaatttccttttatgtcacatacatatgttctgttcctctcccacacacagaaattccatacatggaattaattgcatagcactgttgcaacttgaaatttgccaaatagcaagcagcatcacatgttgatttctacttctacatgtcaatcatcgaaagcaccttattatacaaggtcacacacactaaggcacgcgctatgtgaaaatacttgatcattaagtaacttgtaattatttaactagtggttgaccttaaatttttgcactaaacacttgtcaactccactctcaaacaaatgggagaaaaatacaaagaagtttatgtataaacgtgtatatatatctcactatatatgccagtatcataatcagtgatctagatccttatttctagctgtgacacacagatcagaccaaacacaagtcaaacatgaaacatggacacacatttcaagcaacttcgtggctgcttcctcactttcatttaaaatttggttcaatttttttgtgaaagtggcaaatcgcataaaagaccaagtcaccgacttgtctcacaaggatcatggacctactatatatacacagatacggtttggtgacaggcagaaagaacttgaaaaaaacgagagaaaatggaagaattggaattccttgattgatcgaatcaagtttttttgtttagatatttcgttgaaactataaaataagttacaatgtattataagaaaaatgactaaaaagtttacagaaaatacatgtgtgcgcgcgtgtaagtttttagaacatgaattgcattttttatttcgcattggagatccaagtttaaaattgattttatatataatatgtttggaattatggtgaagacgtggtttttcacgtcaatttgatacgtgtatccatatacacataatttttttatatattttgatttcacgtgaaaaataatttaaaattgattttaaatttaaacaattttaagtaagtttttacattcgatgaaaaattttatattgagttctattatcttaatttgtttttataataaaaatatacaaacataaatcatactgttacaaaattaattttgttggcacaaaagcttaattccaaaatcacgtacattagtatttgagacgaagatatcaatgttgtgtatatagttgatatatctattttctaaatatatgattagaaatttgatcatcaaatttgttgtgtataaagaatatatgtactgaaagattaacctcttaaataagtttaatacattaagaaattagtctaccacttttcattagaaaaatatcttatgttaaaaaaatattgggatggataagcataatttataattattattttgaattttggtaagttacttttctgattatttgacgggttcaagatatatactatgttaggttgtcaggttggtcaatattaatgctcaaaagtgttaacaaagaccagacaaaaaaacgaattatttggtaaaaaaaataaaggacgacgtggacctagaaagaaagagagattacagtgaggttgctacttttgaatttgcatactttttgttcaactgtgttgacaattgaccctaaaattcttgcttgacaagtatacactatagggggcaggggcatgcatcagttttgaaaatttgcttcggcaataacaagtggcacgaaaatgagagttgaaaaatggtgccaacaatttagcagcaagaggatctggtgggtcatttactcatttctattgtctctactagttgtaattaaagtactaaagtatattcataaaagtggttgatggaacccaaaactaatgtatactttattgaaccatataaaaaaaactaaagttaattgagcaaattctatagtcactttgtgtgtacatgactattaaactgctgttaggttaaataacaaatattcatttacagacaactaaattagtaggaaaccgttgtaccttcaactatgtaaactgtacagttataactttatacatgtaacgtaggttttagttgacaattatcatttgtttaaaacaaacgtcggacccaattaagagtaaaagagatatataggttgattgtttaagccttttttttaaaaaaaaattaaaaacacagaatatcaaagttattttaattaattttaatcttaatcatttgtgtgaattatattcttgaatttgctctttttgtatgctgcatttatcatgtgatacattttctatatatacatgtgtgttgattgttaagatcaaattacttcaaatgtaatttttcnnnnnnnnnnnnnnnnnnnnnnnnnnnnnnnnnnnnnnnnnnnnnnnnnnnnnnnnnnnnnnnntatatatatatatatatatatatatatatatatatatatcatttttatgcatgtaaaagcactttgaattgacagcgaaatactaaacaaacacgattggttgaaaacaatttgagattctttgtggaaggtggttgagaattgagagtggaattaattaaaactgtctttactgatccagcttcaacaggacagacacgtctttaacttttgatcttttatccctcccaacatttaagnattatatatatatatatatatatatatatatatatatatatataaaataatggccaagataaaagaaggaaatgtgtgaataaaaatatttcaactgttgacatgtgtttagctagttaaaactttgttttaatatataagaaaaaaagtatgatttggtatttttaaatgaataaattcttaaaaattatttttctattaaattaggtaacttcttttatattaaggatactattcatttttttcaaatgttgttattggagtttaattgaaatataatttaaatatgtattgaattttaagttttaaatctcgactctctatattaaattcataaagataatgattatgcacccatacattatttcgatcaaattaaaatatgtattgaacttttaagttttaaatctcgactctttattttatcataatttagtgttgatatatatatttttattttttagtttccttcaaatttataaaaacatatgtactaatacagaaaatagttaggtatgcattttcgttaatatcactccataaattacttcgcctatgaagtaccgttttttaaaaattaagcactagacatataattaaaatacatttatgagcatagttatctctagatcatagttatgaatgaaaatgcatttgtgatctaattaattttgatataggtttgttgataaaatctatctgaatatataattaattgaattcacaatacataaattggttcaccttttataatcagctacttgtataaacaaattatgattggttatttaaaattgtccaaaaactcaatactagtgaatattaatatctacctctaaatttatatttaactctggattttactcacacggttatatatcgccaactggcaacaaagatataacgtgcgcgtatattggagtatatcgattaattaataaaagttttattattccctttacctgccgccattgttactattttttcttcgcattgtattcaacattaatattttgtcgtagattacatcaaacctcgaagcatcggagtgacgttttgcttctctgaccacatcaactgagaaacgaataaataaaaggtgtcacacatttcaaggcaaaaactcgtgtaccctacgtcttttttttatgatttttttaattactttacatatttcttttacaaaaatttagttaatttagtcaaagatattaaattaatgaatctgtcaataacttataattttattttaaaattattcttacttttttttatcaattatctctctcttttctcaactaatcattatttttatttttatcggtaggattcaagaaaatataaggttaataataatacgttagatttttttaatctaatggttacttttttcccaaaataagtactgtcttgtgttatttaatatatatcaagaaaaattaataaactataaataaataaaagagtaataattttataaaactagtcttaaggaattgaaataaaatatttattatgtaaatcacaaaagagtgtaaaaaaatcatagattttaccctacttcaatgacaattgtttaccattctatttggttctactcatccgtatctaattccaattgtttaacgctacaaacaaccctatcaagtcattggtacacgataaatttaatatgtttttttaaggcgataagtttactgtgctaatatatagtctagtttcataacttagttaataattagcaagacgttttagttatttatttctgttatgagtcgttgaaatggttggggaagaaattcaatgtaaggagtcctattaattactagagaaaactaagatatatgttttgattatactttcgttcgtatgaacttaagataaatataaaaagaaatttacagtaaattacatattttatttaataaattgaattagacttttttaattatatatttcttttgtcactaattataaaattcattttataaaataatttttaaatttttagatacaacaattatttttctctatatatcttcacttaattattctttcttaaatattaataaaaaataattaagtggatagaaaaataaataataataaaattaattgacatatttaaaataatattttttatgagacgtgaattacattagacataataattccgaagacaaaaatagaggtatggtttgggcggcggtagaagataaagataacgtagaatggaatcagaagcaaatccaaccaacgtcaaacaaatgaattaatgactgggggttgctagtgtttgacttttgggttatttatttatggtgtttggaagccacaaaacttttcgtacggtcaaaacactcgaaacacgtacaaaaaaaagaaaaaaactcacctacaaacgtttgagtcggtgttacgcgttggggtcttattttattcttctttcttttcttttcagtttcatttcagagtttacattggggaccaacaaaagttgataaatagcacattcattccaaaacaaaatatgagtttaatttttattgttaatataagaattttcgttactgataatttataagtatttttataaatatttaaactatgagtttagttcctattattaatataagaatttcgtactcataatttataaatatttttataaatgtttaatgaccttattgagacttactataaccataatgaatcctttatatccaagggagggaaacttattttttttttttaaaaaaaaaagagttcacattagtggcatggctagtagtgaccggtgaatcagtagaaaagtagtgagcaaaacataagaaaaatcgatgacactttataggccagctggcattatttaattgagaaacatgcactacagctacgttctcgtttggtggccgattctttatgtgcttttattcctcatcttaaaatcccatcctctatacgacgtcaccgttatatgtgttctcattccttacctcacattcctatatgctatagtttctattcttaattttatgtgcgacaactacttatatgtaactagtatattgatcagtattacgtatttactcctgatttattcattaagaaaaataggtggtacgcatgtatgatttatcaatctatttcatgtcttttgtaagatgagaataaaaaacaatcaataatgagcagtttttcgaataaattataattatatgtaaaaaatgaattggtggaaattttatcttttatatattaaaatggatatttgatatatttatatataagtttaattatatatggaaataattcaataagtaatatataattaaactaatataaataattcaatggtgataattttttaaaaattatttattattattaatttaaaattatatatgaaattatatatcaaaattttcatttttaattatctatatttatatcattattaattaatgatgatgatttgaaaatatatatatatatagacaccttttattaccatggatattttattttatattagtttgaatttaattaaaatataatttaaattcaatatgaatttaaagttttttttatacaataacagaaatgaaaatcaaacttaagttttcatgcatttacccaactcctcacaactaatttttttttcaatttcatccatatgatatgataaccatgcatgtatgtgtcctaatcggctactacttagacacttaacatgcatgctaatttagttttttattttctttttttaaagacgcgaagctgaccccattaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataattaattatcaaatataatgaaatgattgatttttataataattatatatatatgataattttaaattagttaatggtgtaaaaaaattatactgaaaatgtataaaattaaaattttatatttaaataataatatttaaaacaaacatttttctttcatttcttaaactaacattttaaaaaataattttttattttcaggttacatataagactctaaacaaaacatacattgtgttttttatacacaacatacattgtgtttagattggcgtttggttgttttactcttaccatgattttcaatcatacttgaaaatacatgaaagaaaattttagggtgaacgaaaaaaaaaatgataaactaggataagtaaaaaataatgtgaagataaagatatttgatttaagaaaaaaataaaaacagatgcatgtaaataaatgaacaaaacaggttaaaaataacaagtttcagatttttaaatttatatctttgtcatctcttctctcataaacacatttatctttttatttctgacttatttttttcactgtttttcccccaccgaacaaaacataagatattacacctgattttcaaacacgcacgtagtaacgtagtaacatacaatacaatgtacgtaaagcaaattttcttattacatcaaagcaaaacatacgatacaatgtaaaagggacagcagaaactggcgacgagattttgtggtctgggggaacggtacggtgctaccaaatgatggtggcagcgcagcgtggcccactctgcattcgacacgtgcacatccatgtactcctcttgtacgcgatgcatggagatctgaaatatgacagttggaagtgacaatgctttgtccatctaatctaattatcatcatttcactacttttttttaagagaaaaaacgtatctatctattttataataattctgatttcattcaaatttattttattattttggtcaatttgaataaaaaattcatttctgcataaagtttattcttaaaatattcagcgttaccttttaagaacagacacaagtgcaaagaaattggcttactggcttagcttagttttccttagtttcggtttgacttacaggtgtattcagggtatatactttttctaaattatttaaatatattttttttatttctggtatatatttagattttacgttgatcttttaataaaaaaaatttccgcatctgcatcttgatatttttaaaaaattgttttaatctttattatcaattaagtaataatataccaattaaatatttgatagcataatttatgattttttaaaaaacattaatatttgttaaaaaattaaattatttttttgacggttaaaaaccgtcataatcaattaaagttagaaaatgaataaaacatacattgtgaatcctccttttctagctctcatcttccacttctgtcacccatcactcccttccccatacttctccccttcccaattcctcgacctcctttgcctcttcctcggtccagcccaactactagatccacccctccatcttcctgtgctcctccgccaactcgactgcactgactccttcgactcaatgcttaccttcctctgccaaatgcactcctccaaaatcctcatcgacgagtccaccgccctcatcttcctcaagacctatgccacctcccaccacctacacggcgaaatcgaccccctcttcctcatcatggagtgcgacatcgccatcaaacctgacacgcacttcaacaactttgccctcagcctctttgtcaaagccaacaagctcaggctcgtcaaaacgctccactctgacgctgtttcacacgacgtctccactttcaacatcttaattagggctttatgcaaggtcccttagcttcatcccgtgattcttatgcttgagcaaatgcccaactacaacaggggaaggcacgtgtgggaatttggcgttcgagatctgggacatgcgactgcaacgacgaaagtccacagtggtggtggagtgggggcccactgcagatcaacaccgacagagacaaagaggacacataagtggttgaaggcagcgacacaaaacataagtgattgaaggcagcgacacagagaaggaggtggtcgcggaaaaggaggggggagaagaccttccctttaaaaagttgagattttttttattattatttaaacaatatttgttttgaaacaaatactgatgatttttgagtcatcacaaatcgcgttatcaaatatttaatggacacgtaattacttaactgacaacataaatctaaaacaaaattttcaaatattgggaagcaaatacgaaatttttttttatcaaggattaaacacaaaattcaaatataaataagagaccccctccctccagtgatgcacgtggaagcatgtcaaatgtctatgaattttttagattttggtttggaagagaatgactgatcaatgagggaaatataaagtattcctatattggattaaaatcaatggtcttcatttgtaaagctaagctggttcagttcaattaggatttaggagtaattcattatactaactatctaattataatgttattaaatccttttattatggttcagacttcataacgtctagtatattttatcctaatatatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtagtaccattttttggttgtcgttacttgtaagcaaaacaatcaaggtaaatagcagtaaaaagaaaaagcaatcaacgtaaaacatcattataaactctataatgattgttttttaaatttattttaaatatgctaataatttatagaaatgaaaacatatttgtttatgatttttttgtacaaaatgcaattatttaaatcgaatatcacattcgggagagacaattatagagagttatgttgtctacaaaattgtgcaaattgacacagttattcttcctttttcttttattcaaccgttattcttcctttatacataaaatttcgtataattaaatcatcaaggtaatgcatggaatttctactagtaattactattttattctatttatttatttattttataaaaaattatttatgttaaaatatgtcttgatccgggcctacaaatttaatttgtatatataatgtattatattcaacattaaatataattaggctataaaattatatttaaaatatattttacaatatatattttaaaataaatntaatttgtatatataatgtattatattcaacattagatataattaggctataaaattagatttaaaatatattttacaatatttattttaaataaataatattaatatgaatataatatcatgttatgtaaaatattaattaagtcaatacatttcattaataatatataattgttaataaaaaaataaattttaaacaatatataattttggatcaaattgaactaattcatcaaaagatattttaagtttatttttaaaatttaaattcgttcaaactactttaaactaaaatagattaatgtgtcagtgccgaatgtgaacgttcctcgctcgatcatttattgaagatatagatcttgtggtttgaattatcgtcatacatagtttttattgaatctgaaatggtaatatgtgctggcttgatagatatacttgtaattttttaaaataggaaaagaatcagaagaataaatcaaatgaccgaaagatgaaacataaacacgtagattcccaacgtatgtttccttaattaccacctaaagcagtccttttcaattttcatattaaaaaaacagaagagggaagagttagtttaattatatatttatatattatcttctcaccaacttatgcatatgctgtacaccactttccaacaccgtaagtttgcatacccaattattataatgccaatgtctaatttcaattttggcaggaaattgatagtatacttggtttagtttttttaaaaatgtttttttttccatttttttaaataactataaaaagtaattatttatttaataaaaacgccaaaacatttagacttgtaatcatataaaatattttacaaataaactgtttgttataatttttattagaataaattaataatgttattaattattaaataaatgaacaattcttgtcagtttaacttattcagtaaatactttaaattttaacgaatttcacttcatttttgttctatttaccattgcattttgcaacattagtaatcataaatattacttagtttgttttatattatacatgctttacacatacgtacccatgcttaacataccgtatgaagtgtaaagggctatacgtgacaaagtcttaaaaggcaaatcatcaagctaacgataatcaaacggtgtaaatggatttaataataataataataataataataataataataataataataagcctgattatagattttttttacaaaaaatataaatattattataaaaaattattaaatggaaagatgccataatcatatataattataatttaattcagttacgattatatgaccatattgcaaacaatgacattcacaaatcacgatgatattgcaataaaaaaaaactataactaatttcctgttgattatatgaatttatttttcttaacctcctattttttaaatttgtggaaataacaaatgtaacaatactttatacaatttctaatatagtgaggactaaggatagcaaaattaattataattcatcaccatgtgagataaagttttattcatttaatattttctcttacagataatatatgctgtgtatttaaagagctaacatggggttgatcccttttgactatttggcctgctagcaaaaagactttttgttgctactaataagccaatgatacaatacaagttcaagtttagagcctgtgggacatcctgatctcattacaaggaaagttccaactttttagctttcacatccccaaacacaatttcaaattgataactttgtatgcacctcaaattaacaatcttttttaaggtacagtacgcaatgaacatataaaaaattgcaacatttttcgttagcaatgagctccttatatactctttaccaaatcagccacagcaggcagaaagttcataagccacgaattcaattagatatatgcaaattaatggttagctttggaataattgacaagtgtttggtggttaaaatacttaaactacgtaacgtactaccccttcgagggagtaggaattatctgagatgacataagcagtttggaattaatggttgattttgctaaagtcaatctcgttctcacttggaacggattgaagtttacttcaagacatggtcatgaaaatgacccctcatagaaaggaggaactagaaagcgaggattatttcctagaaaattatccacaatttcattggaggttaatatgttataaaagaaaaatccccgcaagtcaaatcaaataactttttttatttttttatgtacattaactcataaaacgcccaaaaaataaaatagacacactaattgttacaatataatactaaaaaacatatcaataattaacaataataatttataaataaactatttgtgaatgttatacaaagaatgcagatgaaagaaaaaacgtatataaagtagaaagaaaaattcagagaaaaaatataaataaataaaagataattacaaaaaaaattaattaagaaactctgattttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatttctccttgaaatttcattgttaaagaatgtgattttatttaaaaaaatattattaatgtccacttaatgcttcaaatataaatttactaacattatgaagcttattttcttaattggacagtcaagaaagtgtacgtttaattgacaaaaaaagtctaaataagatagaccgaaatatactccaaactcaaatataagcgaaaaaatttaattcatagtaattaacaaaataagttaacatcatttaattttgatagtctcactataaaaatgaatttgttttttnnnnnnnnnnnnnnnnnnnnnnnnnnnnnnnnnnnnnnnnnnnnnnnnnnnnnnnnnnnnnnnttttgtttattttgttttagtccttttaatatatatctatttttttattttattccttacaaaatttcttcattttatattaattcttttgaaaaacatttgataaggactaataacaaatgatctatatatattatagagataaaaatgaatatatatatatatataaaggattaaaacaaaataataaaaattaaaaaatatatatttttgttttatttggaactcaaacacaaaaataattttattaaagattaaaataaaatttgttaatttatcgaaaaacaaacacctaatttattagtaccatctaaaatcatggaactaaatttaatcaaaaaataaattaaatgatcaaattgaaaaaataaattaaataacaaacatagtaattaaacctggaaattaaaaggataattgccccacaatcattttttaaaaaagaaaattttatttctatattttatagattcatttttttaggaaaagttatcttataagacaatacctattttttggtggggtcaattttttttattatgcatatacaaataaaaaaaaattcttatgagataattgccctcacaccctccacgtgcatccgccagtgtgagtgcagattaacactactcttattgtatttagagtgaaagtttaatttgacatttttatttttgtattaatattttattttagttaatttttgcgacaaatgaatctaaccttctgttgaaaggattttaaggacatacacataagtcagaagtgaatttagtagtacatataatgaaattattattatttaaataaggctaaaaattaaatttttttgtaactattatctcacttcaaatttaaacgatacataaaaactgagtacaagttcacaactaataaaatcaacaatttgagtttctaaaaaaagaaaagaaattaaaataagggtacaggtcatgtcatgggtctgttggtaaagaagccacataccaaaccatggtctttataaaaataaagggaaaataatcccaaaaccaaaacagaagaaaaaaaaaaaaggaatttgagtatacttgttcgactccacatggttggaaagtggaaacactgtttctttctctctctacttcctatctcacactttctcttcatatcttattcttctcctcctaacatgtataaatatgttaagtgattaatagcaaaggatcccattaactttgttaataagtgcaagttagctacttagttcaattttcctgcaccaacatttcaaacactatcatatcatatcatatcttaccattaactcaaagtaacagtgttccattaagattttctcatctcatcaaccccattacagattcttctcttttctccttcctggttttcgaatcttcaggtactctaccacccttcatcaactcactcttcattttccttttgcttttaagaatctattttaatatgtttgtttctttttatggaataaatgatatgtatatccatttctgcatattgcatactgtgctgaatgtttgaatgctatgctattctacccaatctaactaaatatccgtgaagaaaaagaaatatgatttttttattcatgttttggtgatttttttttagatccttgctcttctttaactgggattatctgtgatattttgatttctgttgtttggtttgtttggaatctgtttaagagaatgaaatgggatttccttggtactgtgtttcaggttctcctttcatggatatgagactgttttcttggatttttctttaaaaatgggagtttagctaatgggttttgcggatccgtgatccttttgtttctgatggttttgctgcagcatagaatttgagttcttgttgatcagttcgatgaggattacggtgctgctgttcctgcctagatgataataaatagaacaatgcattctaaaaaatgggtcttaagaattttatttttctattttttttttatttccaacattcatttatcttgatgtaaattgtgtggttgtgatgtgagtacggtctgaatttgatggctttggaacctttgtatttcgaattattgttcttagcattgatgtacgtattccatccagtttgacacatgaaaaattcatcatcttgtactttaatattgactttgcaattttcaggaccacggattgcacaagtttctgcagattggttttgctgtcatatggggatttccttctcatgtccatttgccaagtacaatgatgtggaagatggcttagactccgttgttgtaaaatccatcaactttggcaatgatgaaatcaaaactccaatgcgatcggtcagtttcaagaacgaagatttagaacccaccatccttaaatctctaggttctggaaagatgacaatagaggcatctgtgagcttcaaaagaaaggacattgataacattatctcaaccaacactttgtcatttgacaaagaggaaaacatgcctatctcaaggactagcaaaaagagcaaagaaatggatgatcttccttttaagtcagagtgtcaagtggaaaccatccaatcagcacttctaaatccaaacagccccaaacacattgcagcacttaaattgcagaaagtatacaagagctttcgcactagaagaaagctagcagattgtgcaattcttgttgaacaaagctggtactttttttatttgcctgagaatctctttccttctttacaaaatttcatgtgtttttgacatgttttaatctttaattttataggtggaagctcttggattttgctgaactcaagcgcagctccatatctttctttgagattgagaaacatgaaaccgcggtttcgcgttggtctagagccagaactagagctgctaaggtactttaacataattagctttggaagggtaataatggtgattattgaaggttaataccttcaataactactatgctctaccttgctagttcaaactttcaagctgcaagaaactgaattaaaatttgctctgtcattgcaggttggaaaaggtttatcaaaagatgataaagctcaaaaacttgctttacagcactggcttgaagcggttagtcaaacatggctgctctagcttttttttttctgcttatgtatcggtctgttagtcattcatcaatttttacttactgagttttttttactgtgtgatagattgacccacgccatcgctatggacataatctacacttctattacgataggtggcttcagtgtcagagcagagaaccctttttctactggtaacattctttgtaaaatatatttctgagttacaacttatatttctcctatatagatcttaagtcacatgtgtttgaaattaagcttctttgaaattgcaggttagatataggagaaggaaaagaagtaaatcttgagaagtgccctcgttccaaacttcaacagcagtgcattaaatatcttggtccggtaaggtttccgcaatttatacaaacatctcttgatagacaaatttgctggagattctttgatttcaattgttattaactgttttcattttatgttcttacagatggaaaggctggcttatgaagttattgtggaagatggaaagttcttctacaagcagacaggagagctccttaacactggagaagatgcacatgccaagtggatttttgtccttagcacatctaagacattgtatgttggcaagaagacaaaaggttcatttcagcattctagcttcttggctggaggagccacatcttctgctgggagactagtgattgaaaatggtgtcttgaaggtacaaatctggcataaggcttgtaaatatattactcttttactggattcttatagccatagatgactactttttttttatttttattttatatgctcagaaaatgagtttgttgtttcttttcaacaggctgtttggcctcacagtggtcattatcgtccgacagaagaaaattttaaggaatttatttcattccttcaggagaacaatgtgagcctttcagatgtcaaggtatagatacttagaaccattgctttacattactttagtattgtttgtaatggtttataatttagatctgtaattacaagatgtgaaacaatatattctgaggaaattcattttgttatatgcagatggatccagttgatgaggctgatgacttgctttctctgagaagtagtggtcatcttagaagccactcatctgaagaggacttcactgagaacatgaatggcctggagattgaagagaccattattgaaggctcagttgcagcagagaaggccaatttgatcgaaaccgagaggtcttctgcactgatggcaccttgcacaaggcaatttcaaattcttggaagagaactgagcaatctagaaataccaaaaaggggtcatgtgtttgaaggactagaaaatgagatagaagggagtgaccaaagctgtgtgagtatccaaatggaatctcaagaaacaaaacaagcatttgtaccagagctggaccatacaaattcagagaaaaacttatctgatgacaatgatgtagaaaccattccacaagagtccatactaaaaagaatcaattcacataaagaaatgaaatcatatcaactggggaagcagttgtcttgcaaatggacaaccggagcggggccacgcattggctgtgtgagagactacccttgtgagcttcagttccgagctttggagcaagttaatctgtctccaagaagtggatcccgctctaaatcatcctttgctcctagaagcaccactttgttgagctctagtctttcaaatgtagcaagtctgtctggggacttaacaattgaaccacttcacatgcctcatagaggtgagtccaatagttcaagatcagaatgctcccctttgatcagaggatcatcagtgataccagttattcatagttcatgagtgaataggattctccattgttttattcttttttgtgtcaataggtaaccaattaatatatgtatttttgttattctttccattgatgcacacaggcatttttttttcactcatgtatagtattataggatcaaaactcagaagtgtaaaattattttgggatttatttatcctcccaatacaaaggaaacatttgatcttccaccatgcaacaagttcatgggttcaattcaaatatatctatttatagttaatatattgaaggtttattgatgatgcaggtttatattatccttttctcactgaaatttaagtctaatccacattattttttgttatgcggctgaggacatatttggacttaaatatctacaatggtttaatttttcagggaaaccaaaggtctctctgatgaaggcaaaaaaatttaaataatatttttttccaattatttaccaatatagggctgtttcaaacttatttaccaaaatggtgcagccagacgcgcttgcatggggcgtgtttcaggcacaggtggcgcgatgtaaatataaactttgaaaaatcataacttttgattgggatgtccgattgaggcgaaaccggtggccacgcgctcaaaattgagaggagaagaatcggacatcctagtttagaaaagaaatattatttaggttcttttgccctcttatgaatcttgtttttgctaatttgtttatttttatttgtatttagtttggggaataaagaaaatctttaacaatataacataaattcttatcaaaatctttatgaagataagataataatccaccaacccacttgttatttttatgaggcacaataggtagaatttatcctgaaaacagaagaatgatcgagaactaatcataagagtttatgtacaaagtgcttaatgacttcattaatattcgattttttcagcaatttagttgacaaagtcccaaaatcttcatatgctaattgaaatcgggaagtatttatatatttaagattggcttattataatgttttgaaaaaaataatataaaacccactgttcaaattggtattgtctagttgggcttattaagcttcgcattccatgctgtgcatgacactatctatctatccattagtatgtgcaaaatgatgaaatataattgcaaccattatgatgaaaagtgactatctttttccttgcattgcttggtgcacgttaatctttctgttcaaacttaactagcaaggatagcccgtgttgtagacgggtcaatatgtaagatttaattaatatattagattgaatatattgaaatattatgatgaaaatgaattttcttttagactcgtggcaatcttcttttgtggtgcatattctctgaacattgatttctctggttcccttattactactttttagctattaaaaatagtagttcaatttttcttttctgatgttttggtatctcgtggccttttttcggtcaaatttcactgttagaggatatgatcaacaaatttggatttatctcttttaaaataggtatataaaatgagaaaataaggataaatttgaatgaagcactactatcttatagaatgaactaacttcaaatcaatggtggtggacaaataatgctattgctgatagttatcacggattcaaagcgtatttgattttccgttagcacaaattttcaagcatataaacaaaataacaattattaattactttatgctaaacatgtactcaattcgcaaccctgtattaatgattgctttctttgattgagaaccaaaatttggctccccctaatttgtcaatattggcgtgatgtatatatagtattaaatttggcacttaattttagataaaaaaagtgagatattcaatgattaaacttatatatgaatttaattaaaatatatattatattatcatctaatcacaaattaatatatatatatatattataataagattgataatttttgtcttaaaagtaatatctaagtttacgttatcaaaatgagacttcccacatatacctatatattgtggaaaaaaaatatatataataggtatagttggtttcattgcatgtatagatagaaaacgagatatttaactagttaaacccaactccttttgttatcggtttctatcaaagggttgacgcctttttttttctctaaaatattcttttcacataaatatgattctattatacatttgtaattttatagaaaaattgtgtttatgttgttttctgaacaagtgtgaaaataaaaacaactaaaacaccatttcgtggtatgttgtataatgaaatcatagttttgttactttatgagggggtgaaaaaaataataacggaattgtgaatctattttttttaacccaaaaacataactaagctttcattgcccatttctttcttctttttcctttgcacgtaggggtgatgaatggtggggaatatctaggtcgatgggtctagattggtgtagatcaaaggtgtttggtcacggtgacaacgagaatgcgtagcattatggacagaggtgcaaggtcaagggttcgcacgatgttgcaactatgtggtggtggttttgccaaggggtcacgtgcacagatgtactgttggggcaatgagcggtgcatgacgatgttgcaatggtatcagggttgctgggttcaaagctggacaaaggtggtggcgcgctgcgtgatgtggtggttatgggttgaatggggtgaaaagaaggtgaagggaaagaaggggggagggtaagataatattttctcacgtttgtagtggccaataacaaaaattgtaggggttacctataagtcaaattagctaatctgaagttgaaaaacatttttcatgattagacaagcccagtaatttaggggatatgcagactatattaaattgagaagagtccatgaattatttatttatttttaagaacataagagaaaaagaagaaacgaccaaactaggaaaattttaattagtacgcttctaattgataagaaaaaataaataaaaaagataacaaatgaataagcttctttgacaatatttattttatcataaatttaattatactaattaaaaacatagacactaatgtgtttatacttgcatttttattataattttaatttatgcaaaatggaaaatacatattgagtaaaaaataaattaataaactaaaattaatacagatgtcaatgtataataagaaaatttattacaatatatcaaacttaatgtcttgcctaaaaatatacacataaatgagtgataaaaataaatagttacaatgtgtcaaatttaatgcagtacatacgtaaacatatcgacacaacaatatataaagaaatttttataatatatcaaagttagcattttgaaaaaaataaatgagaagacnnnnnnnnnnnnnnnnnnnnnnnnnttacatacgggtgtatataaacgatccaatccaataaggatcgaaaaaattaatccaaaaaagtaaaaaattgaaggatcaacaaagttgaaaatcgatgttttttattaaatcaaattggattttggatttgattttaaaaattgattcaaatttaacttatgcatatgtatatatttttattcatacatttataatatcatttatttttatatcttataaatttataaaattatcatagaaattatatcaatttatgaaatttataattaattaaaaatgttttactgattatttgaggaagatgcttaaatattctattattagttatacaataacacataaatagatgtttgatattttaaattattttttattatatttattatatatcctatattttatttaatatttttctaaaaaatnnnnnnnnnnttaaatcaaattggattttggatttgattttaaaaattgattcaaatttaacttatgcatatatgtatacatttttattcataaatttataatatcatttattttatttcttataaatttataaaattatcatagaaattatatcaatttatgaaaaatataattaattaaaaatgttttactgattatttgagtaagatgcttaaatattctattattagttatacaatgacacataaataaatgtttgatatttaaattattttttattatatttattatatatcttatattttatttaatatttttctaaaaattaaataaaagtatgattataattgaaaatcaatctaatccaaaacagtttaaattggattggattggattaaaagtttaaattaaatcatttgaatgataaattaaaaaaatcaaaaaaattgaattgaatgattttttttccaaaattaattcaatctaatccacgaatatcactgccattacgggatggttttggccatgctcatgaccctaacttttttttttccttttgttatgtgtttgcattatttatttttttgggtaagatgctaaacttgatataaggctataatttttcttattatattttgacatgtatattaattttaaattattattattatttgtttaatgcatgcttatatgtatatattttgttacaagaggtaaaaatgcatgtttataggtatgtttttttgttatgtattattttggatttaataaaaaaaattacatgtttatttgtacatttttttctttttggataaattggtacttttttcgatttcaaacataagttatttaatattttttcttcattatattaagagaaaaggaattatatatgcactaacaacataaaatatttttgtagttatttaatcttaacttattatgtataataaatttattaattttaaaaataattatcttaaaataatttatgattgaatgataatataaaacaagtttacaatgttaatgtagttatattaaactcccatattaatgtcacaaaataaaaaattaatcactatagtttcattatattacttagtttgtcaaaatattttttaaataagattatataatatttatttatttatctttattttataaagataaggacaaagatcaaagagtaaattacatttgtaccccatgtattttgctcaaatttagttcgacaccctctcttttttcacattacttttaccccattattaatgtagttaactaaggtaaattaaaatatgtgagaagacgaaattgtctttacattttaattgtaaaacccaaattatcccttcccaattagtttcagaattaatggttcaagtcttattccttttcatcattcatgagtactattcatcttctacttgttggtgagtttttcttcatcgtccagagtgcgagtttcttttcctctcacgatgttcacgttccactcctctttaccgtttgcgagttctttagtatttctcttctagttcacgagttctccattgttcctcttcccgttctatcttcacaaacatcttcatttgtcttctttcgacattcacgagcgctgtgtttctctttctgttccatgatttctgttcatgctagagttatgtttgtatgtgacacttgaccttgtatatatgttactttttaaggttatttatttaatattgattgtttattattgcctattaatgaatgggatttcaatgggggaccattttgggaccacttataattttcaaaatcatttatttattattgttgataaaatgatgttgatgtttgggaccacaagaaacacaatggatgaactgattgtttattattgttgattaaaatagtgttgatgtttgagaccacatgaacacaatgaatgaactggaatacatgagtcctaaaccagacaacgtggatattttggtccactttacggactaacgagatgaactaagtgaaatatgtaatgttgatcatgataagtttggaatgtctgatgcacataattgtgtgaccaacattgctaatgactaatacttgtcatcatgtcaccctcttattttatggttttgttctattgttagtggtaaattttttccccttaagactgatcatgacatgctgaaaatgtttgttaagaatcaaaatttagtttatattcatatgtatgttaatataacaaatgatgagttttagaacctatatgtgagtggaaatgtaaatgaacttgtaagtgaaattgtgaatgaatatatgaatgaaaaattgaagaagaaggaaaagtgttaatagtgtgtatcaataatgtgagttcacatccaacaaaaagatgaatttatttttaattatagaaagaataaaatgaaataatagtcttaaatattttcaagttaagaagaagataaaagtatttttttattaaattattaaatcatatttaagattgagtacgatgtaatgtaagttaaataattaagaatatttttgtgattaaaaaagagggaggcagcagatgaaatttaagcgaaactgaggatatagcgacggaagactacgattgaactcaatttacatcgaatccctcaattccaataacgaaccaaccaaccagcccttttttattttgctcgtgttgatcgcaaatcctcatctctattcgttgcaatccccactgcgccactttccaggttaaccctaattcttgtattctcccactttcaattattattctttttcctcatcacgttctcgttcaatatccaatttatttgtcttgctgcctaaacaaattaggtcatcgcttggtttcatgctttctgctaaacaaattgctgtgttgtttgtgtgtgtgtgtgtgtttaaataacttcctgattagtgatcaattcaattgcaacactgcatgcaatcgtgaaacatttttgaaagcgtttttttttgtcaacttctgtttcttcgtaaggtgtactgcattgtgaaggacaagatttttaagccgttgctttgttcttggaggtgttagactattaggggctgattgttaaagacggcacttgtttatttatatgcctaattctttatagcaaaaaacctaaaactactccgaagtagaaggaatagacgcacccagtgattgccaagggccctaaaaattagaaaaatggtgtttcattggaagtaaccttcttatgttgaaagagtaaattgtttgggagaacatgcgtgtctgataaagagcgatcgatgcctcccacttatgcagcaaatcacttgtattaatcctgttgagtactgttgcctcaaaacaaaggacttgaccttagagagagttatccatttctgtctgtatttttcaagagtgaacttttggggggttaagagactagagtgtccgaagttaaacaaaattattttacaggtaagcagaatccaaagttcaaactttcctactagagttggttgagtgagaagtgagaaatttatagaatccaataaagactaaaggggttttaattcacttaatgtagttaagggtttgtggcacctcttgctttgaggtattaaaaatccccagtgcctgtagggagcttttgcctttaacttcatctacacggaccagtttctctataactcaagcatctatcaaactgaaaatctcaagataaaatatgactctgaataaaatacttttttttatgggtgtgtcatgcactgtagagaggttgtaaaggcaaggaaaagcctctaagagaggaaccagccaaaattgatacagcatcttgttggggtccaggggagcctgaaagcaaagaagacctgcaccattgggcctagcaatgaactacaagagtgaacttggcatcacattttcacccaaaaccttagggaattgggtatattggtctgttcccttatgttaccttcatctagcccattcttaactaatgtggaactttgaacaaacttgaatttccaacacatgtttagtttcacagcctttccttgttggcgttgatagctttttcctgtgtttgctatgatagatcaataactagatcattccaaatataatattatatctaataatagttttataggggtctgcagaggtttttctttttaaatgctgagtattgtttatgttttttttttttttttttttanagacattccaaatataatattatatctaataataggtttataggggtctgcagaggtttttctttttaaatgctgagtattgtttattttttttattttttttaataaacagtgatctatattttccttttgttttgagtttattattctgtcactagcaaagtgaaagttgatagctgtctaatatgtttttttcaataccatttcatctattgcaaggcaactaggtttttgaagttttggttttcttccccacagataaataccttcattaccttgtgtcatgcatgtgagtaccttgtgaaattaagttttcaggcttttgttggagacttgcagcagcagtagatatctgtagtacatatcaaatctcaaaatatttaagtacactttgctattttaataaaaaattgaacttacccctccttacaaggcaaaaagatttatgggtgaaatacaggaatgtttatgggttttttccttgtggattgatgtttttttctagtgcttatatgtctccttcaggtgacacaatgccattagattttaagtatttattaatcaaaatgaagttcttccatctgttttaattaatttgaaattttgtaattgtcaataaaagtgtccaaagaaagtgcatgttatgtttataatttttaatgtactatttattcctgtttatggaatatgtcagaattatataggcatgtataaattgttgatatctaaattctatttataagaaaaattaacagcttgaacttcttgatccatgattactagaaactcaattctgcattacgttctagtgcttcctgtgccttctcatttcttttaaatttataaactttttatgcaatcgtcaactatgctagattgctaggttaatgaaatcttcaaaacctcaatatttgtgaatagatacaagaatcagttactcttttcttgtatacaaattgtgtcaggataaagaggcagagaatttctatttcattacgtaatccgtttaattttggttgcttgaaataaggcagatcttgtttttagcagcatcttgaatttcaaaatgcctaaagttagaagattgaagtccccgtctactgattgtaatagaccatatccttacccatccaactccaaaaacattgagctgcataaacctataaatttgttgggatcagctgatgaaataaaagaatgggaggaagctagatgtcctatttgcatggaaccccctcataatggtgttcttttgaaatgttcttcctatgagaagggttgtcttacttacatgtgcaataccagttaccgccactccaactgccttgaccagttttgtaagtcctttgcttctcatctctcatcagaagtactgcaagaaattcctgtcacaggcagagtctctcacagtagagaaattcagtcagagtctcggcaccccactcaatgtgggagccagttacaatcaaagctcatttgccctttttgccgtggagaaatatatggatatatggttttggagcctgctcgaaggtatatgaattctaaactaaggagttgttcttctgaaacatgtgaattccaggggacatatccagaactcaggaagcatgctaggtctgaacatccttctgttcgaccatcagaggtggatccctcgcgacagtgtgattggataaggatggaacaagaaaggggcttggaagatctttttagctcaatccattcaagttctgttgcagattacaatagagataccattttgactgggggtcttgctgacttgatgtcctcgttcttgtatgaaatatttatctctattgaagatgttaaccgtatggctagttttttgactaattcaagacacagagtgccattatatgacagaaggtctggtacaacacacagggtatcaaatgatacacagacaaatcaatcagctcgatggagatccaatttaccttcaatgcatcaactggagagaattgctaggagtagagtgagaaccaattttccatatttatcatcccgtaatcttgaggcagaggcaaatcgtactgctagatggagaacaaatatgtcatcttttagaatgcctcgcaatgagcatcagttttatagagacctcagtgcagaggtcacatcttcaacaaggatgcctcgggcctcacaaggtactcagactaatccccagagcaacatttcttcatctggaagtggaaggtttcctggtcgtcaattacgctggcgtgatcaaagatggtcgacaaacaaccaccaatgatgaatggcaatagatacttctgtttcatataattacaaatgtttacttctgctatccattatggggatacttcaaactatcatttaacttcgttttattggaggatttggttaaatgcaatcgttttatttgaatttaatgattccttgcatgctcaaagcaaccacaaaatatttttctaattatttttgtttgtttttcatctaaattttagggatagactatttttctaacattttttctttttattaccacaagattagaagcatcatttttcaattttcatatcttgcattacgttgtcatatccaatttcttgtaccatgtatctaataattcaaacattggcttgatacctttaattgcattaatttcaatagattttaagaaaatatttttacctgaattgtcaataagaaaattagcaagtgatatctctttcttttttgtcctaccatcacatgtcaaactgcaatctcatatctcgctcacctgtatttttttaaactttttttatttgttatcatttgttttattcataaaggaaatcttaccttataataagtaggtggtttggaatatctatctattctttaatatcttttaacatttttttaccagattaattttctttttaacattaattaatgacaacaaagatagaacttaagatccgagcaaattaaatggttatgtgcagttccaccatgtatgcatttgcttatttcttgaaagatatcattcattatcttttagcatcttcatttaatgacgagtctattttcccctttgtattagcatcttcatttcctgtgtcttctaaacgccctaggttctttttatttttttattttccaacaataatttggtaaacattttcctaatctcgtcgagaatacttgaacagacaacacattttcccttattctaaaaatgtgataagatgctttattcttcaactaaacaacacaaagcacaatacaacaagaacaaatctaagaggtaggagaccaccgaccaatagtataataagcaccaacacaacaataaaaggcaacaagggaccatcgaactagctcctgtgctgaggggaaaaaagcatgaaatggagcatgtaaagtgtcgtggaaaagaaaaaggaaaataaatttgtttctcttaaatatttcgtatgggacactctagttatctttagagaccagagaggcgagatcagttgatttcctctcatttgcatttttttttactgaagattaaaacaaaaaatattagactatgacaagaatattgaaccttttttttacactgcaaaatacttatatcattcattaataatcaagacattgatacaatcaggagcaatatcaaatgtcagtggactagcaaatatcctaaaatcatttaagctatactactttaacaacactaagaaatgaagattaatgaagagtattagatggaaaagatgcaaatggatccacaaaaggaatcacaaacacgtgttctattctaccatactaatactattaccaaacaactcagaagttatgtctcaaaggctcgtggaacgatataaaggcgccttatctttactttcattaagattaaacaaaataagcatcaagaagttcttgaaaaaaaatacataacaaaatgaatatgttaaaacaataatcaaaatgtcagcctgcttttgatgttcttgttacatttggcagaacaacagaatcaagatccccaggataaggggtaaacaagcctagtcctcccctactttcttttaaattgcctttcttaagttcatccaactgtttaacccattctatgggagaagagtgctctcttgtgtgaggatgcaacacaaacagtgaattgtattcacagttgggaaacataaagaatttgaacgcgtcccccaatctgtatgcaacatagccaaaactcagttgatctctgggagtgaagaggtgaacctcattgaaccacaagcagctaaataagttatttatggcagtatgttcccgaatgatgacagctccctctggtacatctgaaacatcatatattattgttaacaatacgcatcaccaaacattatcattagagaggaacaagagaacatttgaatgaatccatgtgtcttaactatacagcagatagtttcatttataattagagtaaaaaatacaatggttaacggttacataattatacagctcataatatccctcagaaatctgtttttaaagagcccagtaacatcatgtgatacatgtagtcaacatcatctattgaaatacggctattgttgttattgttgtatatggaacaaatatgaacaaaattagaaaattaacagaaatgtgacaaaacaatatgtttcctcttaccaaaattgttgaaatcaaaccgtagaaataaaatataaaaccagaggtcttgtttcctgtcttaccactattggtctttttatttgaattccatggcttcattccctcataataatagattttaatgtggagatcaataaggggtcgagcatatcgctttcgcctcttgtttgaatcagcctcctcatatatactacggtgatgcttgtgttgagcaatggcaaacgtatgcttgcctcgccataggtatctgcataattaaggtagttttacaaggttacagtcatcacaagtcacagaaaggcttgcacagacatgatcagcagttttttcaacaatacagatgtagtaagtatgctcttaacatgaaacttcaatgggtgagtttataacaatagtttcagtgtggtttctcctgctggttgaaatagaatattcattcaaagttatcccgttttatatttttacattaatatccctcgtggtatgtataattgtatgaattagtgctttcaaaaggaattaaatatgccgttacacaacacagggtatgaaagtgtcatgtgcaaataaacgcaagggaagtaactccaggaatcaagaaaaaagctatccattctgctagaaagttttagccttatcagtttcaagtaccattttcatttgtttgagaagagacgaggggaggttagtgtcaaaactacatcacaaggggcaacatagaaacctaacatgatacaatcaactgttatcccaaaagaaaatccagaaacacgtaacaagcaagtccctaccaaaccaatactttgcttctataatgcatcaacttcatgattgtaaatatataaagactatgtaagagaaaaatgggaaagcaaaaaaatccattaaattgagtccttcaaacagagtgccccataatgtttttagtgtaagtgactgatcagtacatgaaatgtatcaaattcaaaattatcaaatgcctttccctcctatccttctaagctctcttgagtaagaaaaggatggcagtttaaatatctatccaaaaaaacaaagatttaaagtgttgatgttatcataaaattagggataaaacatttaaacagatataagtacctatcaaggattagcagtggatctactatcagctccattttaccatcaatccaaatactatactgtgcttgagggaacaacctgtgggttaaaattttgggaaccttcccattccttcttggttcatcataaggaggatgcttaagaagaataagtcgccatattcccacccattttccaccagctccgtcttctttgacagtaccattttccctcatgaatttcagagatacctcatccaccaccataagaaagcaaaaaagctcctttgagcgaaggcttatatttgatggttgatgaggtaaatcgtagccatcaaaaatgccagatgcaacaacaaatttgcatttcttgacatatttgatgtctacatgattcatttcagcaccaccacctcgaatgaatccacaatgcacctaatgggcagagcacatgggaaaacatgacttgttgattatggcaactacgacgcaatcttgcaaaattgtgaagcaattgagattaaaatgaacttgagcaaatcatgctaactaatctaccttcatatttgattttagtttgaaactttcctccctttgtttccaacttggatggcctccaaatagaggagatgactgagcttcactatgtcgaacctcatcttccataacatatgacagatttttgagaattttgttgggagttgttccagttgggataactattttatcagggtcattggaaagaggaattggacatcctaacgaacataggcagcaccaatatcaaacacacagttatcatttggtgaagttcaaaaagaagggatggaagcaaaaccaccaaaatcttactgtgaggttttgatacaagtcccatattgcctaacatgttgtaaaccttgctatctttgttacacatagctgcaggtcaagcagaaaattgctatattttcagaaatgttgacaattttggtggaaaaaataaaataaaagacaaaatgtttataatgaacaagcatttcttgaagtatgtctacctaacagaacctcccatcaagttatcatcctacatttgtaaattctaatcatagcaactttgcatctatattcactaatcagattgtagatatttgtatttacaaagttagtttcaactaacttaatatagataaaattaagacaagtgaagtcctagttccccttacaaataccatcaaagaaaaacaataattaacaagaaaacatcacattaaattcaattttctgtactaagatatattatactaactaacgtacccccgtaccagaaggcttctatacgaaagtatgggagaggactattgtatacagccttatccttgcatatgcaaagagtttgtttccgaattcaaacctatgaccaactggtcaccaagcgtcagagctttccctctatgcctagaaatattatactattcttatttcaactagaaaataaagagttgctaaccttctaattccacagtaaatacttctaaagaattaagctacgagttgaacttatgagtatgaaagagaaagagacataagacttaaccttatctatagtgaaaaatgaatttccaaactgttctttttaaaagccatcatctatgaattgcaagaaacttcctgtacatgttggttttctagtaccaggaacaactaaaatcaacgggcacaggcagctacgaagatcaagttaaaatataaagcaacgagatttattcccttcaacccaattctcaaaatatcacattgagaatatacagttagatgaagtgtctatgttattacttattacaattaagtagtagttatcaacaagagataaacttaagaagatttcaaaaaagtaacgaaatttattaaaaactttactaacctgataaaaaggagacggaagtttgacaagaccatatatggaacaacaatgcaagaagaattaataacatccacaagatccctgctacaagaaccaaccgaacaaaccctttcttccaaacgatcttcatggggtaatcttgaggtaccctccctgaagaaaagaaacccacctcaaaatctgcatcaccaacaaacagattttatttgccaaggccaaagtaactatttccttcactgttatataatctagtaaagaaacaaaagagatatttctcagcagataaaagaaccaaaacagtgtataacagtccttcctaacctttagcagaattttgactacttcgatctcctctacgatttaggcgcaaagatagagacctttgaagatcaccctccatatctgattctttcttcatgttatcatcactgccattgcataacaaaaaaaaaaaaagatgacattttggcataacccatgagactaaaaatcagaaaagatgcacacacagttatcaaaagcaaaactgataaagagaacgaaaagagggaaaaaaaaaaaaaactgatncagcaactaattaccccataagttccttgaaaatattcaaccaggacaaatttaaaaaccaaaactttgagcgaaaaaaagagggacagaaagggagaaaaagaatagggcgagacccaaatgaatattaagaatagtatagtgtcggtgaggagagcgcagatgcatacaaccacaaaaataatgggaagaggagtaacgagttggggcatcactatcaggtgtaaattgtgaatgaagtaattgaggaaaacgagaagaaattggtacctggcggtggtgaaagaagggatggttctgttgtcagtgaccaaaaagggaccagatctgtgtgaaatgtgtaatgttgtgttgggtcgttctaacaacaacagaagagataaactagaaagaactaagactgtgaagaagagatgttgaagtttcaaactgaaacagatatccctctatcctttgttttctcatcaacactcacacgggatcatcagaggatcatggaagctgcagaatctcttgttttattttaatgttcttttttttctctttcttttttctttactttcaattgattgaggaggatcaaaggcccaaaataagagggtggagcaatttggaatgggctgtaatggaactggaactagtatcccagccgggtttcttttgtctatatttttaaaataaaaaattaatatgaaagaaaataaaataaaattcgaaagaacaacaagcattttggttggttaaactttttccacgggcctaaacggcaagtagtagtcaatttggaaaaaatcgtatcagaattctgcagtttattttgtaagtttttagtttttaccatagaggtgatttgattacagtccttcgtttgttcttgtccattcatagctccaagctcctaatcacccacgtggctttgtgatcatttcatgaaatgccacaaagcgataaggtccttattacaaagccaaaatcacttggttgatggtgacaactggaatcacatggacttccccttaaatttgagcatcagataaaaatgaacgtaaaacgtgagcctctagttttgagttgaagcatataactttggggtgttcattgtgtgttgccactctcctctcttgttgtactcttgttccttttggttagcagaaaggaacatggaagctgtgtgtgctttttctgttggggcacttcacatcccaacagcacatgaaacatcaaagtcatttaggaaatctatattcttgagcaacctagtggcttcaccagtttcattggtttttctcaggggcagttcaaaatccaagcttttaactgccttgtcacccactccattgacagaatccagtaaccaacctgaggttgagccagaatttgaaagtcatgcagagaaatttgactggtactctcagtggtaccctttgatgccaatttgtgaccttgacaagaggaagccacatgggaagagggtgctgggaattgatgtggttgtgtggtgggataggaatgagggtgcttggcaggttcacgatgatgcttgtcctcatagattagcacccttgtctgatggaaggattgatcaatggggcaggttgcagtgtgtgtaccatggttggtgtttcaatggcaaaggagaatgccagctcattcctcaggcactccctgatggccctccggtaattactcttggtcataatttgtagttaatgcatgttgttgtaatatggctcccaaattcactattttttttgtatgtttcatttcctgtgtagtaagtagccagaacgcatatgaaaatgcagacttttcagcctttttttcaatcaaaagattatgatttgcatgtaccatttactcatttcctggccatgaattttagcttgtcatcatgatttcatgttctgaaacgtgcaatattgaaggtgagatcatattatgttgatgcgtggaacattagtggcttgtgagtggctggtggcgtactttctctctaagttcattggttctagatctcaccaatgcttcaaactactcttgacccctatgcatgtcacgcatggccacctcttcctcctctttttgttgatgtgaagttatgttgtagacttgtaatttgtttttcatggctctcttaatggaaaaggtatgagttacacctcccaagtttaagagtttccatctattctttacttgatgtgtgacaatctagtcttacataagtcgacttatccacttaccatgaccagaagttgacttgtacttaggaaagtcaacgtacaacattcatactcagttaatagtatatagacaacttacagaatacaaaagttaagcaactgacacaatacaaaacttctcatgtttcaaaaaagcaaatccaacttggtacatagtcagttatagtacatggtttagttttgtgctttgtgaggtccaattgggtaagtcagtacatgactcctacacctgaatttttttaacccttttagaaactcaggtaaatcacacccaactcaaaatttgagtttttttatactttatccattagccagatgaatgtatgttggtactttgttgaatggggtcttttgcccatttagtaaataatgagcaggttttgtgacccttatgaaactcaggaggtaagtcacatatgacccaaagttggactttcctttaaccaattttattttcaaaaattttaaatgcttccaagtttcttcatacaatgggacaatctgatgctcattaaagtttgctaaaaaaaatgtgtaggtacatacgtccaaaaaagcatgtgtagctgcttacccaagtactgtgcagaatgatatcttgtggttctggccaaatactgatcctcaatacaaagatattattacaagaaaaagacccccattcataccagaaatggatgatccatcgtatactaaattaatgggaaacagagacattccttatgggtatgattttagactattaagatctttcctgtgttgtagaactacacatctgtacgtggctcactttcttttacctgaagctactgaactattatttttttctttatttttttgtgattggtaattggtctaattatttagctgattctggaagatgaaaacacaagcatgacgttatgcatagaatttgcatcctgggggcgaaaaccacattccccacttagtgtatctttgatctttctaacaaaatgaatatgcaattttaggtatgaagtactgatggaaaatcttatggaccctgcacatgttccatatgcacactatggactaatgcgtactcagcaaccaaaaggtaggcatataaggtatatcttttttaacttaattaaatttctatttacttatatatgacacttacatatgtagagcttaataacagtgaaagctgatagagaagggggcaggccacttgacatgtctattgaaaagttagatatcaatggtttttcagcagatcaggcttgggccaaaagcaaatttatgccaccatgcattttttatgtgtatcctccagatcaacctgcctcatctggtgaaactaacgtaaaatattgagtagatgctatttttagatcagaaacaatatgcaggcagtatttctaagggtataatttgtgttacacttaatgcagaaatcatcagctaagaagaaaatgtgtttaatcttcgtttgtgttccggttagtcctggtaaaagcagattgatatggtgcttcccaagaaactttggattgtggatggacaaaattgtaccacgatggatatttcatgtgggacaaaacctgattctggattcagatttatatctcctccatgttgaggtaacgcctgttattatttatcctatcaactaattggttccatcactctactttttcctcttcaaactattgtaagttctgctgaataaagctatcataaagaggagcaacattttttcccactaggtggtattagctgcatgaattaaacgatgatagtgttttgttgtaaatgatatttatacacaaacagacaaactatttttattgggcttcctctacctctaactacccatctgatatactctccttattgggcttctataggtcttctcatacatgaccaaactacctaagacaagattgtatgatcttttctacaataggtgctaccccaagttttcccccaatactattataatcctatcttgtctagtatgtcatctcatccaactcaacattctcatttctgctaaaaaaactacgtacctcattgtcgagaggttcctcgctatgctaagggaagggagagagatattgtactcagctttacccttgcatatgcaaagagtctaactctcaattctgctacattgagtttattctctcgtttgttttttaccacccaacattttgttccatataacatcacaagttttatagttgtgtagtaaaattttgtttgagtggtacttttttatcacagataactcagggtactcttccatttcatttttcctactttaatcttatgatttatatctctctttttctaataaaaaacaataaatgaatgatattagttgttactactacaagtgtacaacaaaaacaaagtcttatcccactaggtgaggtcagttacatgaatcacataacgtcattcgacaaaattaaaatcaaagtttcagaactattattaagccttagatctcctttggtgatttcctccaacgtcctttttggtttccctcttctccttttccctaatctaaaaatcatacaatttactcttctaactagcacctttggaggccttctttgtacatgcccaaaccaccttaacaggttttatattgctactgttacatcataacaatataaaatttgataactgtggaatttttttcaatggattagattattcagcttgtctttgtcctgattaacttataaggccatttgcaatgaaaattttattcatagtagttgccaggttaacttttccttgcatttgtgtacaggttaaattttttaattgattttttatattaatctcttaaattatgatagattggttacccgagtttcagtcagtattacagattaggcttgctgaaaatttatattcttctaacttgattagctcaaacgaatttttcttagccttgggtgaacggatagagttttcaggttaaatgtaaactgtcaactgcacgttcatatttccaacctaaattaattttctgttagtctaattgttgggggattttgtcccaataatggctaaaaaataattcttattataatctgctgctatataattccacatgtgcttcagattttatgacagaatatctcttagaaaggtgaataatatcacttaacattgatgcaaaatcttaataatttatgtttcagcatccagttgccactggtattatgttctacatgtaactaaaatttggtacctttctttcttgttgtctggtctgttttattttcttcagttttaatgtctccatagaaaagtaatatgtccctggaaaacaatttaatttgattcctcatatttgtttgttaaattcttctgataggaacataaactaaaggatattggaccaaacaattggcacaaagcctgttttgtgccaacaaagtcagacgcccttgttattggttatagaacatggctaaggaagtatgcagatggtcaggttgattggagaggaaaatatagtggagctcttcctccaacacctccgagagaacagcttttagacaggtactcatttaagattgctcttgaacatggaagtttcaatatagttataaatagattggccatttcctttaattcagggaagagttacaaagagttagtattcgttttggtcctcggaagtggcaacttgtgttgcttaggtccctgaaaaatctatacagattagtctttggagggatagaattatttacaagcttaaaagggtaaaattgttaacaagttgacacattcaatgatcaatttgtgtagataggcactttcaaggactaaagcaacacaagttgttttgttgctttaagggaccaaattctatattaaatcaagcataaatctttaatgaagtccaccataatcaagaattttatcaatctaaaattcttagccaatggagaaagaaaaagttgttctgtactcctgtaactacaacgtaatcagcagagagaaattccatgctttaatgtgtgtttcacaaaagcagcttgatacctctgactttgagtatatatttttttttcctaaataattgaacaaaggcaagtaatcacaaaaacgaatttatgtcgtaatttgggtttcaatgttgcatctctatatctaacgaggtttcactaacatgcttgcatatgtactaataaacaatttttgaaaaattttgttttgggattgttgattacaaattaatttgagcaggtactggtcccatgtggtgaattgcaagagttgcaattctgcttataagagcctgaatgcggttgaagtaatgctgcagatcatatctgttgcttcaattgggattgttgccgtcatgaagcatggtacaatgtcagtggcaaaaagaaattcaatggttgccttagcagtactatcatttgcactgtcacggtggttagctcacttcatatacaaaaacttccgttatcatgactacgagcatgccttccgctgaaatgtgttttccatagttcttcatgtctaaatatgtgtatagactatagtgaaggtccactagaataaagtcactggcactttatttgactttttaaattttaaaagttaattcatctatgacaagtattcacaacctcttcatacagaggacaaataggttgatatcaatctcatgtaaatctaatttacattgtccgacataaaatgagtagaattgtagaaatattgcatctagttatgaacgtaaagtttgtgatcttttcccttttatatatgtatagacactaacacacaaacagatagataatgatatggctattataagttagtacttgtagttcttaacaaaacacagagacacctgtaaattagttggatggtacttgacttgatgcccaatagtcaagacggcagagaccaaaattctcggctttcgtcataaaatcaattcctaaatccaattaataagaggtgaatttgtttaaacttatttcttggaaaaatatttattttaatgaaataagtactttttttttgttttttaaattttttgtataaattacttttgcttaaaaaaatttaatttttgcttattttgataaacagatcctatatgcttatcttaaaactatttttttaagtctgaacaaaccagtccaatattagtatttgtcaataagaaattttcaaaattaacttcatgattcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattttcggacataacgagtaactaacctgaataactaatgtgtgaacgaagaaaaggcaacaacaaataggaaaaaaaaagtgaagtgaagttttatgttttcttttatggctttgtgccatttggtttattatacttgttttatgttggtgtattaaattttaaaaattttattttgataattttttttaatttctgctactaaaattaatgtgtcattaatttttaaaaatgagtaattaaaataatgacgattacaaaatgatatgtattaattatctatttttttaacttttgtcattttttctacaaatttcataacaaccagaagataaacaatataatatagtaataacatacattataaacattagattttgaaggtgataagaaatttaggatctcatgttgcaatgaaaattttgagttttgcttccatttttggtttcatgactgtcattattttaatctaaaacattaaaataaaacttttaaaatttatcgtaacaattttttttaaaaaaaataaaaataaaaaaccaatgaacatagtaaacaaaagtaacatttaatcttggtttttatgacaagtgaagtgaagtaagtaacactctaacattacacagcactgaatgactcggcatcagattcagatcctccgtcgccatcacccctaacctgtagcccataaactaacaccgccacctctttctcttcctcaccttcagatctcaaaaaatgaaggactcaaactccagcaacagtagcagaaccgaacccatagcccaaaacatcatcaaactcattagcaacctcttcttctccgtcttcgtcttctctgtcttaatcttcaccgtcatagccataacctaccagcccccagacccatggctcgagtccaccccagccctaactaacctcttcacccaatcacaaaacgccactttccgaatcgactcctccgtcctcaaaaccggcgaagacctcgctccctcgccgcaagaccctcccctcccacctccgccaccctcatccgccgccgtcaccgaagccgtcatcgagaaaaccgaacagcaaattgccaagtccaccgttaattccaccgccgactccaccgacgcggcgcttccttctccccccgcctgcgacggaaccctaaactgctccaaccctcgcgttcgtattgctattcagagattcaacctccgcgcgttcaagtccattgccttcttcgactaccagcctccggtgaacggctccgtcgccggcgagtgcgacgtcgcgtggcgcttccggaacaagcgcgagcgctcctggcgcaagtaccgcgactttcgccgcttcaagatcgctgtcaccgacgactgcaggtacaaggtggtgcacgccggcggctggcactctggcgccaatgctcgccggaatatgacgcgctccggcgccgccaggggtggtcggaccctgccgccgcgggcttcagcccgcgatgatgagatcaatgacacgattccgactttgggatcggagactaattttaggaatgggaagtatttgtattactcgagaggtggggattactgcaagggaatgaatcattatttgtggagtttcttgtgtggattgggggaagctatgtttttaaacaggacttttgttatggatttgagtgtttgtttggcttcaacttataaccctagtaacaaggatgaggaggggaaggattttaggtactacttcgatttcgagcatttgaaggagacggcttcgattgtggaggaaggtgagtttttgagggattggaagaagtgggataaaacgcatttgaagaagaagattcctgttaggaaggttgtcaatcacaaggtgactcctatgcagcttaagaaggataagagtacgattatatggaggcagtttgatgcgcctgagcctgaaaattattggtatagggtttgtgaaggtgaggctgctaagaatattcagaggccttggcatgctgtgtggaaatccaagaggttgatgaatattgttactgagattagtggaaggttggactgggattttgacgccgttcatgtggttcggggagagaaagcccagaacaaggagttgtggcctcatttggattatgatacgtcgccggatgttcttgttgagaagcttaaagggatggttcagccttggaggcatttgtacattgccaccaatgagccttattataattactttgataagttgaggtcaaattacaaggtgcatttgcttgatgactataaggagctgtggggaaatacaagtgagtggtataacgagaccacacttatcaacaatggaaagcctgttgagtttgatgggtacatgaaagttgcagtggatacagaggtcttttaccgtggaaagacatgcgtggaaacgttctataatttgactaaagattgcaaggatggagttaatacatgctgatcaggttggcactactgatttggatgctttttcagaatacatggtacactcgggccttgcttttggattcagtttcagattcataccattgggttagatatgagcttggtattgtacttgcttgttcttttattatattgatgatttatgttgattatcatgattttgtatacatactatagaatccctttctaccctctttcctttctgttgactcaagctgctaaaaatccattctcgtattctttcattctcttttctcatttgaataccaaattgaaaattaagaagagtttttgctgaagcctttaagactctatttgtctatgaccttcagatttgggtaatggctctgctttataaattttccaagttatatagtatagtgaaatactaaaatatattcaatgaatgctcacatagtcacattattccgtctttaaatacattgttgccctgatgaacttccaacataactttttgacctcaatcctacgtaaaagttctgcataaccctaatttgtgtaccccaattctaagttctaacttcatctatctatatttccttcacttctgtatttatgtatttggaataacttatcctttttgactcctaggaatacccattttagtcgcagacttcactccatgccacggtccactgatgacactactttgagttcattcttataccttgaggatcttttttaggcaatctatatgaaaccgttggttggatgaatctttttttccttgcacatgacttgtcaacatccccacaaaggtatgttttattgagattacaaattaatctaaatgtattccttttaatgtgtggcacctctaatttggtgccacctctagttcatgtttctgcagaaacaaaaattttcaaattagagacatagccgtgttttagaaaatgaaattggtcgagattccttcctcatcattcgtgtttaaattctgctcgtttgataacttcacttttctgattttatgatagtgattagttgtactctgattttctgattaacttcacataccttaaaaacaacaatccaaacagattttatgcatgatgtccagtacgacacacatagttggtgttaacctcctcactacacagtgctttctagtatttttcaaaccattgcattcgtgtgccccaaacaactattgcgttaagatgcgatagaattattataacaaaagaaacaacgaaagataaggtttcttttattttcgatcctaaagatgttggcatggcaagggtcaaggcaagatacgacggtatgaaagagaaacatcataatcaagttggttctcagtaagcaaactgcaaatttgaaattgagctaatataacggacaaaagctttaacgtactatggcttaaatactcgaattttgctttatcaatgaacgtattttattcactcaccatactttgctttatcctttaacattgtttggcttaaatacatgtatcgtttttatcaaatggggtaaagttgataatactcgttccagtttatataaattatttagctgataacgtactattatctgaaaggtcaataagcaccaaaaacccaaatcaagaacaaattgaatttgagacggcaagtgagggaaatagaaaccatgttaattgtatatcatgctacaatttatagaagaatgaaaaaaagatcaaaacccaatgtcaagagtgtcactaggatcactacaaataagtgactttcagtcattcagactattcatcctcctggctgcgtaatctggccgttttgtttgtcacaacaacatcaagttgcgcggctctctcaactatatcttttctctttcttgtggatatattgtgggcaatctcagcacagtaagtcctaaaataaagacaaataaagtggtcaggaaacattagatgcaaaatgatcagaattgaaatactaattgggacacaacgttcacctgttgtgcatcatgagcagttccaagtccttcacattgtgaacaacaaatttcttaaaaccattaggaagatagtggcgggtcttcttgtctgaaccataaccaatgtttggcatcagagtgcatcccttgaactttctcctaacacgggaatctataccctttggcctacgccagtttgtctgttgaataaaaaaatagaaggttattagttatagaccctagtataataatttcatagacaagaacaatttgatctgcaatctcagccgaaagatggtgatattaggataataatcacagacaatcagcacattattgaaatgtcatcacagattgcagatcagactattttctggtaaaacaaaaagtattcttaactacatgtgcaagaaaagtattaataaaatgaaaacgatttttgagatcaacataaaggtattcaagagatgtaaacaggaaaatagtaacagaaagcttatagtagtaaagaaagccaactgtgtcgcaaggcctgtaaaaattctatatatgcccttaaaacgagatgtcaagctacagctagacaagagtccaaagtctggacatcagataccatgggcaaataaattaacaaataaattcttaatttaagcaacttaaagataataagttataatcactaaataatcaaacaaaattactcaaccgtatgaaaaggatggcagagatcagatggtagtgcatgttagtaatcatcattctattgcagaattgatggataaagatcatcatatctctttacaatcgcatttcataatatacaaataacaaatttaagtggaaatttattcagattgaaaagaaattactaggcaagccaatcaatgcatattaattaaaggatcagacaattaattttcaccagagtgcaccaatggagcaagtaagactgggtgtccaaaaagttaccatcaaatcccatgctcaaattaaaacaaaaaacaaaggaaaactgtggcaaacaggaaacaaatcaacatcaataaaaaccaaacaaagcaccaacaaaagtacaacacaaatcatatatgggatcagatagtcgatctctcatcacatataaaaaatatagtaagactgggtgtcaaatttatcctcctatcccatcggtccaaaacaattgagacttaaagaagcaaattcaaataaaattgacaaaaaaataacaggttgaaataatacagcagaatcagataaaatgtcaatcaccatcttacaccttgtggtgcaaattaagactggggcgacaaagtaatatcatcatatccttaaaaagcagcaagctactacgacgaaacgcatatcaaacaattaactaaaccgaaaataaaaataaaaaagctcaacagctatatgcaacacaaaacaaagtgtaaaatcacaaaattactcatccaaacgatacatcttaaattaatcagaatgaagaggctaaaatgtatactaccttgacggaaattttcctgtcactctgaggcctcttgaacttcttgaccctcttcttcacgatcttcttcgagagtagaggtaccgccattttctcttaagtgtcttgagatgagggtgggaatagagtagtagtatatataggcgctgcggcgtctagggtttttatctcaccataacggagtgcgtctattctagggttttttggatagggtttgtttggatggaggtaaaggtaaatgggttgggccaaaccgggcttaggagtaaagaagtccaaccaagtaaacagtgataagttttaattggcccagatcattcaatactttcacttattcctttttttagagtaaactcagtaaagtaatttttttctaaaatattttcttttcattttgtgactttcttttatatttttcatattttgaaatttgagtaattttttgtgtgtagaaaatatttttttagttctttaaataattatgacctaatgaaatatttgtcatccttcaaacaattttgatataaatttattgacttaaatatatttttaatctcttaaatatgaaaatatacctattttaaccctttaaattaaaagttgtttttttttagttctttaaattgaaaaatacatttttagcccttctctataataatattaaataattaataattttgtagtcatttttagttgtcaaaatttaattttataatttaaattttaaaatataatttatgtgaggttaaaaccaccactaattggaatatatcatcaaacatatagaggaaaagattttcgcaacttcctcgatctcaacaactttggcacatctatcagcttgtagattggagaagaaattttcgatattttactatattatgctctacttacctggtggaataggaaaagtgtttttgtgttttgcaagtgtggggacatgttgtggcgttttgataaatatttataataagattcatctagttatattggttgcatatctaattttgcaggtgatttgtagtgcagtggcgagggggcttagtgctccgcgttgtaaatatcctgttttaataaaaggaataataagattaaaatggtcatttactcagtagatatatttattttcccttattttatttcttatcaactaaccttaattcaaaaaattcattctaccctcatctaatttaatcatatttcttttatttattttttctcacctattctcctttctttcctcctcacaatcaaataatttcttagaatcatcacagaaaatatcaccttatttcaaaatgaattgacgtaggacaggaaaatagttagagtattttttggatgaataccattttttttatgaaaaaaaaaatagctggagttcaaataaaagtatcatgtatctctaggttgcacccagaaatataaggagtttttaatagacaagcagtatcaatttttatattattaaccaaaaaaaatttacttttaaattataaaagcagtgaaaaaactttatggggaatgcattatttaggaattatgaataaagaaattgaaagttgcatttattcacgcacgggaatgatgcagatgtgatgttgtccggttgtaataactttactgggcagtgtttgggacagtaaagtgagtgagactttgcacactgttgttgcctctccctttcttcgccaactctttcacattccttccttttcccaacaccttcacattgcaacctaaaaatctctcaattcaacggtttccgctttcagggttttagcttttgctacgtgttggtgtggtgaatgcactttcttttctgcgcgttccacctctctcagctagtgttcagtgttcattatacccacaacagaagagtagctactcaacacaagctctttcggggtttttaagaaagatcaggtgcacagtccgcgcttctattcctttctttctaaacccctctatgagggttaggttattatgcttttttttgtactaaaagaggaatacacgcttctctctcttctccattttaagaaaaaatgtctataaacggcaaatcttttagtatttatttatttatttttgttttaactgggccttgaggtgtaccatgtactacctatttggaaagcttgttgaatatggcactgttcttactagatttgatttctgtgaacatcaattttatgtaagagtagatattgttcattaatgtttcatccaactagtggacttcgtttaattatctgtctgtgttatgttggtcatttattgctcaaaatgtgatttcgtgtttattgctcaagttttcagctaaggctttgctggacagcaacattgggctgaaattgctgattcactcaggtgatattggatgtgatgaagcttaaaacatggcttgcgagagttttgttgctcactattgctgtgcttaccactacattaggtaatttataccttcttttttttccatatttgtggtgaatatctgaaattgagttttcaaatttctttgttctcacgatcagtctacatactgtatagtctagactgcttttgcagttacaccgtgtgtcaattaaatttggatcaaaagtgtattaaaatgaaattgctgataggtgacagccttgccaatagtcatgcattcataaaaaaaattggcctaaatagagtgaaacttatcctggaaatggcattggctttgtcagattggatttatgtagtttatgttgcctcctcctggactccttatgctttggtacttttcattgtctatcagattctgactgtaaagtcactagtgctgcaagctgactgccgagtggaccgagtctcttgtgcttgcatgtgcatttattatttattaagtacaattgatgaggtgtttcatgtattattggattgggtttgatagttgcaagcaagtattttacagtcaaaactattgcttttcttacataattataatgaccatatgtcttgtacgttggtcagcctgtttatttttctatacctgttatgattaccacaaggggaagcaattagggatgtggatgtatgagtatgacattgactgtctattatctttttgagttgatggcttgatgctagatcaaattgtttaacttgtaggtgcctttgtgggggtaaacattggcactgatgcttctgatctgccatctgcttcaaatatagttgacattctacaagctaatcaaattactcatgtgcgtctgtatgatgctaacgcacacttactacaagctctttcaaacactagcattgaagtaattgttggtgtcaccaatgaggaggtactgaggattggagaatctccgtcagcagctgcagcctggattaataaaaatgttgttgcttatgtcccgtccaccaatatcacaggaatggcagttggcagtgaggttctttccactatcgcaaatgtcgcccctgttctggttcctgccatgaattctcttcacaaagccctggttgctgcaaaccttaacttccgggtcaaagtttcaactccccagtctatggacattatccctaagccttttcctccttccactgccacctttaactcttcatggaactctactatctatcaactccttcagtttctgaagaacacaaattcctcctacatgttaaatgcctacccttattatggatacactaaaggagatggtattttccctattgaatatgctcttttccaacctcttccttccgtgaagcaaattgttgacccaaacactctatttcattataacagtatgtttgatgctatggtggatgctacctactactctatagaagccttaaatttcaataatatacccattgttgtcacagagactggctggccgtcgtttggtggagctaatgaaccagatgctactgaagaaaacgctgagctctacattaataatatgattcagcgggtcatgaatgattcaggttctcctagtcagccaaacatagccattaatacatacatatatgaattgtttaatgaagacaagaggaatgggcctgtatcagaaaaaagttggggcatcttttataccaatggtagtactgtttatccattgaggtttggtgcttccgatccgattgctggaaattcttcagcagttttttgtgtggctaaagatggagcagacaccgataagctgcaatctggactgagctgggcatgtggacaaggaggagcaaattgtgctgcaattcaacaggggcagccatgttatctccccaataatgtgaaaagccatgcctcttatgcttataatgattattatcagagaaagcatagcagtggtggaacttgtgactttgatggtaccgctacaattactaccaaggatcctagtaagtcgatatgacttcttatttctgttttaaccttgatattctgatatgggacgcttgtaacacttcaagttatttctttggactattactcatgtaaccattttttatttcaaattgcgtactaactgttgtaggaaatttcccacaatccctccttgttagaaacaggaaaacagcccctggagagtaaatcatatatttgaaagtcattggtcgttgttagaaagcaattacagttataaaaactattcaagttataagcatataccaatgtgcttttcaaattacacaatgacacatctatggcttcactaaaagttgaatttgaataaatacatctaattcctcccacaaaacatggctggatgataaaataatggattcgtagtgtctttggttggtgatcatgtccctatttggcatattagcagggcaagaaagcagttgcagttttttttgatttgaacctgaagatcatgtttagtcaaaaaaatattagttacattacatcgtttagttacttaaccaattaattctgtgtactttgttgcaggttcttcatcctgtatatttgctggaaggtatagaatcttaatctttatacatccttgatttattagacttagaagtagtaattgtgaccttttaaatttcttatatgatcatggaatattttgacagcagttctaactcgagcactggtggattgagtttacctccaatggcacttggaccttcaggcccctttggtgcgagtatgaacatgcaagtgtctagccttaactatttgatatcagctattggtgtatttttggctctggcggtgttatgaccacaaggtcgatgctctttaaattgcaattcaatgattcgtgtaatgtggtcctatcgattttgtatctagcttttcttgggtccaatttattcttcagagatgtcccatcttctgcatttggggtcattgtaatttatcacacttttaagatagttatttaatgtagtgctttagccatcagaggagactaacctaatacggggcccttaagaaatgactgccagcttctcgaaccaacaaattatgcacttgttgtgatcataaaaaattagagtagcatacaatttatttgaactattaataagaaaaggtgtgttcagttgaacaattaagaaaaattagcatgagatctatgaaatattcagtagcttatactatatatttatatggatggaactacgaagagtttgtaagtacgaacatacgggtgaataatttttctttaccataaaataatattaatattcatgttgtcttctttaaagtctaatttaaaattggtaattattttttatgaattttttttctaactcaatgatggcagcttacaaggcattcagtgcgggtaattgagtctcaatgttttttagtaggctattttcatcaatctttgtttcctttctgtttgctgcttctcctttccgaacaacagtcgtgaattacctatttatggccgatttatttatttacaaaattaatcatataaaatcaatatttttttttataaaaatcttggaagcaaggatagtgaaaaatttatttacaaatttgaaaaaagagggataagaagagtaaagatattattcaagatagatgtatcaaggatgaaaataaaaaaaaacttttggtaaggaatgaagatgtaagtaaaagatgtttaaactactttagtaaattttttaatgagaatgacgacaagagtgaggtggatttggaagatattttttatagtagaagatttgtatgcataattaatacacatgaagttaaggagactttaaagaggatgaataataataaaactttgggacccgattacgtccatattgaagtgtggagaaacttgagtgatgtgacaataaaatggttgatcaatatttttaataaaattcttcaaacaaataagatgtctgatgcttataagaaaaatatgtttgtgcttatttacaaaaataagaaaaatattcataattattctaactataaaggcatcaagctcgtgagtcatactatgaagttgtaggagagagttattgaacaacgcctaaggagggagaccaatgtttccttaaatcaatttgaatttatgccaagaagatataccatggaagttattttcttgatgcgacaattaatggaaaagtataggaagaagaataaagacttacatataggattcatagatcttgagaaaacgtatgataacgtcccaagaaaagtcttatggtagacaattgagaagaaaaatgtagcattaaagtatgttaatgcaatcaaggatatgtatgatggggctaccacatgtgtagaagcttgtaatggaacatcaaggtattttcctatcacggtaggtgtttactaaggttcagcttttagtccttatctctttaccttagtgatagatgaactgacaaaagatatttaagaaaaagtgtcgtaatgtatgtttttttgcagatgatattatgcttattgatgagatcaaatatgatgttaatagaaaactggaattgtagagaaacactttggagtctaaatgattcataataagcaagagcaagacggagtacatgaagtgtgagtttttgcgggtaagagatgatgatcaagacacagtgcaactacgtggtcaagaggtacccaaaaaagatgtttttagatacttgagatcaattttgcaaaaaggtggtgaagttgatgaaaatttaaataatagaatcatatcagagtggactaaatgaaggagtgcatcggagtttttgtgtaaccgcaaaattccccttaagctaaaaggaaaattctatagaataattgtaagaccgacaatgttttatgatgtggaatgctgaccagcacataagcaacatgtgcataaaatagggttagcagaaatgaggattgtaaggtggatgtgtgtttatacgaaaatggataagataagaaatgaatatattcgacgaaaggtaagagtaatatcggtgtgtgaaaagatgagggagtatagattaaggtggtttggacacaagacgaccactggatgattatgtaaaaacaagagtttgttaccaagagctcaacacaaagaaaggtagaggtagaagtcgaccgaaacttacctggggaaaagtaattaagcaagacctaatgaagtgagatatagattgatggagagttaaacccgttaatatttctatgttttttccttgttttttttttagttctttgtctctttattttttcctcctcctttcacccctcttttatgttagtttatttttcatatcttttgtcttcttttcactttttctttctctgtgtctttctctttctttgtcttattttttatttatcattgaatttatctatcactaaccataattaacttgagttaaaagtattattaatgttgatgttgattgcacaaactaaactaatatattaaataagaaataaaatactactacttaataagtgtcttaaatacttctaatttggataaaaaaataattgactaatagaaaggtcaaaggcttttattctttaatttaaatgtataaattattgtaaaatggaaaataaaacttgatatattaatttattttcataaataagtaattgaagtagggtcttgctaatcaatgtcaaaaaaattataatcaatacaattttgtgtatgttaataaaaatcttataaataatataattttatgcattttaatataatttttttaaatttcttaactgtactagtcagcatttttcatataagtattttattttgatagtaattttcagtaagcgtctctgacaagattagtgcagcaacaacaaacagcctttgggaaaccaacaccactaccgtgcaacagtcaaaagctgaagcgaaaataacaagtaatttgtctgattgtgaattgtgatgcgatcgaatcggagcatggagggaggcaacagaaatgggtacgcgtgggcagtatctgctggattcaacgccgctcttgcagccatttccgttaagctccctcttcaccaggttaggttaggttacattcagattcgccttctaattttcatattactgtaatttctctttcctttaattgaatcttagattagatatatatatatatatatatatatatatatatttatttatttattagtttgtcaggtacgggatggtgttattgttcaatgtcaccatgtgggcttgttatgtcaacagccttaaagctctctcctctcttcaggcaactgtcaccaatttcgctaccaattttatctcttccggtttagccggtttcttcttctttcacgaatcactctctttccaggtatactttctctgatcataatgttgttatgactatcgcttccaattaatacaccctctcaactttggttcatttttatacttttaacttgtctggaggttactccatttgcatctcatttttttttttttattagcaaatgttagaatgttagtttttgttagcagaggaatcaaatccttgcctttttcccccgtttcttctctcttaaccatctaacccacatgatcattttaaaccatctccaaaactatatgttttattattgattcttgttaatgattttagactcttcaatttcaacatttttgaactattatatctttcgtttgatcttggaaaccaaacactcttcccatcaactggaattgcttttggattataagaagtaatcaggttaacttccaaagtgcttcggagttttttaattgtggggatagtaattttggtgtcaccttaaattgagctgaaggaatccgggatgagtttttttttttttttttgtgtctttgatacaattttgcacatcaagtttatctttgggttttcattttcaaggggcgccaaactgatgatccttaatgttgttctgctttttagcactaacagagtagaggaccacttggtttttctgtctgttactgatgcttacagtgctaatgctaaatgactaaaccaccaaagaactcatggccccggttatttgcctcttacgcattcaccttattgattcatgcattttctgatgtataaactgttccacagtggtttgcaggtgccatacttataataattggtgtagtaatacttagcaactcaagtattgagaagaaggctagcactgattaggtgttacagttcaactcaataccttttaggcttgtttgttcaagacggaggctaacatctgcaactgcatggaagcaaaatttggacaagaacttggaaatatcaggaatagtaaagttagatagtttccagggcagttcaattgacatgaaacaaacacagcgaaaatcgcttcttgccttcactgatttaagaactcttgttatatatatgtcattcaggttgaggaattgttattagccacaagcaacttttggttccaccattctatggctacttttttaaatttctatttgtattgggatctcaaggttcaatatgctatatttatggatgtcgttcaaaagttacgtgcaactacaagttttcttgctgatcgaactagctctcctgcctatccatttctatgaattcagtcgttttagtaacaatgtaagtaggattttacatatgtgagagtattgctgcccatctaataactcagcatgacatgcgatacaccagtgctactggtgagatttctgcattagatgaccatgagatacaactacgagtgagatttgatggtaaaagagtgttatagattggatgtgactgatgaggctctattatatttgctacaagaggatgtcttttttgggataagatggaacacttttgagtctccacttcataaagcggtttgatttgaggtgtagagagatgaatgagataatgttgttaaatagcattaagggtgtcagtcaaactccttttggttagattttcctaaagcacaaaccaagacaattggtatttttttttataaatatttaaccactctaaattattcttatgttaatgtaaaaaaaaatgttcttctatttttaattaattaatatttaaaatatgataaagaaagtatcatcagccattcactgaatttattaaaagaatttctttaagatatccaaattccaaagccatatataataatcgagtaaattataattttacttcttgaaattatgagacgttgttataatagtctatgaaattagaaaaatgtttaatatatacttaaaattaaaattattgtcattttaatctggacatatacaagtaactatctttataatctattaattttataatttactttcattgtagtctctctaacaaagctagtgttaggatgaatatgtgactaacaaatttcaatttcgagaattcgtttgacatttttttaattttaaggatttttatgataatattttacgattttaaggactaaaattgtagtttagtttataatgaactatcatgatttatttaaccaaaaaaaatataattgtacaataacactagcatgatattttgctaaaaaaaattattaacaatatatttaaaaaggattttaaacatttaaaaaataatgcttttttattatgaatttaaatgaaatttaatgatgtaaaaataataggaagctaagtgagtggatgaaatgaaacctttgggtccttggcttgtgggaataggagagtgatgatgatatcaggaagtggaggaaaatcatcgtggagttcatcaacatcgtcatgggtacccacaacctcgcggcatcgggaaagaggattcagagggaaatggtcgaactcaacaacgaccctcctcctgattgctctgctggccccaagggcgataacctctatcactggattgccaccattattggaacccctggtagctgcgtaaccctattctattactattaccattactatcactatgaatatcatgtttataataggtttcttctttgcttgcaggaacaccctaccaaggtggcatatttttccttgacatcaaattcccaattgattatcccttcaagcctcccgaggtacatctctcacatacacttctttcaactaatccatttcatattttcttgtataagttgtttcaatttcacgtgtatttcgctcatatttgtttgttttatgactacatgtttggaccatgtcatgtcttaccaagcacctaggtcattcaagcagacagtacatatgacttgctccatcagcttattaattcaattttgcaaggccatggacttgtctttgtctgattgttatgtttcacattcagtataagggctcaatctgacacttgagccatgaggctctccgcccaaataggctagtcttttgggatggactctcgtttggggtttgagtcataattgatgtcaaaggtaacctgaaaaggagtgattagggaaatgcatacctgtactataagaatcagaataatagactagtctttttggatgagtttcctcacgggcttacttaaagtcaagactagggtagtgtcccttcaggaaaagcaaattgattataaggaccattcaactatgcaacacccttgtgcaaataaggatatgaagtgtaattcttggaaaatacataatcgaatgtttgtgtcactttttctttccaagatatataactactagatggtgtgttattgtatttaacaattttgatatgtattccaagatatgcagacaaaccagaaaatgtagagcggttgaagtactttcattgttttttaccgtcttaaattaaataattgagcttgcaggtagtattcaaaacacgcatttaccactgcaatgtagaccctgatggccgtgttagtgtgggaatgttgaaggatgattggagtccagcgctaacaattactaaggtgctactagctgttagatcaattttggcaaatcctgatccttgtaagttcttcccacctcttattttttccattttgtttatataaataggggttgatgatggtttgcatgttagttctattcttcagccttttgctttcaaatacagcagtagaggcagatcttgttatgtgccttgttttggagaagaagcacgttttaacaggacaccaactaatggtttatgtcttttgtcgctttggattcaattaacttagggggttgtttgatttgggaatacattttctgttttatttcttgtttttacaaataattaaaaaaaatgttaccttgttattgcttggtttctttttttaaaagatttgtataggaaacaatgacacttttaaaatttgttttgttttcattgtttcctatggaaatctttgaaaacaagaaattattcctacatcaacttcttacaatacttttaacaactaattttttctttctatctttcttcgtcatgcgactcatcttatctatcccatacttctcttctcttcctatctctttcctaatttgtaaaaaatgttgtggtagtagaaatctcctttccaaccatgtaatattagtgatgccaacactttcaatcaatataacaagtaggcatttatgatttatgatcttggagtgtaaagatgttatcattgttgcagataattatgctgttgtccctggcattgctcacttgtatttgggagacaaagcaaaacatgatgatattgctgcagagtggactgtccgatttgccaagtgaatgggatacaagtgccctttggttggcttacatcttatatataatgttccaatatttatgtaaatgagaatgatagttaatagaagtacgtagtaacaagcttatctcctccttgctcgctgttccagagagtgccttaattgattcgtcataattgtaagtggataatgataatcatgacatgctgtaaattattttcatagttcttgattttatttattttgttttattaagtttgtttatttaaccaaatttcaggaaacacgtcaaacattgttacttttagggattccaaagttattgagttatggatgctatttgacacagtttgatgatatctatgaacagcaagaatgatcatgtatttgagaagtatgaaatttagaactgttttcgaaagagccttgacatgcattgaaaatggtactgaattgacatttgggtggggtggatttttctgcaaatagttattgtgaaaaatccataggaaacttggtgagtttcttgtggatatagatctgtaaaaaatctgctggaaaattcaaagtttcttatagttttattttcacaggaaaaaccatatgttttgctaatgtcataagcaaagttgcaagaattttttatacagaaataatctgtacgaaattgataagatttttttagtaaaatgtactcgattatatggacatgatttcgaaaagttgcgataactatgttatttaattgtgacattattatttcaaacttattatttgattttagggttggaattaaaaatctagaatctgttaacttattatttcgagcatttggaaataaataccaaccagctagcttatgagtttaacttcctacatcagtgttttttctaatacacctaacatattttttttattttcaactttaccctcatatgaatcagcaattcgtatgagtcatatggattggcaatccataggactcttacggatcaataatccatatgactcatatggattggcaatccatatgacttctacggatcgataatccgtaggagtcatacggatcgacgatctgtaagaattgaatggtgtatgtcggtatgtaacttacggattttgaaaagggcaaaattgatattacattgtgcatgctgggtgtattagaaaattagctggtgtaaaaagttaaactcctaccttatttattatatattaacatatttgagttgattatttttttgtctttttctagatagacttttcttttcaacacgaaatatggtttgcataatgcatgtgtattttgatttagtggaacaagtttgcatgcatatgcctcctgacttgagcaaactatggatagtttgttgcttgaaaaaatcatggtataatttgagacaaacacctattatattggcaaattcacttaggataactatatttgggtaaaagtataagggatacagtgaaatattttttttcccatcatctctactatatatatagatctctaaatacgaatctnattgtcagttcgtggtaattctaaagaaatttctcttaataataaacaagactaattatacttgtatttcgtgagattcatagtatgctcgtgtttctatttaaaatggcgttcgatgctaatctaatactcccactgtgattaattataagacataatttattagtttatgattataatatattttttcaatttctataggagagagaaagaaataattcatgatattttaataaaaaaataattaatatataataggaatgaaataaaatcttgtaataaaggataaaaaaattatttgactaattcttataaatagaaataaactaataaaggaagtaatgtctttcatgtttatacttagaaagttaatactacttcttataagtaaaaaatgatgttatacgttgaatttaaatataaataaaattaattatttttgtcatatttaatgatattatttttaaaatatttttatttaattttaattttattttttcaatgacttttttattggtgataataaatttaaataaaaaatattttaaagcctaacaaccacccatcaaaaagagttaggtgacgtgagcgagcgcactccgtagtcaactttgggaactgaagctcaacaaccacccatcaaaagcctttaactttcaagttggaaactgctgcggagacacagagagagagagatggggaagagcgtgcgggatttgggagtggaggatttggtgaatgcaggaggcttaacagtgtcagaaggcaatgaattataccatgctttgagggatatcctctctgagtttcagtctccttcacacatatggcgccaaattgtcactcggagactgctcaaaccatcttaccctcactccttgcatcagcttctctactactctgtttatcactctcaacattcttccctcccactctattgcttcccttctctgtatctctctcttactatgccttatcacttaccactacctcaacacaaacgctaattcatctttcattttttgctttttgatttcagagagcaatccaaacacaccaacctgggccgtctcatggaaacccatgcccctgaccttttaggagcttcctacaaagaccctattactagttatcctctatttcacaagttttctgttcaacaccctcaggtaagcctactaccctcccacctctaattcccttttttattctagtattgtgttttcaacgtgtatcatttgtttgtgcagctttactggtcccttattctcaaggaactttcagtttcctttgttgaacctcccaagtgcattttagatacttccgacccttctaaacatggtgggacttggctccccggttctgtcctcaacattgccgattgctgtttgcaacccagttcacacccccacaaaacagatgacactttagccatcgtttggagagatgaaggtttcgatgattccgaggttaatcatatcacgcttaaacaactccggcaccaagtgatgtaagccattcaagttacactctcgtttttccacaaaagttatgttaattataggtagtctgatctcttgattttttctttaaattgtaacttgtgctaagtcagttatttaaatcatttaagagatatttttcaattgcatcattgcattgagttttgcactgttgattttgtgttaatgtatatcattttgatattctttgtttcggctcttttcctacttgtgtcttactttatatgatgattttttttttcctgttgttgccatatgatttccaggttggtagccaaagcaatagatgccacattctcaaggggagatgcaattgcaattgacatgcaaatgacagccaatgccgtaataatctatttagccattgtcctagcaggatgtgctgtggtctcaatagcggatagctttgcaccaaaagaaattgcaactcgactccgtgtttccaaagcaaagggtattttcacacaggtgatgtttcaattgtaaagcaagctactgttgattgaaatggaaccattcaatatttggaatgtctctgttctttcttacttatcatttgtgcaaataatactatttagtatgcttgaagcaatgctaacgttactaaatctttattatgttggagaataaatactgtcctttcaagttcccttggaagcttaagcatctatattaggcatttcttgaaggtttcaaatttaaatgcctggaactgaacacaaatattatcttcagaagcatgcatcttgtgttgttaaaaactccttttgcatatattagaagcttcaaatttatagcattggattagatacaagcatttatacaatcaatatctgataaatacctattactacagccgatgcgaatgagtagaaatataaagggacaggtagggccttactggattaatgatcacatgagcaagtgaagcgagggaattttttgtaagttgtaactgctagacaactggcagaggggaagaggaatagttagcattgaggaatatttgaaatctgttaaaaacagggaagagtgggaattgggaggaggctagtcccttgaagtgctagcctagttactttaatgttccgtttctgtaatctctggtttaattcccggtattgtgcaatattagacttaatttctatgaatctccaattattttagtaacaaattaagattgttgtattttactcaactttattttgttttcaggatttcatagcaagaggtggcaggaaattccctttgtacaggtaaacaattgttatcattacacccatagctacattttcagcagtttaacttctaaatactaaaattgtattttaaattagccaagggttctgatgcctgtgtctaatttatctgttcagattatggtaggcatgctaagtgtaatgcacacgtcaagcttatttcctgttatacttaacttttggaacaattggcaacttaaccttcattgtagttaggttatttcatattcatctgttgatccgtcctttgattaatgtttcaatactgtgtttttacttaatgtttctgattttaaattcaatgccatggtcgaaatgatggaaaaatgaagtgttgggattactgatattctatttattttgtatcagaaaaatcccagtgttagaatataagagttaatctgaaagtaagtgatgttaaatcatcaaagctatgttgtatttcaggacatgtttttctggaaccctgtttcctttttctcattttctattcacttatttttttgtgtatgtgagaaaaatagtgtcacaaatgactggtttcatcaatgaatttatttttctgttataaatagaaaattcatgttaaacccaaattcccaatcataataagtcttttgcacattaacaactcagatgctaactcaaaattctatatcataaatacgttactcttcttcatgctgatgtttgtgtagcattccatctaacctcttcctatcacatctcccaaatcctgcttgaatttaattattctacttgcaatgtctcatttcttatatgagtacttgtaataataaacatgaattagttcaatatcttacatgcatgctttctgatatgttgattattgttcctggtgctagttataatctctaaattatatctaaacagacctctttaatggtaacaaaagtaattaactgtggagtgagatgcaccaaaggtagaagccagctctccctttacttggttcactttaatatatactgattccccaacttatactgacttaaatgccctctcagattgctttgctgtccaagccttgtaaagatgaaatgtttcaaccttggtagtgctcatgtttgtatgtttgttaaatagatttatggctgttctttaagcacatagaccatgtttctccttgcagtcgagtcattgaggcggctacatgtaaagttattgtgctccctgtgatgggtgaagatgtaggagtacaattaagagaacaagacttgtcatggaaaagttttctctcttctgccaggtaattcatactgcaatgtcatcattaaacaatatcataatataaacaaatggtcatttttggtgactaaaataatcacttctttagatcccagaaatggaagagagaaaaaaggagacagaaaaagaaagagaagttgcatttttttcttgtgctttctctcatcttaacatttaactcttggcaggtcagatcattactctccaagctatcaatcagttgattctatcactaatatactattctcttctggaaccacaggtaaagatcctctcttagaatatatcagatagaaaataccattgtactgattttctggttatattttgactttcatcaggggatccaaaagctattccttggactcaacttgcaccaatacgaagtgctgctgatggatgggctgccattgatattaaacctggagatgtgtattgctggcctacaaacttaggatgggtgattggaccaacagtattgtatcattgctttctaactggtgcaactctggctttgtaccatgggtctcctcaaggtcgtgattttggaaaatttgttcaggtaaattccccaaaatcttatattattttttttttacatcttttctatattttaatcacctaaaaagttgggaccacacaccttaatgtaaatgctgattagtaattagtgacatcataattgccatggttgatgtgtattgtattctgcatcaatagagtttgatactttgcaccaaagcacaaccttattgaactacaattgttcaggatgcaggtgtcaccattttgggaacagttccaagcttagtaaaagcttggaagagtacgcaatgtatggagggcttggattggacaaagataaagtaatatctgtcagtagtgtaaataatcaagttgctactaagaaaaatgaactgaactatggttatatgcagaacattttgttcctctggagaaacatcaaatgttgatgatgatctatggctttcttcaaaagcttattacagtccaattgttgaattgtgtggaggcactgagcttgcatctagctacattgcaggaagtccgttgcagcctcaagcttttggagcatttagcacagcatcaatgacaactggttttgtcatttttgacgaaaatggagttccttatgtaagaaaattttctggatagtttgagttctttggtgatgatttttatttacttatgctgccacttgtgacagcattacatcataccatatctgggtgcaattttgttgtttgcagtgtggctctgtctattcttctcctctcttcaattcttttaagatttcatactcttcccaattgagttgtttgcattttcactagcagatgtccaaactattaactatccaataaatttaaccatcttatcttcatatctatgggcttagataaattataatttaggttttctaatttatttgatctctttgcctaatatgacagccagatgatgttgcttgtgttggggaagtgggcttattccctctctctctgggagcatctgacagattgcttaatgctgatcatgagaaggtttactttaagggaatgcccatttataaggggaaggtagaacttcaattaatatgcttagaatggttttcacacttagatacaactatcttcaaatattaattctttcatgtgtgaaggataccatttctcctctgatctggaagtatgttgtgattacttatatgctagaggctttttttgatggccctgtttcataagcacttgtcttcatgcacaattaacaaattacaaactgaaaattaaaactaattagagtgaaaatataggaacatctttcattctgaactttgtctgttttatagttggttatcaaatgccgccaagacccatgcaagcttttgatgtccaaaatactgtaaatccgtatgatctcgattaaagatttttaaataatcccttctttgtaaactacataataatagaataaactaaatttgtaattttaactactcattctattactatggttataatttgtcatgtctaattgtctatcattgtaaatttattaacagattcttaggaggcatggagatataataaaaagaacagttgacggatatatcattgtgcaagggagggctgatgacaccatgaatcttggtggaataaaggtatcattattacatggaaacagctgaattagaagctaatcaggaatttcgaagattctgatagtaatcaaagctatcaaccagggaagcagtagaagaatatagctctgatgaccaaagaaaaaacggaagagtgtagaaaaaaaataaaaaagagaaaatttttcattccttgattcacgatatctgatcaactttccatttgtaaaggtgcaacataaattacaagaaaaaaagaaacaaaaaaagataaaccataaccaacactgctacacttgactatgtgctacaatcgttccagcttaacaatccattccagcttggcaacaattagaaacactgaaaacaactgtaataactttctgttaagaaaagaaaatttaactaatcactccagtcagtgtagaactagaagggggaattactatgggtgaagtaatgtgaaatgatggtcctaggatgggggatgaagcttttgaaggataggtctgcatgttagacttaatagtgtgagaatactatatctttcatgtccatggtctgcataaacttggtaagaatggaagatactcttaactgatgttcttcagaaattcttaaaatcatttaagaatgctttatcttccattcttacacatatggtgtaagaattctatcatagctttcatgtccatgatctacaagtacaacttagtaagtaatactctctaactgatcatagatatatcagatattctaaaactcacatgattgttgctcttattttgccattcctggactcgttttaacttttaaccttgaaatttctgtttctgatatgcagacaagttctgtagaaattgagcgtgtctgtgatggagcggatgaatgcattttggagacagctgccattggtgttgcgattgcaaatagaggcccagaacaactggttatatttgtagttttaaaggaaggatacaattcaagtgcagaaactctaaagatgaaattcactaaagctattcaaagcaaccttaaccctttgtttaaggtctgactcttagttggttttaaacaatattgaattggttgtggtttattaatttgtgaaaactgacatgacttgggatgatacgatacagttcactaatacattcacaaactcttttcattacataacaggtaagccttgttaaaattgtgccagactttcctcgaacatcttccaacaaaatactgaggagagtaatgagggatcaaatgaagcgtgagctatcagttcagagcagactttagtgaaaccattaattctcaaaagatcagcgcctagcagactcccaacattcagcatcttcatgtggaaaaataagtgaaggattatttggtttgagggatgaacatgatagatagtccttggaattggtatgcagattttcactgtaatatagcataggctatttattagctgaagtccttggtgtgtaatcaaaggcaaaagctaagaaaagaagtactaccggtggtgggtgaaaatataagagatgtaagaatataaatatttttaagtacatgtagcaaaaaatacgtatatctgggtgattttcaatgctctatacgcaattcacctttatacaataaaaataaagtctttcttttctttaaaatgaagacattttttttccatagatacatgattttatcattattcaatatttttagttaggttaaattattaattacttatacatttttttacatgaatttttttaatgcatgcttttaaaagatgatatattttttattgaggaattgaagaaagaggttaactcaaaactttagttccaaagatggacattgttagcaaaagtttttcccttgagttaaagtaaaaagattatgtgcatcgactttttagcaagaaacaagaggaaagagatttagaagtaaacatttgagatgtgatatcgcatgtttctaatttaagtaatttcagatcaatattacaaaattatgcaaaaattaatgacgccgtactaaagacaagctaggtaattaaaatagaaaaagacatcggaggttattggtgactaaaaaatatctaccaagttaaaaaaatgaagttttagtgtactattaaagattagtagagggtgcaaaaaaagtattacacaacagaaaaaatttgttttggttgtgtatagaccctcaactacacaataacagagatacaaactttgggggttgaaaaagcaatgaggggttgcgaatagtaaagtccacttggcagccttgacaaaaaaaacacaaatcatgaaagagattttcttcctgcaccattcaaaactcagagagtaccgtagttaccagaagtgacactgtgacagagtgacgaggagaagaaaggcaactacacacatacacacccctacttaactcgtttcagtggatagcgctcactatttcggaaccccaaaacaaagaaagtaaaggttcatttagttaaactttgggttatcccgtgtgttttgactcctgagcaccagctgtttgataaaataatccaaccattagtttccatttcttttaatttaatgttttcctaacttctctgtttctttgctcgataatgttctgacactcttctcctgtgtgacgctgctgaacagagagagagactcctcattcaagataaatagatgaatttccgttgacaacgttgtgaagttatgaaaatgttgtttcttcaaaccactgtcttacctagacccttctcacctttttgtgatgctagtttgcatccattgtcatcacttaacattcaaaatcctatgttggaatgtgctcacagcttttctcattattcccctgtatctagccaccgcattgtaaagtccatatcatgctctgtttctagaaagtctcattcaaaacccgatcctgaacctccggaacctgaagctagttcgaaccaaagagcaaggcctaaggcaagaagcagaagtggccaatctaaagatgtggtatccagcaatggtgataaaagttcagcagagacattccccactacgattcccaggaagccgaagcgtggtcgcagaagtgaagccgtggcagtggaagattttgtacgcgattcgctcgagcgcacgtttgctgcaattcgggaacaaaacaaggatgctttggagaatcatgagaacataatgaaggagagggatgatgacagttctaaatctgaaagtggtgataaggacgatgtcaatgatgatgaagaggaagatggcggtgaaggcttaagaaataagatggtgattgaggaagagagtaaaagctggcctttggatgcagatgttgggtggggaataagagcttccgagtattttgagcagcatccaatcaagaatgtggtgggagaagatgggtatgaaattgactgggaaggggagattgatgacaactgggtgcaagagatcaactgtttggagtgggagagttttgctttccatcccagccctttaattgtccttgtctttgaacgctataacaggtaatttctactgttttgggttttacttgaaatgctttttgggtatggatttgctggagctaaagagaatagaattattggtaatacttaagacaagagtgggatggaacaaatggtaaaactgaatgagatggtaaaaacttctcaacagcactcttaagagaagaaaataaaatggacatgggagaaaatgaatcaaacttcttaagttatgttcttcaacttttttagaagcttccttttttaacttctctgagtactgataaacctaatagcgctcagcacctatacttcccttatcatagacagcatttggaaacatggggtgggacaacttgctggttggttaactttggatactttttctccacatgcatttgaattggggcccaagaaaacagttttcacatttgatttgattttctttttccccgattgaaattatagaagtaaaactgaactttctttcagaagtgagaaattgtatgtatccatttttagtttataatttgattctcgtctctaatgaagtttcttcttctatacacaaaattcaattttttgaaaggttttctgctggcaatggtttgctatacctacttcttttaagatgtcatttcttcacagaagataattttggtttattcagaggcacgtgataatgcacatgagtgtggaaatgcataaaaaaattgtatttcgataagaaattctgtatttaattaaatgtttctttttgtttgtaaaaattgaatatagaaaatgccacatcggatatataatgaatgatacgttggtagcgatttcaaataatgttagctatttatagctaattttaacctctagtttggtgtttgattttgttttttccacagggcatctgataactggaaaaatttgaaagagttagagaaagcagtaaaggtatattggagagctaaagatcggttgcctccccgggtacgatcatttttctatttcatgtgataaaactgcactttcatctatttatacatgcctaaactgaaaagaatgatgttgctttccatcaatgcaaatcttccttctgattaaccacttgttagatttataaaattatattttctgttatttaattatcactatacaaatgttacaagtggtactattttagaataccgtgtaacatattgaatttcctatttataggcggttaagatagatatcaatatcgagagagatttggcttatgccctgaaagttagagaatgtcctcaaattttatttttaaggggtcacagggtcgtgtacagggagaaaggtgagatcattgatctttctcttccctttttttatgtataccagagttttgtttggttggtacaaagaaatgcacattctctttgtctaggctcttcttttataatgatgcactgttacttgtacctttgcagaactccgaactgcggatgagctggttcagatgattgcatttttctattacaatgcaaagaagcctgcgtggatagatgataaggccttgtatactcgttattaatcttcaagaatgtcatatagcccttggacaacctgaagattgcgtgtctttgtaatgaaacaaacaaaattgacagcaattgttttatgtataaaaaatataaagtactgaataaaagttaaaacaatcgagcactaccaaatttagaaattttaagtggaatagtgagtatacatattcattgttttatcttctacgcattagctatggagttcgaagtcccttgagtaaatggtctatacactaataatataaaattatgttataatttaatcataaaaaatatcatatatgataaatttattatttttacaacaattgttttaaacgtcacatgtagcatatttttcatcgattaataatgtagaagtttctgcacaagtatggaagttaaactcagaattttttggttttttaaaattgtagaattatattttgtgaatagccattcacaagaaacgttcgactctagctccactcattggtcataaatcataatcattagtattccttggtggggtggtcctcttggctttcaagcgatgcatataactgaatatggtgatgtttatggaactaaaaaataatattaataaaaacaaacaaggagtggcttatttgttttggattctattctaagcaggctttgaaggaaacatacaatttattctctttcttttacgccaattttcgttcaaaaagaatctttaacaaataaatttaaaacattggaaaacaatgtgatctttatttaatacttttgtttacatcttcttaatcattcataacaaattattaaaaatatacaacgtcttcattaaaaaaatataaattcaaacataaaaaagtgttgttatgctgccaccttcgccaacagagtgatgggtgtggtttacaagttgcaatgcccgtctagatccaaatttggtgttacatatatcgcgaagattgaatcttaaatgttttaccttgagactcatttggctttagaataagatacatttcattctctttaaaaccttgtatataattaaaatttgaaacatgtttatttattttttgtccttaattaaagaccgaacgaaaccaagcttttcacattaaaacacaaaggagtgcaaaaaggtgggaaggggacaaaagtttgatgtgataatcgccattcaacgacaaatcctaagggagaatttggtatttttgagcttccacgagttttatatccacagcagaaccaaccaattccacaagttggcacctctcatggaatcacatgtcctcgtgtggagcaccaacattagataatagatacagcaaatgtccttcatgcattccttattttactcttgtaatcaggaactgaaccagaaaaaaatgataggaggggaaaaatgacattataaattttatttattttataaaattaaggatgaatggagagtttttaaattttgattttctgatagaacatattaagagaacttattattttaggggggcaattgccccattttcttaaacctgggtcggtctctacttataatccgtatcctattgtcgttcacatgattattatgcatagcaaatgcatgcaaatttggaaagctccatgccaatatttaatcggtaattgctaataaaatactactatagtggagaagttttttttattagtaggaataaaaaataattattaaaaaatttacaataaatcaataatttacttattttatttaatcacttgagctagaatttcttaatataatgaatatgatcgatgagtagagtattatagttgttaatttgctatattatcgaccataagctttcttggatacatcatccggtctatagattaccgattttcatttgcaattaatttgatcatcaaaatcgattttaaaattttgacatactgaaaacaaaggcaagggggtgtatctctcgttttatcgcaactaaagcaaaagataaggaattgacatccccatggacatgtgctgcgatggtccttgcttactttttagtttttactagacctacgtaaagctcattcgttccaagatcccaaagaaaccaaccccacttcacacttgatggagaggccagactccagagcattcttccttttccgttttatcatacaatatatatatatatatatatatatatatatatatatatatatatatatatatatatatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaataatctaaggtatgactattaagataatattataaaagttaataacctttaattaccatgcataacaattttaaaatataaaacatatgtaccatcctatcagacaggtcttcaatattgaagaatctactgccttaaaatgtttgaatatagatttttaagaggctatcgtcaattagacttattagaccgtcgcacccaaaattcgtttctatccctaaggatatgataactaatcttcagaaaaaaaggatgtgatatctaatactacatataatttcagtggctttggaagatatttgaaatnnnnnnnnnntatctcttgttaataacgtagtaagaaattatcaaacggatcggtgtagtaatttacaccaatatagcatagtgctgattcaaaaaattatcaaatatttttttttggcatcataaattaagaccactgaaaatgtcaaatataaaaaatgatatttaaaaataacttaaacttgcttctataattaagtatataaatatatcacaaaaggctattggcaacaactaaaaactaaaatgcattccatatttttttaacttctacttgtttcaattaggtggcatcatcaataaatatatttttaaaaaatatgaaatatatctacttttatttacagaaattaaatctaattattacttatctttcatatgaataataggtttataattaattatcatgagaaaatttagtattttgacgaacaaaatatcacaaaaaattattatcaccaataaaaataagaatttgtcattctcatttattcacaaattaatnnnnnnnnnnaacaaatcaaacatgaaaaacaaacatttaaaaaaactaaaatttgattttgtactaaacgctttctagatgtcaagtaaatcgtttatacatgggtagtgtaatttttctttttatatttttatcaatttacaaattactatataaaatttattgaccatcgtaacaataatagtttctaattaattgagaatataaaattttgtacactgataacgcacaaaaatagttcttataccaaatattaccttaaaataattacatcctgctagaaaataagcagtcacttttatgtggcaaggatcaggattatctccaataaaaaagagtaaataaataaaataaatgacgaacatggatctcattggccgaaaactagtttcgtaaattacaggaatgccaaggttaataacaaaaaaagaaatgccacattaattctatctcatttgttgtgggagggagagaacaagaacaacaacaacataggcgaggtttacaacatataaatgcgcttctaacttctaagtagtgtgtggtctctctctgtaggtctcgcccaatacctactctcagctcccaagagcacgcaccaccactagtgcacttccttctccttctccctctgtttttcttcttcgctaaacccttttttctatctcactaacaacacaacaatgggagacgagaagaaggccaagcctgctgcttccggcgtgtggtccaccatcaagcctttcgtcaatggcggagtctccggcatgctcgccacttgcgtcattcaacccatcgatatgatcaaggtgacgtcaagtttttacctttccgtcctttttgtatctattcctccaaatggacttctgggtctgttcgatttttgttgctggattcagatctgtgggtttttgtgtacgatctctgtttttgtgtgttgtggggtttgatggttttggtggtgtaggtgaggattcaacttgggcaaggatcagctgcgcaggtcacttccaccatgcttaagaatgagggtgttgctgccttctataaggtttttacatctcttcccatgctcttgttttttatgttgtttcattttctctaattatggatccttgctttattggtgggatgatttttggtgtattgatgattccaatttgttatgggttttggtatggccagatgttgtgtgttgtgtttgtttcacttgttttaattacctggctatagatctgcaagtggaagtggatttttgtagacgttgttgctttggattatgagttatgaaggggtttcttattgatgagtgactgttttattccagtttgagttttggacatgcgttttattatctaatggtgtctaaaatgtatcatttcttgtagggtctatctgctggattactcaggcaggctacatacaccactgcccgtcttggatcatttaagtgagttgttacgtctatgttcatcactcttgattaatcaaaagtagaaattttgtagtcttaatttctaaggctttctgctattcctttgctgttttgcattgtttataatatgatagctttgataactggaaagcttatcatctttcatggtttctaaggaattgttttgtgtgattgtgactaacttaatggttttaatgctttttagaatcttgacggccaaagctatcgaggctaatgatgggaagcccctgccactctatcagaaagctctatgtgggctgactgctggtgctatcggagcaactgttggtagtccagcagatttggcactcattcggatgcaggctgatgcaacattacctgctgctcagcgccgaaattacactaatgccttccatgcactctatcgaattactgctgatgaaggggttttggcactttggaaaggtgctgggcctactgttgtaagagccatggcattgaacatgggcatgcttgcatcttatgatcaaagtgttgagttcttcagggattctgttggtcttggtgaagctgctactgttctaggtaagtaaccattttactactgtcaaattattttatttgtatttgttggctttagctttatacattgtgatggtatttgtgagacaagtatgctcaactgtactacaccttactaaagattttgcccaaattatttttagtgcaccttatttaaaattttctgctgatgtttcagaagtctatgctttactcccatcgatccccttgtagacttaaaaacactgaaacaaaatgatttagtcaaaccttacaatagttgggttgtcttccacatccactattttatttgccaaaagctcaaaaattgccaacagatacaatagttggccttgtttttactgtttacaaaaacagatttatgttttctaaattttgtttgacccctgagcacatttctattttctagaagtttgtcctctgagcacttgaacagagtgcttgaagaaaaaagaagggaatgagaaaaatctcacagctgtttctgctttttgctttctaaaagacttgtttgggaaacaattttcataacttcatagattttagatgagaaattaattgctcagtgtggaattgttttataaaacagttttaaaaataaacctgtgagaagggaatcaaacaggtccatagtctttccttgttctgttttctatcatgtaggaactgaatttattgttgatgtctccttttttttacaactgattcttatcaattagtcacttctagtatgcggtagaagacaaatatcagtgcatttttgaaaagtttatgcaattcagggaaaataagagagaccaattgcaatatttctgtatgttattggcagagtagtttactcttttgaaactaaccatgttaatggtaggattttcgggttaatgcaccaatgttgatttgggcaaactcttcaagtggatgactaatttagccaagcattgaaaatggtctaagtttagcatctcattcttaataagtattatgcaatttggctctcgtacaatgtctaagcagtaagcagatatgtttctttctatttctatttttttgaacaaattgcgagacttgattgctctttgttgttttaagaaattatggaagcttgcataatattacacatgtcataattccttgtctgagttaaagttttgtaagggaaatctaatatttcatatggattgtgccataagctacataggttaatataatgccaaagattttattctcactgttaccaactaacatttgttcttctttaggtgcaagttccgtttctggatttttcgcagcagcttgcagtttgccatttgactatgtgaagacccagatccagaagatgcaacctgatgctgatggaaaatatccatacactggctctgttgattgtgctatcaaaaccttcaaagcaggaggaccgttcaaattttacaccggattccctgtctattgtgttaggattgctcctcatgtcatggtattattctataatgattcctttgcttttgtttatttgaattaatgttacattcaaggggtttgttaagtttatgttctgatatatgattgtattaattgcttatgcagatgacatggattttcctcaaccaggttcagaaattgcagaaatcctacgggttgtagttcccccatggtaatttggacattttgtgttgaattcaagctttgagtatattgaataatttgttgggtgtgttgtagccctttttggcagctaaacaccaatggagctgatcatttttaagtttaattaatcatgcgactgaagcgggaatttgcatacaaacattgtattagtgatataatataggattggatgcggctggagcagaatagtataattccatttgagcatggatgtcattgagaaacttgtggagatgtccaaaactagaataagtaatcctatctcagacagcattcagacatcaagttttgtaatttttttccataggtgggaagtatttttttttcaaccatatttcttattgagcattgatacacgtacacccatacgtgtatcatacccccacccaacacctgaaataataaacgggtggtagttgaaataataaaataatatatttaaaggggtggctaatggagggataaacactgtttgggtgtttgtgtaacttttttctttcttatttgttgcaagtttttcctttaattagtattttgttggtgtcttgttaaatctaatggttaaaggtaaaaataagtacaacgttttttttattaaaaatcaaatttgaaaatacactggaaattagtggaagacggaagtacaactacaattagcgttgaatttggttaaagatctcatcaaacaatgaattcattgagattttcttgataatttttccaatgttatttttggtcttttatctttattttaaaaggttaaaaagtattatgttataagtgcaatattttaatttaataattataagaaaaaatagaaagaaaattttaacaccacttatcatgtgtatgaaaagatctgtatgcgtgctatattttggttcacttgctccacaagaataatgtttgaatcacactcatcataattttttttttgttattatgttataagtgcgaaatgctcataacttattttgtcaacaattatttttttatctattatatttaaattcaagaggaaacaatttgaatacagttatactcaaaccaacgtacctanaattaataggaataaaagatgttttttataatatggaaaagacattttttttgtgtggtgggggtgggggaggatgagaataatcatatattcttgattgaaaaatatttatcctctaaatatagtaaaaatgataattctaatttatttaaatcccaataatagaaataatatgtttagtgaaaataataaacatagaagtacaataatttaattataatgaaaatatggttaataattatttttaagttttgaaaatgcaatacatgcgtactaaaaaattgtcatattaatatttctagtagaagagacttcgtcagctatatcaactagtgttttcacatatatttttaacacatgatcttctcagcagatttcttttcataatatgtgcaaggaagtcacaaacacggcagctccctttgatttgtttattaataattaatcattaacttctaaacttcaatttggagcttgtcacttagaaatatatatcatgctgtcgtagctagtttcatagtcagcttctataaaagtaacacctacgaagaaactcaataaaaattaaaaagaccacgcagtgccattttgaagttgcaaaatagttaaaaaattgtagtattttcaatcaaattcatacgtgataaggttccattaaaatgttaaaatggcgttcatgttaatatgttataatatatataaaaatatatatgtatgtatatgtgtgtgtctttttctttttggtgactggtgacatatatttcgccgtccatagcttttctctctatatagtatatacactactgcggtataaaaggtttgtttctatcaacggcgctcctcccaatttctgagcatttgctgttcagtttccaatttgtctacacattcaagttttgtttattagcaacaaattattaaaagagaaagaaaatccatcccctgggactacgcgtgaatataagtatatttatattcttaattatgttccattctcaatcttgctggttttcctgactatatataatacgcaaacaatataaaggttcatcaatcttgccaccaacaaataatcttgctgtctttcatccttatagctagaagctcattgcaatctttaggaaataatgacggttagaatttagaaacactattttgtcattttgccactgctcttgaattatgtctctctactgtcttcttgtgaacttccttgttattatcttttgcacatcatcatgcacacatgactacaatatatttcctttttattttcattatcaaggtgtaaataggttctatatcttccttgattataagcttaaggcgggaccgtatgttaacatttattttgaatcttttaattaaaagacatgcttaagaaattgtaataattatataaatttaaaaaaatcttaaagaaaaaggtatttaagtacttttataagaagttagaagtaacaacttctgaaaatgttaaaaaaaacccttaattacacaagcatactcttgattgatattcaactttattaatttgaaataagaggtttcaagttcgattgagctagctactgcgtattaaaatgttaaatacactaaatcatcaatagtattagagatgactaagctcaaacaaaatctgcattatgttacgtgcatgcattgtacatatattcaactacatgtggcctttgtattaataataattcatatggtttatttatgtttaactattcttcatttttcttttcttgtgttttgtagatagtagagatgtgtgtgcacatggactgtccaggttgcgagaccaagataaagaaagctctcaaaaaattgcgtggtacataaaagccttaactttgtgtgcgattgtttttattaaaatcatataattatattcgtgtttagtaataattgtgctaaaacggaatagaagatcatatacataagttctattttatatttgataaactttacaaataaaacaaaacaaacgtaaaattaaaaaacaatagatttccattctactgaaagagggtgaaaccaaaaaccaaaaatagcagattatatataagttctactttatccacgtacgtatcatatcaatcgctatatcagatttaatttatttcgcattgacaacataatgtcattgagcataattgacgattttttttctctctttttgcttctttaatatagaaagaaaagtataattagaccctatttgtgtgtgtgtattaaaattcaaattaattctgtattcaatcttgcacatagctagcgttggctcaacgatttattaattttgacattatggaagagtactaatattgtgtgattttatatgtgaagctttgaggaataaaaatatttatagttgaaaagaaactgatataaaatatattgcatatacctattattgaatgaattttctaaaatttagtgtataaatacacacatatatgtatatatataactggttttatataattcaagagttcaaatggacccaattcgttttttcctgtaaaaaaattataaaatagtgtgtatacaagtcttatgttagtgctcttcaaacatttatcgttgtagtgtggcaagttcaaattctacatccatcttacctattggtttaaacgaattgtatcatcaggagttgatgatgttgatatagacatgaggatgcaaaaggtaactgtgatgggttgggcagaccaaaagaaggtattgaaaacagtgaggaagactggtaggagggcagaactgtggccgtatccatacaacccagaataccatgccttggctcgccattacggcaatggtaattactttgcttctgccaagccctcctcttcttacaattattacaagcatggctatagttatggtgaagactttggctactaccacaagccaattggtgcagcaattattgatgagaaggccgtgtccatgttcagtgatgacaaccctcatgcttgctctataatgtgaagcacattgatttatcgcatgaacttcttgactttttcctgtcaataaacgtgggctacttagaaagttgtattatgcattggcaataccataataaatatcccttgcacatttatatgtatagatacttgaagtggaaattgagtggggaaaaataccaaaccacggtttattctagtagaaatgtgatttgaatttttgctagctagatagttatattcagtatttgatcatatctggtatagggttgattgatttaggtcccaagtcaaaatacatctccataagttaacacgtaccttaggatatcacgagctactcgatcacttggggattacagttctagacttgttttatcctagctaggtttcccaattagagctcaattgcatgaaaagccgatatatccttgcaacaaaattaacaatatagcttctatatcaagtagtaaggtattattcaaataattcttattatccaccaaaagataaatgtatttatcatgaagaagtgtcacattatctaaacctatcttatatataaatagaagtctagagttttgcactctaggtaggcctaatctctaaccatcttatctaagatttcatgttgacttgaatattggaattcttacaactataagttgtcccttttcttgtcaacttgaattgcatacataattaactagaaaatcattcacgatatgacttttctcgatcatttaggttcatatataatgattaaaaaagagtttaaaattaagtttagacttaattttatctttaagttattaaagacaaatttgacaataaattatattttttaataaataatattaaattataaattttatccgcctaagaattaatatgtgattgaccagtttatctacttgttttgcatattttcagagaatagtaaatatgaattttccatccttcaaggaatgcctcggacctttaggtgggagaggaatgttggaggggaagggagggaagggaaaaatttatgtagagacatcttcttgtttgagagttttaatttttgagggaaaggatttgaggattttcaaaactcctccaaagcctccaaagccttaaaattgttgtcccccctatttggagggttttttagaaggaaaagtaattaaaattattattataccagtcagtattaataaaattactattctaccctaatcagtgtaaaatatataatgtattaattttttaaataagaaaaaaattgtaaaaatttcttattaactttctattttcctctcttaatatatttttaactcccaaacaaggagaaagaaacttcccttattttcttccctttccttcccctcccttccccttcaatctcttttcttctcctcccctcctaactcccaaacaaagccttaaggaacaatttgattatttacaaaaataaataaataaataaaggcgccaaagcaaagcaaacccaaccccacgggtgagtggtgattttgcggtgacgccacgctgtatgtctgcttccgttgcgttgcgtgtcgtttacatgaatcagaaattaacagatggcttgttcccacccgcgaatccattgcccattccgagttctgagtgactcaaaagtgcagcgttgtgatttggtccagaagataacaacacttgtgccttcaattaaggattggttttccctatataaatttattatcatacatcacacatatggcaacggcacccttcattcaatcgcgctgtgcctactcgcctagaatttccaatcgcaacaacaagggagcctcacaacaagcccatatagcttcttcctcctcaccctccagttctactttctcttctggtaattttttttttatttccccttacttcttaatttcctaatcttctattttttttttaaactgatttgattgtggatttgttagtgctccaacttacgtttctcttaattaagatcgtttttgtttcattggccaattaaacatcgagcgttgattatttcaattttcgttctgtcattttactcttcgcctcctgttcttgtgtgcacacgagaggttggtttacacgtgggagagcagtgggggtccacctctgtgtagacacaaggaaaaataaaaaatactacttaggactagtgtaaaaactgaaaatccttcttaggctattgcttcctgtaccttcaagttgcttctttgcaccctttccggaatgtttttttacctttcggatgattggccattccggaagccaaaaaagtgatgcagtaaactacatcccccttcttaagctacttacatagtgggccagatttatactgttgggctagagggtgagttctgcttcctacaccagcgctttttccaatacacctacatattttttatttccaattttactctcatatggatcggcaatccgtaagagtcatatggattgtcaattcatatgaatcatacggatcggcgatccgtatgagtcatatggattgccaatccgtatgactcataaggatcggtgatccgtaagaaatctaatggtgtatgtcgatatgcaacttacggattttgagaagggcaaaatcggtattacactgtgcatgttaggtgacctggtactggcccaaggcgctgtatggtccaccttctttgattaatggaaaattgggaagtgacttcaagaccaatttatttattagctgattttgtattttgatactgggcagctagctagctcgttggtagttgtgcaccactttggaagttttcaacgttcatctagttctagaaacttcatttgtctatgctatgaatagggactctattttgattgatagaaggaatcacatgaaaggatacgcatactacttataccagagttaagaggttgtgactgaaactaaagaggagtgtatgaaaatcttagtaataagacaattaataccctgtgagttccaagcttattgatcacacctatctaaccttaaaaactagtaaaatagctgcaatcaaccctgtcaaacctttgaaccccactggcgtgaagctaggtaataaaaactaacatactattttcgttggtattgtatgcaggattgggatactatatggacttttcaccctagactcgataaatgcaacagaaggcatttaacttgaattcaagtataaatttgattttagtagtttattgagaatatcagttgatattacgggtctatatgtcttattttatatgtgcaattggcaattgcataccactaacttattgtccttaattaaggcaaaatacaggtttggttgcctaacattagccaataagaaatcacttgtgttcccagtggagagagtgtaaagtcaagcaccatgcataagcaaaacattcttccattggctacatgcaaccaagcattccctaggtagatagtgtgggtggttttctgccgtgggtcagttcaaatcgaatgcaaccagcagcaatctgaaagttgatagatattataccagtactcagcccaatgcaaccaatttgcccacttcttaggctaccataagcaaaatagtgtgagtaagtctctagtccctagttagtactttagtttgaccatctgttatagggtgatgtgctgagatcatttgaagagcagtaccctttaggcaaaataattcagataagaacttgtttataaaaggtggatccggatctcttactatggaggttgtcactccatggagatgagcaacctccttagcaaacaactaagccaccatttgagccaaaaaggggtgtttcaataagatgaagtgaccacacttggatggccagtccaaaacaattaggattgcatcataccccttagattgaggtagtcttgtgataaaatccatccccacattatcccattatagcctttggtataggtgaggttttgagtagacgtgctggagaatggagatgcggcttgatacttgttctgctagcagatagggtgttccactacaaatttagttactatagccatcgtcctttgccaaaatagttttgcttccaaatgcctatagctcctataagcccctgaatgacccctactgggtttgaatgaaattcaggtagcactgtagcagaactgatgtccattcttagttagctgttataacaattctccccttatagaataggcattcctgatctaaagaataccctggtttctcatttgttttttcctgaaatgaagtgataagtttactcaagtgaggatcaatattcattgcttgttgaattttttctgcatccagcaaaattggccctatgagagctatcaattccccttcctccatttgtgatagtgcatctgtggcccaattctcctgtccaggtctaggccaatagattatgtcaaaatcataacccagtggcttagccagccagttttgctgattttgggttgtttttcttagctgtaatgtgtttcaagagtttctggtaggttaaaactgtaactttcctgcctattagtatggactccaatgctggatggcttacaccaatgccatcaattctttttcataaatgggcttacttagattctacaaaatttaaatattgtatttgtttattgttcatttgatgatttgattgttgttgctctatctttagattgcaaaagttgcttttgttcctctggagttgacaagagacctgagaaggtagaactttccattatctgaaaggctacattgttttttctccttttgcatcagacgttgtgctcaagaatgttgcgttactagagtttgaccttgatgctttttgtctcttgttcgactataatgttctcaagacgacataatcttcagacttgctgttaaagggtgaaatgatcataggacaatgaagtcttccaacggttattgaacatagtctcaggatgatcttcatgatctttcaatcagatggattgccaatttttagtccctgtatgcttagagagaacatgttagcacataatattcttattcatcaatttgctttgtttgttatccattaaaactatagggccagatcatcttttcctcaacaagattcatacatatgccgcctcaaggctccataatgtcgggaaacctttttgcattgggcaacattttttacaattatttcctacttggcttgctttctccatcctctttctttgtcactcttttgtctattttctttttgtagttttctaggtaaaagaccattgttggaataaggttttgatagggaggagagaaaagagagaaagatggttgtgcatatttgtttactgaatgaatataagtttgatagatgtgataaagtactacaacctaatactcctataaacctactaatgattacggcaagtactagtactagtactagtctaagcctacaaacacaaagactaataatcccaatattctaacaacagtattaatattggtgcaaatatatgtttaagttttaattttcattaaggctggtagatgaatttttgcaggtacaaacagtggacagagacaccagggccttagagctcaagctatgagtactgtcactcttggaaattctattgctagcatagggaatttgaagaacgaccctgatcatctccttgttcttgttcatggtatcttggctaggtatgtgatatatttattgagagaataaaaaattgtttgaattattttgtgttaaaatatgagtgatgcttgttttgagctatatgggagtatgggtgaaaagtgaagtttacgtgcttaatgcttttaaagttagctactatattgaagttcagttggaaaggattatgattttcatcctgtttatgattagtgggtacctttccagtttgcctgtcaattataaatctgattcaattcatactctcacaatttagcctatgaatgtgaataaagtaaagtattcgtttcattgtttacacttttacaagttggtttcattgcaaaatttgggcacatggttgtttatcatatgtctcatctgtccgcttctttatgttggtctgtagtttagtctcatacaaagttgtactgatgttttgattgatacagcacaggggactggacttatgcagaagcagagttgaaaaggcgccttggaaaaacctttttaatttatggttagatatttttaactagtggttctctatgttatattgcataatgctcctctaggtctgtaaattgagcttgtttgtaaactgtacaagggtgtatccacccttaaattttagagggttaaagtggttcaaattagtttagtgtgttaagattgtgatgtagttgaaattaaatcaatggtggatgcacccttgtttgtgtattttacatacaagctcactttcgaagagctttttatctaatgtttgattgttgaatcatagtgttcttagtttctttaaattaaatcgttacttttgggatgttcaatgatctatgattctatggaggcaactgactgagataccttaaccagctcaaacataatctgctttacaggtttaagtaaacatgcaaaatttaactcactcttgtgctgaacagccttaactgttcttttcactttctttcaagttaatgctgaaaaaagtctatttgtatcatttggaaagaagtaagcttaagcttcctaagatatatatatatatatatatatataaaatgctgtgaagattttcttgggtattgcatgagtgcctcatccgtgaatgtaaaattatttgtctagctgaagtccttaacaattgtttgttgtttgcagtaagttcatcaaatacttacactaagacattttctgggattgatggagctggaaagcgattagctgatgacctccatttgaaatgtctatatatcagatttgtgttgtcattcttttttaaaacttggaattgtcttggtgctgtatgttgaaattatgagcttagggatagagcgaggaagagagataaaagagaatgaaacactgaattaataatttgatattaagtattaactaagatattacaatgtcttgatgtgtttgatatgtttgtaaaacttgaagctctaactcatatttatactaattaattaatcataatcctggctaattaggtgaacaaatcattgtgagataaagaaatatgttgttaactaaaattaagagataatgaggaaatagggaaactaaaccttgaagataatgcaagatatgacactccctcaagctaaagcttactaagtttgaggctttttttatccatctaatagtttctttgttttcccttctatttttctgagctgagatttgacttgactattctctttcttaaattagtttcttatacatagtcttagtttttacatcgaattatgcatgcttgtatttatattttgagatttttatttttatacaggcatacagccttagaagaaatttttaaatagaaagagtggaaggaggagagaatgccagtaactcttctaatagcagttccgatggaaagaatactagaataggatttgcattatcaccaaacaggtcctaacaaaattttaattttactggagaaatgttatattacaatcatgaaaaaggtgattagaaaataatgctaataaacaggactttttaagtcaaatgaatgaatgcaaaccatccttctgccaacctcctatgtttatatgtcttgttgatgctctttgtgtttctcaacttgaactgaaaatttgccggccataagagttttgactgtttagtgtgcatatatttcagcttccatttctgttgggtgtcccaatcctagaaaagcttgctgcacctatagctcctttttttgttggccagacaggtagtcagttgttccttactgatggcaaacctgacaaaccgcctctcctattgagaatggcttctgattctgatgatgggaagtttttgtaagtgaaggaatctatttgtactagtctttatccctctttttcaattaagtaatctaatacttacacagtttatatttctgtagatctgcacttggagcatttagatgtcgcatcatttatgctaatgtttcatatgatcgtatcctctcagtatgtttttctgttttacaacttgttaggcatatcaatgataaacttatggttcttttctcctcaattttggtaattttttaacttcatatagacatggttggttggcgcacatcctctataaggagggaaactgaactcagtaaggtgaatatgatgatttctccaattggattgtcttattttttgttggttactgatctccaatattcagcatatgtaagtttaatgattaataattaatacttagattatgactaaactaaaatcttgtaggatgcttggaattatgcttaacatcctaactgtgtttatgtcttccatttataatctgttttacttgtcttaactcttagatttatcacttaaatggtaagttgtaatttaaattctacaattgctaataggataactggatatcttctataggtatgaaatattatcaggagttctaatataaattttgttcatgtctcgatgaataatatcaagtaatgaaaataatagaagtataaaagagattgttattattatgattattatttactactttgtgtactagaactgttacagagcatcaaatttccttacccactcccaataataatatgatgtaccctctcccgataataatatgatgatgatgtattagattttatcatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttattatttactactttgtgtactagaactgttacagagcatcaaatttccttaccctctcccaagaataatatgatgtaccctctcccgataataatatgatgatgatgtattagattttatcatcatcattgtattaaatttcaacagaaaagggtttaaaagtgaacttgcatctactacatcaaagtttatgtgggacattgtgataaagaaacaaatacgtaaaatttgagagaattaagtctcccatcaaaatgtgactatatttcatttttttaattctttgaaaaatatttgtttactgctgtacttcacttaaagagatataaggttggttggttgggtggttaagaaacaagggaaggaaggaaaggtcgcggttcaatcccttctgctaacaaaaagctacaaactaacaattaatattttgtcgataaaaaaaattgtacttcacttgaagaacttcactagtttgactgttgattgggatcttcagttcttcacattttcagttatcagaatggttttataatttgcactgttaactcagttctttagtagcctaatctctattgtgccttcataattacttaattggaaattcctatgactgcagaatcacagcctttccgcaaaagatgaaagcctgtatcctgaaatggatgtggcagtggttcttagttgtatctgtatcagttgctctacgcagtactgatgttattgaatgtctatattaaatccctttgaaacgaataaagtaaaataaaattgatggatcaattcaattgatactgcaattaaaatgttgtgatttgtgagtggtgttaattctggcatcctagtttgttcgttagcttccgtgttgcaagcgtggaaaagaaactatagatgttgggtaaaggggaaagcgctgcaatccttttttttgggtgcaggttctgttttgaaaagtaggaggagattttgtttaatataagaaaagggaaacgcttgaattgtgaaagttaaagaatgtgaatatgtttatatggtattaacattttctattgtattggcagcctcctcgaaaatctttagatggatacaagcacgtggttgatgtggaatattgtcccccagttccttctgatgggcctaaatttcctccaaaagcagtaaaagcaaaggaggcagcacaaaatgcgccaaatacacagaatactgtagaatatcatgaaattgtagaaggtgattattattgcccagagtaacttattaaaattacgatgtgtatcaattatctgttcagtcactgatattcctctaaagccactaatctttttaacagatgagatgattcggggattacagcagttgggatggaaaaaagttgatgtcaactttcactcagcattctggcctttctttgctcataacaacattcatgtactgcatccatttaatctgtcggatgatgatggtatcactggtacagagtttttaacacgagtgcttgtctgatttcaggtgaaaaatgaatggcttcacaatgctggtgtaggagtaattgctcatgtggccgacagcttaagacagcaagaagcaccatcaattttgtctgctagcttgtaactagtgtactagtatgtaattccactttgcctgggcatgcctaatcctgtgtttgatttagataatgaaaatagaggagatgaagattaaagaattttttttgaagtaaagtgtaaaatgggtgggttccacatggaacccatcaaatttctctcctccctccctaaacctaacacagcctaactacacaatacaatatgagaaaacattcttttattacagtagtcattaatataattacaatattttattattaacatacttaaccttacggtagttcttacttaacagtgattatcatgcagcttttagaaagatacaccatcataccaatggaaacaatatggtttgtgtgtaacatgacttgcaaaacatatttgagcttctacatgttttgactgttatcagaatcatacatttcataatttgaagcttacaatttgataccatttggctacccactgatttatatggtaagataaattttaaatgactttgtatctgatacatgaataaatttatgcaattttgtatcatagataagaattatacgattcaattaaatacatgaatgaaaaaatacataggatttaaattcaaacgatgtaacattgatttgtacatattggtaaagaaaatgcaaaagttatttgaataaaattatttgagtttgatttacttatgaaaattaacatttttgtataaatattggatgtcagtttaatatgagaaccaaaatcctatagtttgaaaaatgagaaatagtacatatataacaactacaataaatcttataataaagagagataaagggaaaaaatgagaagataattttttttgaaatataataaatgatataataaaaagagatagacacataaaatgatgttatataaattattataagaattattttacatgtatcatatctcttataaaatgtagaaaccaaaattaaacaataaaaatattggtactcatatcaactatttgatgatgtcaacatttcaacttcatatcataataacattctaaaaactccataacacttctttaattaaacacaacataatatctttggaataatatcaaactcgaatcacccataaatcatcttatatatatatatatttttttttcttttaaaattaaaacaatataagttttttgaaccttatagagacctgatccaattcattattgattgagttaatatggtttggatttgacctaaaaatgtacaaaattcaaccaaactcatccccaaaatataatggagggattattttttccattttcacgtaaatttgagtgtagcaggctgtacaaattgaaataaatcttgaccattacattatttaaaattttccaacggtcaacaatgaacgtgaccataatgaaccaaattttgtccattccaccatacagtataaatttttaatgtttccgtgtgaacaacaaccccccttattcaaaagacaaaaaaagtgaatttgaaatttcaatgcccaccaaacgccaatcaatttgcctccctttcaatcccacaacgtgaccatcactcactccccactcttcaccaaaagacaaacgcgtggaaaacactctcctcagagcgcgtggcaataccccctctcctccacaacctaacccttctctcaactttcttatacccacaacacaacgcacacagtgacagtacacacaaaaattttctagagcgagaaagtgagaggagagagaaagtagcagatcctccatggcctccaccaaggaacgcgaaaacttcgtctacgtcgccaagctcgccgaacaagccgaacgctatgaaggtataataataataatccattctcttaatttccatgttgagatttcagagtcaccacactgtgctgacctagatgttcaattagataatcatgttccttaatttcggtttagacggttgaattttcgttgttgattttgaattcgaatttcgaggagcacaattgtgagaatttttgagtgtttggtatgctgtgttagaaatggtggaagcaatgaagaatgtggcgaagctaaacgtggaattgacggtggaggagcggaaccttctttcagttgggtacaagaacgtggtgggtgctcgtagggcttcgtggaggattctttcctcgattgaacagaaagaagaagctaaagggaacgatgtgagcgtgaagaggataaaggagtatatgcagaaggtggagtctgagttgtccaatatctgcagtgatatcatgactgttattgatgaataccttattccctctagctcttctggtgaacctactgtctttttctacaaaatgtgagtgctgagttgtcatttttttgttcttcagttggaatttagagtttttgtgtgttgatttaagcctttttttttggttgcaggaagggggactattaccggtacctcgcggagttcaagtccggtgatgagagaaaagaggctgctgatcattccatgaaagcgtatcaggtctgcttgtattttgacctcttgcatctgatgtggttttaatttaaacctggtgattctgattcatggtatctgttgtggagtgtggactatatggttgctttgcatgccaatctaactgaagccagagaagaaaaaatgcttctgttttcactttcctttgttatcagtcacaaatcttgcttattggtatttctttgtgctaaatgaatcctggacgaaagtgcaaagatattggcctgtgtccttttttaatttaccttttaaggtaattggcaagtcaacattctattattgtaattgtaatataaatcatttcattggaaggccttcaacatcaattttaatatatttttaatgttgatgttaacttgtagatgatttgttagccataactcttcactggtgatatgaattttgaaggagtgatttctttatcactaaagttgtgtacttgttaatgaggaaaagattaaccgaggaaaaggggggagtagggatgtagggtagtgcttattcttcaggcataacaacttattatacgttatatatgtcttatgaccacatatgatcagttttacatgtgtggcattgtgacattcatttagatgaaggcatcactgatatgaatttggctgtttagttaccaaagtatttttccgcttgttcatgtttatctgaacaattcataaatatttcagttggcttccactactgccgaggctgagttagcacccacacatcccatccgtttgggcctggctttgaatttctctgtcttttattatgaaattttgaactctcctgaaaggtatgacttttattttattttattaatttttaattgcccacctctttgtgtactatgtgccaaagttggcccctgcttaacaaatttaacacagtactcttcatatctcagggcctgtcaccttgctaagcaggcatttgatgaagcaatctctgagttggatactctgagcgaggagtcttacaaagacagcaccctaattatgcagcttctgagggacaatctcaccctgtggacttctgacatccctgaagatggaggtattcattaatggaaatcaatgaactctgtcaatgtgtttgctggactttgtctgcaatgtaaataaaaatacatgaaaacttttagggttaattacagtattacactcaaatcctctgaggtagtgaggtttaatagaatttcactcgatacccttccctttttagactctacacaaacctctgttaatttgtataaaatgttacaccatgtgcccttccattaatacagatctcccctgatttcttatgtagggaggtcaaagtaatgtgaaaaaagggaggggtaatgggtttaatctcattaaagctcagttgtcagtgtgatttgtctcatttgctattttttatttgtttccgtttgattggtctcataatgagttatattagtggtaaatgtgactcttcttactgggactagatggctgagttttcaagctaatcattgggggtttgcatatgaatttcattcaattaaatttaatttcggagatcgatggtcttcatgaacttgtgcacttagaattgagtttatacaatttttctattgtttaatctttatagttggataacaatttggtcagagttgtttccactctaatatcagtgtgggaactgggaagcattaacatgggtagggttattggacatgacatttgtatgacataggcattcagcattatctttaagattgggacatgggtgccgcaggatatgaaagaaaattgtatgtataaaaaacatttatatttatcattttcataagacataaaaatagcatataaaaacatttggagctaagcagaacttaaaaaattaagagcaataagaggtttagccttgattgatccaatgagtttaaaccagtaaataccaaataatttaaaatgaagggtctccaaccaaaactcaaaccatcaaaggttggttcttgggtggtgaagattgtggctgctgtgttcttgcttgcttgcccatattgggtcagaagcacacaaaacttgaaaatttggctgcctggtgtcagaaaaagtaaaagggtttccaaaatgcaaattgtaaaagcatgcatatcctcccaactggcacacattcaagtattggacattgttagacttacagtggcctgaatgccatacccactgctttagtatttttaggatcaggtgagtttgctgagtattaaaaggtgatgtaatattttgattgtgtcttactgtgtactatacttattttggtgttgttttcgattaggctattgcttctcattttattttagctatttttctttgttctgtggtcctgccaacccaacttcagtatctctgatttccctggttaattaaatatggcctcttttaatagcagaggaacaaaaggtggattctgcccgagctgctggaggtgacgatgcataggtaggttataatacccatttagctgatggtatttgggttttacttttttaccttaaagttacattttgcaatgaagtgaagcaggtattggccaaggaatttgtggagtgcatacgagaaggctagtttctctctggatagtttaccattaggatgttgtaatagaacatggagttggtctctagaaaatcaccatagggctttgtgagccttttatcgtgtgctttctgttaatggagactggagttgagatttgcatggtgtttggctgtaatttagtgaatttcttcatagtgaatttcttcattttgactttctttctaagaggatgctaccttgcattcttttatcagtttacatagataatttttatttaaaattatgcgaatcattgtttcaaaagagaagtgtgaatttacgactttattttcttaatggttgactggacttttactatttacccaatgatatgattgtgattaaataaactatcccaacttcaaattttatttattttttaaagggagcttaatatcacgttcaatctttatgggtacattcacgacaatactgcagacatactgtacgtaaacccgaaaaacaggaacgaaaacacaggcattgcgtaaactaaaaatgccaaattataagatatttagacacccaaatgctttttgacaccttgatagagaaaaatgtaaatatgataaatgatatgatttgatagaaagagaaaaataaaaagataaaaggtccttatgaatcatgaagtgcttaaaatataaagatgttcaaatatcaagcaccctaatatatatatgtgatgattagacaatagaagttatttacaatcatcacccccaatgcataatgaacacaatcctcatcctcttaataaaaataactccatccgaaccaagaatattaggatttaacaatgggcaattctaccttcgtcatagcctcagccctttgttttttgtccttctttggttcggcttctctattgggatttgagggcagagtttactgcgacacatggcacgcccagttcctcaccagggtcagcgagtacatgccaaggtacatgttgcatataagttcttgttaacaatttagcaaaatgaaaaccatacatatccatgcacacttcaattcaccaagaggaggttaagctggtgaagagaatcagcatcagcaacaacaatggcttggtgaaagagcgagcttagacttcttcaagtgaacaacaacaactaacattcaactcatcattggaatccattctaaccattcattaataaccattttgttaaatgtgcatgcataatgtacgtacttatttatatatgggggactttcctagcgtcgtgggcttttttgttgctagctggggtttggatgactggtccaatgtttaatatcgtattggacatgtcatgtgtgtattctcaaccttctagtgtctttcagaccattccaagttggaaagtaaaagaaaagattaccgatagaaccaattatttttagtcttctcattcttcagtcaatgatatttccggagataaccagtttttttttttttttttttttttttnnnnnnnnnnnnnnnnnnnntaaaatttgtaggagatcaaaacatatagtttcattatgttatggaaaagagaaatttttgttgtgaagaatgtctttggcaaaacaatttaactaaataaaatataattatgaaaataatgatattataaaaaaaaccttattaattaacattccattatatatcccttagtggtctttaaatcttatgttttgtattaattattaaagcaccgtactaagttcgacctttatagtatacccgttataattatatgaaactttcctgataaaaaaaaaattacgggtattcattgtgaatttctgagaatcacaattcctttaaatcatgttacatcctttcaaatgaaaatgaaattatcacacaaggatactattacaccaaatgtcgatattaaggctacaaaaatctgatgtaaacatggacgacagcgaaaacaggctgccgtacgtatttcaaaaagttcggcttaatgatttgattatcatcatgctttaatttctgtttcttaaaagcagaaaactctaaccatgttaagtcgatcgaagcatgctatgtctcccatcaaaggcgatggcacaataaaaggagggagggagagtgagctggtttttactattatattatgttgagtgaacttaaaataacaaggtttctttttctgattaaaataacactatttaacactgttttggagtcttaatttgagtacatctagttcccaattaagcttttcgggattaataaatttttgcttataaaaaaaattaacacaaaaaaattataataaatttgtccttacttttagtcattgttaaggactataaggatgaaaaaaaaattgaaagtaaaaaaaaaggttaagagacaaaaaaaataaaattttaaaaaaattaagatctaaaagatagtttaccctaaaaaagatacatggcatattacatttactggagccagtgtgcagcactcttatgttcatttgcaacaacgtcctcccctgttagcacctcttttattagctgataggatgggtgttgttcaccttagattctgatttcgtttttatttatagttactaacatagagtgtaatctatttcaaacggtttaacatgctagtaatattcagacaaaaggaatttaattaacgaaacaagtggaatataaattactgattatcgaggctactctcacaaaattgatgttaattacaacttatccgattaattacatatcattattataataaaacaataaatctgcccacttattattataaaacacgaaattggagtctttattttattttaacttcaaattattttcttatacttaataattgataccgtagattaaacgttttagccggcttctagaaccaagatgtgaacaaaagacggataaatcccctaattttcaaagcagagagaaaataaataattaataaaagtacaatttgctctcaagttttcgtatttacttttataaacttttccctttctttctcattgaccatttcttcagcgtttacgtttacatcaatcaattagtgtagcttttgcggatcacacgtcaaagcaaaggatttaatgtacttgaattaattctatatagattatgtgtgaactagagcatgtatatatatatatatatatatatatatatatatatatatatatgtaggtgagaaataatctgaaccgttcacgtctccaattgtaaaacatgattggttcatttgctgtcttttttcgagcattcacatcttcataatcagataaactttagattgtcactgccttttcaagcctcctttgtttctatctgattcggatgttctgtgatttcgtggatgataacaaattttctttgactttcatgctgagctgcagtaacaagcaattctataagatattttggcccattttatatgtataatatacagaggggatatgtaatgccaaaatattgactatacaaaaaagctagcttattttccaggaacgcaatcaaataattggatcattaattatcactttacttgggtcatgaagttgggaaatttcggagttccatgcacatagaagttttttttttttttaattttctctttttaaataaaaaattacacacacaatgtcctatccatgcttaataataagcaaaatatcaaacaaatgcttggtacacgggaacatatttttcttttgaaataccctatagatgtgtgaattagatgagattattaaaggattacttatttcactcaagttttttgagaatatatatgtgaaaaagaagagactagcaaatagaaggataaaacatagatgcatgtaatatcataaatataaataaatggtgtttttttttttctttcaataaattaaatatacaacacgtgtaacaatgattataagtgttatattttgatcaattatctgttataccttgtgttttattttttttattgagaaacaacaacaaaactatatttaaaatgataattgatacctaagtttttaagaagaattacttaaaaaacctcaaaagggagatatatgttaatacaagaaaaaaggggagagagaaaggaatgaaagaagtgaaggcttaacaaggttgacgttgacaacctgagctcatcctccgtcttttagatggaaaaagctgccggaaatcaccatgagccacggtggcaacatgccattcatccaaagtcagcctctcctccggttcaaactgttgttggacggtggatctgaatccactgtccataaatccaacagggtcatggcacagcggtttgacccttcgcctgccggctcctactggcacgttgcgaagggccccaccagccgtccagtatctctgacagcccttacagaaatgtctgggctgattaacgttgtagttattgaagtagcaaaacttggtttccatgctcttgcatcttgggcatggtatgatcttatcaggtctctttatctcctctgtcccatcttcactattttttttatcttcttttctttctcttccatacaacgtaatcgttgttccaaacagcttaatcccttcactagcttggccactttgtacccgagccattaattttagagagaggaggaaagagagaatattattctgagtgaagaaggtttaggttggggtggaggaggaaaaattgtgaaggtgctttttatatatacaaaggggaataaagctaaaagtgcacaatagttagtacaatcataaaccatgccatgggtctttggcagaaagtccatatgataaacgccaaacgtaggtagaatataaagtgcgttgccaaattacactaaataaaagagaaaaagaagaaaagctaaaaagggtttgggttggggtagtagaaattagaaaaagctatggatgagctttttgtacacatcaggagtctacgtcatgcccatgaagtgctaaaatgtatacatacaagttacaacacaacactggcccaatccaggtagatcgcttacaaagtgtaaaagagaatggagtataatatattgatttatgcaataaatcttataatatacacgagaaagatacgaaggaaaagtactagtactgttggctatttgataagtgatgtgaataaaagaaagagaattatatacaatgagagagaaagtaatttcttgtatttaaattctacttataatctatttaatttcaaatgtaagccagctcatagatattatatatactagccaaaagggatgatctctctatatattccttgttagtttctttaaagaaaaaattcagaaagagaaacaaacgaatattgtacatatattaattcattttctttgagacgactaaatgtcttgacatatgcaaacttgcaattcactcaaagtttggaaaataaggatgtttgctagctgataataacggataattaagtaatgaatggtctagagtctagagtctagagcatgattccttatttgtttagataagtcattgtttgggtgttgctatcctcccacagccaccaagaaatgtaaactattgcccgattggattcttttacactaacacatgttttaataaaaaagattaatactgaaattaatttaagtatatgtcttaattacatttaatgattcaaataattttattacaaatatttaatatttcaaaaataattttattaagattaatttgacctaactttaacaaatccttaatcgggtcagattgactacgtatatataacatttttaaaaaaagtttaacttatttagagaaaattgtaatttgactctttaatccatcctaacattaatatttcataaaattttaattatctaattaatccctcaaaagtttaaatcattaacatattatttcctttaagattttgttaataaataagtcatttaaagattgaaaatgtcatcatatttatccttacacaagactaaaggggaaaataataatctttcaatgatttactgatttcatttactaacggacaagatgtttatgtaatattttttacattaataatataaaaaaaattaaactctataatatatgttaacctctaaatatataatgtcaatatcatcaacagataaaaagcagttgaactagacgtcttaacatgtatattacaatttaaggttcgttatannnnnnnnnnttaatatttcaaaaataattttattaagattaatttgacctaactttaacaaatccttaatcgggtcagattgactacgtatatataacatttttaaaaaaagtttaacttatttagagaaaattgtaatttgactctttaatccatcctaacattaatatttcataaaattttaattatctaattaatccctcaaaagtttaaatcattaacatattatttcctttaagattttgttaataaataagtcatttaaagattgaaaatgtcatcatatttatccttacacaagactaaaggggaaaataataatctttcaatgatttactgatttcatttactaacggacaagatgtttatgtaatattttttacattaataatataaaaaaaattaaactctataatatatgttaacctctaaatatataatgtcaatatcatcaacagataaaaagcagttgaactagacgtcttaacatgtatattacaatttaaggttcgttatagaaaatatttgaagcttggagagttttaatttgttattataatgaataaagaagagtttcataacgaggaaggaaattaaattgaagaaactatctggctctgagaatgagattggatatatattctacacgaacgactcacgaatcaattttaaatatatttcgtgcttttttcttttccgtagacacattgtttcttaaagtggcatgctcctagtggcatttggtagcacttttcacgcaaaaaagccaacttttcatgttccaacagatttttggaaaactttaatgtatttttattttaaaaatactttttacaagcaaccgaacatcacaccaattcaaaaccttactatttaagtttgtgagtattcatcttatattttaattttttatttttatttaatgtaaattttcatattcacacttatatttcaacaacttttgttgattaaaaggaaattttaataaaaaatattatcattgcaaaaaaaaattgaacagaaaaaatcacgtaagataattttaataatattttataaagtggaaagtaagtaatcattttttttaaaaaataaataaattatcatgaaaagttatttttttaaaagaaaaagaaatagacgcaccgtttgtggccttgccaactccttttccatcatataaaatttagttgtgtcaggttcccttttagtacgcatcatttatatgatacttttatgtgccatttttttactaaaggatttttcatattgttaatttggaaagtgatcccatttccaactcattactctgttttataatgaagattaggaagcatcaatttgctttctttatcgatgaaggatacactttttcgtgaggattcttttaaagtcaatcagtacgtatctatttattatttcatcaattttaaaagcaaagttatgtccgagcaaaatatcatagtcatagatttctaattataataagggattaaggggaaaagttggatgttgcatgttgatctaatctagtcacaaaaatcgaactcattcattagtactttttcttttccattttcctttatgcaagaaattaaaaagttcagctatctataaaatattatattcactaatattatgtgcaagttttgccaaatatcatttatttattacaaatgatatcgataataaataagacaagtgccgtaaggctagcgagaaagaagatgcagcaaattgccttcctgaaatgaaatcaaagaggaaaacctaagcaagaatatatgaggtgcagtatggtaggtattttcttagtcaaaatttagatttcatgctgacctttcaaagcaactttcattgtctaagtatagtaaataaaactctaattttaattagagaatattattaaaattaacaactataatactgtaactaaatcttaacctatgtgaaatttaaatttaaactagggagcaatagaagaaaaattcaccaacttccccttggacacaatggtgctgctgcagaagccacaaatcgacgcgatggaacatgaggaacaacctgattgattctttgatgcaagttgaggatcttcaaccttcacataaatatacttctgaaattcagcttgtgcagcaaactcaacccttatctcagaattaagatttgatttaccaatggcactgaggacaggaatttgtgggggtaacctgttaaacaattgccatcatttagggtgcattttgtagagagagaaaaaataaagttgaagaaaataaatgaagaataaagtgaaaagttcatcttatttccagtcttccaaataaaaataaaactaaaaaatttattaattatgtgcagaatataaaatagttttacagtatcatttattattcgtttcaagtacattatatttttactatattaaacctgaaaaacaaatacattcttattttatcatttttaaaagtattgaacaaattatatatatatatatatatatatatatatatatatggtttcatcaaatttctctccatatctcttcttttttttttcctcttatattagctctccatatttgtttgataaaacattactacatcgtaaaccttacaaaggattctgttattttatttttgtaaccaagaggaattttgctttaagcataaaaaaaaagggggggttgtacgcaatctcaaaaattaaggagagtctcaatgtaatttacttaaaagtattttttattccgtggatatcttgaagatacattaatcatgaaatattattttatattactagtgcataagttcttcatactatcaaaaagataaatatggataatatttattaagtatggtattacatttaaaaaaaaagttcatatcatattgaatattctctttttattattttataaaaatatttcttattaaatatgaagaatattttgttttattggtacactctttagattagttgaagatcgtttttttttaccacatttaccacgtattagaggacgtttggtataaaaaaaatacttttatttcctaagtttggtatgtatctaaagaaaaatattttcaagaaattgataatttcctaagaattgtttttacctactttcccgcataaacattctcatataagggtcgagatccaactatggacctatcttgccgttgagagggagataataaattgaaatcaagtcaagtactcggaattatgatttttttttcaggaactttttacaaacaatggcctggatttgtgatctcacaatacatagggtcaacctgatttcctagcccatatattcaaaagcaaaaactaacgaagacattaattcatcatacgataatgaaagaaactgcactacacttaataacagataaacaagatttattcacacgtgtacatacaacaaagcctcaagcaacttcacttcaagaggctaaaaaacataaaggactgctcgtgtatgaaataatttttttttttaaaaaagaaaaacatgtcatgtatcactccagttatcatcatcttcaccatcatcactcgcaacaacctgaaaggttctccattatggatgctaattagatataaacacagttggggaaaagagtaatagataacaaaagaagagtgaccaatacctgacggattgcatttgccttctccaaaattgctgtaactttgacgtttgctgtggaaccagtggtatcatttgactttcctgttactgtgggcctcaggttgaatgcctgaaccaataaatatatggcaagtcaatgcaaaagttgactacaattaacatgatttatttgaatgttgctagtacatgttctggattgatttttgtcatcaatttgtaatttagaggactaattagatctaaaaaataactaagtatttaatgaccatttgacgtatttataatttataatgaaatacgaagttgatgacacttatatctgtggaggaccaaaatgtttagttaaccttaaatagttgagattataacatgactacatacttttgttctgatttgatataggaaatcttctctttcatctgtctcctttcccattctcaactggtttgcttccttctgacccttcaacttctgctgatccagctgcaggaaatgctcaatgagattaatacattgttaaattctaatatctaccatggctgcataaatacaaagttcaagagaaaggtaagaccaaatgttaccttgtccttcaatttatctataatgttgccataagattcatgatcattgtgattaatttgtatttgctcaacctgggtgagcctaggctgctggaggatagtagaatctggaagactgtgatcaccaatatgttcagcatctacagacatacaatactgtgtcccatttgtcatatccaactgtgattttgagactcgccattgcgttggaggaagaggaggaggaggaggtggtggttgtgcaggctctgcatgactatgtgacataacagcattattgcatttggaatgttttttactttctttctcaagtgcaggattaacattatcgtaacttggaaaatcaagtaaaggcctggacagagaatgttccacaccattcatagtacatgtaccatgtccaccttttacattggtatcatcattggacacagattcagttgatgaccttctgcaaggagaatcatgtaccccttggtcactgctttctggatcctcatcagattcccactgatcagagttatagtcagagtgagggcttcgaccatcatctgatatgtatggagatgatctacagaaagtgtcatcatcatcagagtgggaaactgaaccatccagaggaagggaagcttcagggaccagctggaaagaaggaaacatatcctttacgctttcatgatgattactgccatcaggaaatctcagttttaatttggaggtctctagtccactgacaggatggaaggatattttcatatgttcaagtggaggtgaaggaggaagtgactttataggatatccagaaccaactttctctttggaggttgttgtctcaggaagtgattgtcctacaatgccattttgtccactctggtccaatataacagatttcagagaattataatgttcagatttttcatcaaaagaaactttccgctgaaagctatttattagtaatctatgactaagtccaaacacacgcgatgagttttcaccatttccctggttgggttcagtactgtccttcgtgtcaggggtcgatgggagaatacttccaggtgcaattaccctgatttcccctaaactgtccctctcagtctgaccaaatccattactgtgctgagaattaccagtggccttttcagagacacaagcttggtcatcattatggcctgatgttgagaatctagaatttggttcctttagaatctgctcagcaacctcttctgatgatccctgttcctctttataaccattgctcttttgcattgaattatgatgtgaaccaccatctgtttcactttttgtgatcaaaggcccttgacctaaagaagttgacttgttaaagtcaggaggttttgatggctcgagtcctaataatccaccattagtccagaacctaactgaatgatcagccaaagactctctacgagtctcttcagatttgcagatactgttgttgatcttacctgcttcctcatctggtaaattagagtttttggaaccagaaaatgatatatcagtctcaattggtgctgacactgtatcattaacagtagaagaaccaatgtaggtatcagtgcatactgagttatccaaaacagaattttcacttgtgtgaggaacctgcacaccggcaggagtcttggagggatgagaatcagctatattcttggctatttctttgctaacagaaatatctgatggactcacagatgccaaattagatgcatgcggctctaatgttagagcaggagtttcttgcaatgagttgggcaaattcgcaaacatttctttgtttaaggaaatggtatctgtggtcatttcttcacaataaggagaatttgatggattcacaggtcccaaatttgatgtatgtggctctactgtgagaggaggaatttcttgcaagtcgggcaaattcccaaatgtttctttgttgaagcaaacagtatctctggtcatttcttcaccataaggaacatctgatggactcccaagtcccaaattagatgcatgtggctctgatgtgagaggagaaattttttccaatgagtcaggcaaattcccgaacatttctttattgaagcaaatggtgtctctggtcatttcttcactataaggaacatctgatggacttacaggtcccaaattagatgcacgaggctctgatgtgagaggaggaatatcctgcagagagtcaggcaaatccctgaattgttctttgtttaaagaagcagtgtctctggtcatattttctctatcaagatcatcagatggacttacatatcccaaattagatgcatttggctttgataaaagatcaagaacaggattttcttgcagtgagtcggctaaatgcccttgttcttcatttaagggaatagtataatcagtctgggaaatgacatcagataaattattgtccattaaattaggaggagcttcagtaactccattttcaatcattccacaagtgatacgtgaagataactgctgcacctctcgttttgttatataatcaatatcattttcagattctgattcaatggtgttgagagcatccacataattatcaggttcactatcaatatcatcagtttgaaccctattgcggactggtttcaggttgtttgcttcagtaaataggacatgattgtagtcgatgttggttatggtaacaacctcattcacatgcatatttgagtcatgcttttccacaagcctctccggagttttatttctatcacatgtttgactcttagattccactatctcttccttttcatcccaagtaacaccaaatgaactagaggcaacttgcttttccaacgaatcatgtgaaatactatcatctatatgatgagatactgatgacagagtatcatctgtatgatgagatactgatgacagagtatcagctttctgtttcaatcttgtagatgatggttctttataatctggctcatcagattgcatagaattacttggatggaaaacacattcaatgtagccagcaccagattttgaatcaaaagaatttgaataatgttccagatctgatttcattgtcatatctatggtggaagctgtttgtgaggaagaagtttgcccattgatagcagaagaaatagattgcattctgggtagtcaatataatatgtaagtgttgattttgaatgaacaacatacgccaagattaaatagacatatatagatgtaataccttccactagtgctatgcctctgttcaccccttaaaatgtctccattccttcgtgatcttttcttctgtccaacattttttgtgtaagcatcaagaaattgtttgcaaaaaaatcaatgcatgcatatgacaggaaagaaacagggttaaaaataatcttccccttgaaatgctaggatcattattgtaccttgcttttatgagatttccttgctttttcagtttttccagagtaagattcgtctgaatctgcagatactcttttaaagaaggtcggatctgaatatctcctgaaacaagatcctaggccaccagtatcaaatctgatggacacatggaatatttcattaaccagtacaggacacttgatttaagcaggactagttgactgtattcaactctttccaaaccagagagagatgccaaataggacaggtacaagatccagggctaccagtccaaatttgaactagactgtaactttttatcatctagaccttggaaattagtctaagaagtagtacctaactaatcttgctaatctcaaacagaaagacaaaacagggaaggaaatttaacatacttatcaagcaagtgtacacgtggaggatcacggcattcttcatatgaatccataataaagtgaggcaagtcattgtaaatgaaatgatttcgagcagctttcatgtgtggatgccattcacaacctgaaaggaaactgcttttcattaagaactcctataatctttgaacattgaaaccatgatcattaaataatgtagtattgcaaaatgaagtaaaatatacagatatatgctatctaaaaagtgcataaatctagcttaatgccacttgactgcaatcaggttgaatgtaatctgagataaacattactgtcaaaattatatatattatgagtttgctttttagtgtctttcacacatcagcttccatgtcaaacaaatcacaatgtacacacaagatttgatatataatcttcatcatatttacagtaaatcatgaccatatcagcccctatttcatcacaataccttgactcgttgaacatattgaagacatgaatactgaaccaaccacagtacttccagtttcctaaaagttttagaggtctaataacaacataatagcttgcatgctaacaaagatctatctatatattaactatggcacacccaaagacaaatgagatttctcagagcaatttccgtttaacaaatgcaaaagagagagcaaaagcagattaaagtggatatcatgaacaatgaaaagaaatagaaagaaaattcattgaaaacaacctaacttcaatatgatttagctgcctgatcagcacaatactagacaaacaaatgagagcccttcacattacttcattgatacaaattctagtgtgtcaattaatgtttagtgatgattggtatatcaagattctactcaaagaaacaagtttaagaagtttgtgatataatcatatatttaacatgggaataacttctctcaaaagctactgtatttgattcactcggggcataaatatgtttatgtcacaacttgtaaaacggtaatgatttgcattctgtgacattactcaggatgaattaatttaaaaataacacttttttttggtacaaatattatttgaagatatattttggcagggcacatgttcaaatcttagaaatagcctcctgaccccattaggccgccctttatataattttggagaaattctatgtggttttcaaaattcccttcaaataaaatttggtaaagataaaccctcattaagaaaaatacaataactccatctttctgaggcaataacattcagagatgaaattaacatattctgaaaaaaaaaaattaatatttccaataagtccacacatagaatgagataattgcctaaaagaaccataccagctgtgtaagctaaatgtatgtgacttgtttgtgccaatacagccttctccaaggcaggtagtgaagcttcaatgttttgaacctgaaccatcaatctatgactcctggaagctgttgtcattacttgctcttgcagaccatgaaaaacctctgctgcaaaactacaatttcaaaaaagtttcatcattcatgaatatcaacacaaataacaggaaaactagaactacttggattaaattgccttcaccacacaaatattaaacaaggtttcaacaatcatagagtaaatgtcacaattatcagtaactgtgtaattatatttagcctagataacagagcacacataccaaacacacaaacagatagcagaataggttgaaagtacacagtggacattggagagattaaatcgaatccaatacaagaaatcattatttattttaacattaaaattttcatgatttattttaagaaatatgcaaacataatatgggatatttccaaaacaacaaacacacaccataagtaaggctttacatctagcaaaactaacaataattactagctatttaagcgctaattctcacaaaagaacaacttgtccaaatggggttcagcaaggataaggttttgaagaaagaacacacaagatcccacatttgttctactctatcaaaatcaaaatatataatcaaattgcttggagttccaaccttgccaacaagctctataaatacaacaacaacaacaacaacaacaacaccaacaacaaagctctacaagtacaagaacttaaaattttaactcttccgcaaccatagcccaatttcattgtaacttaaatcaaaatataagtttttgaatagtaactcagatcaaaataaggagtaagacagacgggaggaaggtggcatatatcagtaatgacgatccgaaaactagaaaaaatccacaatggcattcaggttagtcgtattccttctacttcggactatatttacagctgtttagctggagcatgacatggaagtattagttaagttaaaagagaaaacctctagaagaaaaatcaggagtcagcacacaaagttagaacaagaaagcatttttagacaaatccattcctcgaaactattgcacctcgtgaaccacccaaactcttagagagaaaatgatttagagtgattatccaaatagcaaccaaggtcgagctgtacacaacttatacgagtctacacaaagctcaaccaaaaacaaaagtcaaagagcattttgtctccttatcaattgaaacttggcccaaaatccgaaaaataaaaaacagacctcaattccaacggctaagtaccattctctctaaacaacaaactcagccatatttggttacaactaaaaccaacattctcagcaacccccaaccttcaaccccattagagcctcgaaactacagaaattaaccaagcccatttccaaaagaactcccataagtataaaaattgcaaattgcacctatttaaacaaacccaaatggaaaaaagaagaagaagaagaagaagaagaagaagaagaagaagaagatgatgatgatgatgatgtcaaagaaaacatactcggcaagatcaccaagttgcctcaagatcccaacaagaccagccacagccacaccatccaacacagctttagggtcctctttgtttgtctccctgtacaactcaggctgccccaaaccgaactcattcctcacctgcaacctcaccagaggcattttcctctcactcaaacagtgaaaacccaaaacaaagttctcttctctgttttttttcctcttttatttacccccttctagctgttaactcttctgctgaaaccaatgaatgtgcgtgtaggacgagaagcattaaatgaacgaattaagaaagagatatcaacaacaacaacaaaaaaatggattttttgtttttttgcgggggggagattttagttttagagagagaaattaggtgggtgtgtggattgaagcagcttaactgccaaagagaagcgacgaagagtgagaaagcaggttaagtgtacggatcggtgaggtaagggagaagaaggacattgccaaccctgcaagccattcttgaaccgaaacgatagtctgagaaaacattggctggaaatttaaaataccaaaaataccctctgtcttttctttaatgccttacgtgtccggaaaaatgttgtgtgataaaatgactggtttgggtctgtgaggtgtgaccaaaccgtggctttctttctatggctccgaaccttcgacgtgggtaccacaaactttttgaggtttggtcaaaatggtaaaacgcaaagggaccctaactctagacatgaatcggaacatgttcaattttgtttctgaaatcctattggggtcaacttatgaaaggaaaaaaataaaatgaaacaaaaattgagaatggcgaagtagtagaattatccgtatgtgaagtggataatgcgagatggtgatgtttatgatcgcaaaaatacggtgcttcgggtgacaattacggatggaatggcttctgatgtttcaatttcagggatttaatgctaagatctacaatgtgttttatgtggtgggatatgtatagcaccatagtcttaattagttcaaggatttaatgctaagatccaaatttgtttttatgtaatgggatgtgtatagctagaatctagaatattaattaattaaaagatattgaaaatgttgtatggaattcttatattgagaaattgatggatttttcaagggtagtagtagtacgtacctagatagccattcataaatgaattataagaaagcagttgaagtcatttacttgagctgctcagtaatggcgactgcatgttacactctgtaatcttttcttgcatggtaattaattagatactaataaggagagagagagggagtaatggcatggcaagggctacataaatctaagtacaaagatggtatttttgtcaaagaaaataagaaaataaagtaaaggaaacgggaaaaggaaagtgatagaaagagatttgtcattaataagagtaaggcgcaaacaaattcatatgtcctttgccatacatcataaatgtagataagggaagttttttcctttcttttttggagttcttaagctatattagccaatggatgaattgtaatccacgtcttttaaaaatttatcgatccagtaattaaatgtaattgtaaatgtattacttgatatagcaaaaaaaaaaaaaaaaaaaannnnnnnnnnnnnnnnnnnnnattaaaagatattgaaaatgttgtatggaattcttatattgagaaattgatggatttttcaagggtagtagtagtacgtacctagatagccattcataaatgaattataagaaagcagttgaagtcatttacttgagctgctcagtaatggcgactgcatgttacactctgtaatcttttcttgcatggtaattaattagatactaataaggagagagagagggagtaatggcatggcaagggctacataaatctaagtacaaagatggtatttttgtcaaagaaaataagaaaataaagtaaaggaaacgggaaaaggaaagtgatagaaagagatttgtcattaataagagtaaggcgcaaacaaattcatatgtcctttgccatacatcataaatgtagataagggaagttttttcctttcttttttggagttcttaagctatattagccaatggatgaattgtaatccacgtcttttaaaaatttatcgatccagtaattaaatgtaattgtaaatgtattacttgatatagcaaaaaaaaaaaaaaaaaaaannnnnnnnnnnnnnnnnnnnnnnnnnnnnnnnnnnnnnnnnnnnnnnnnnnnnnnnnnnnnnnnnnnnnttgtgaggctttaattcgacattatagtcaaacatatgcattctaaaaaatgcacgattcatggagcagttaacagcagtgctaacaaaaacaacaacttagggcattttcaccaaattcttgaggaataaaatatgatcaacagtctctttcgttgagtccgtaagagttgacaaataaatctaaacgtttggtgaaagatttgacttggaacagtcatctagaatctttattggctttcacttcacccaaaacaaatgtcatttgattcgtttgattctaattataatagtactaccaaattgatcattatactactattattcccgagtcattatagtaacacagtaacactctgaaatctttgagagacctacatattcttaatttgtgttttcgaatccttgtttccaccaatacacacaatcacgcataatccctaatcggtaagtagaaagtagaaactcaccatttatttaaatacattttttttttatattgcgtgctatacatgttgtaccaacattaaatatatttttattgaattaagtcatttaaataatatcatatagcttttaaagtttaaatataataaatatttacatcaaacaattattttttaacttttttttcatcattgatacataataaaaaaaaacacctttaataaattaaacaataactattctggtagccaatatttatttttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatttacatcaaacaattattttttaacttttttttcatcattgatacataataaaaaaaacacctttaataaattaaacaataactattctggtagccaatatttatttttacatataattgaattctatttttaatgttttttaaactctcacttcttttaaaaatatttctatttatttgcgttattttaaaattttaatataatcttattcaattttaccctcattttagaggtaaaaataacattaattacttttaaaaaattaaaaacagatataattatagaaaaatatataaaaaataaaaatatattagaaaatttgaaaagacttttaacttatgattatattctcaatccaagtataaaatctttaaatgatataataataataataataataataataataataataataatagcatacttatatttatcatgagctattaaattcatatgaatggatgaaaacataaaataaaaaattcacattgatgatttatttgaatcaatttcatcatttaaatacaaaaatgaaaaaaaaatacatgaatacgacaagaaaaagaagaataaatcatattttcattcagtatcgaatatttatttcgaacatgagcatttgaaacaaatttaaaatggtgatactcatgttgtggtgaactatggcttgtattttgtgtataaataactatgatttgtatatgagccaactattataaagtagtactataattccaacaaagtgccacaacggctctctgcttgccaaatccaatgctgccattaattagctgcgtagtggaaaattcacgctgttgcgtcacagtaatcaatgaagacaggcagtgcccataattagtccttcaatttgtataggtttcacaatattcaaaaggatagaattgaacttatattttaattactttgttaatttatcgtatataaattaaatgattcaagttattggattgtgaaagcaaatatagtataataatgcgtggcaggctagataagtaaagcaaggtgttaacatgtatttaggcatctttggccataattaactgctcattgcaattaattatatattcatccaaaatgaactactcctttctctatgtatgaatgaattaaatagttggatgacttcaattttccattccttttcttcctggtctttcttctttatcttttctttgcggccttttattttatgtgtcattaatttgttgtttactttcgttaaaatatggtacatagaaagtaagatgattgtgctgtcccatttctttacagggtatacgtatcccaaacaagaatgatatttattaattcatacggccagttcaatgggttagttacttggttcctttttcatatgccaatattaaaataagtcaaggtgtaaatacttacttgtgcttaactcttcagtgaaaaaaaaggtatgcttaactctcacttaacacgggtagaaaaaattaaaagaaaaacggtaaatctatcaaatctactcaatttatactttcatgagtagtatattatattgatgtaaacatgttttttaatctcaattatcactagtaaaaaaatttcaagaacacctaaagttataagtataatatctcttcaaccacgctcacaaactttggaaatccctttgcaatagaattttataaatgttgaaaataacttgtttgtattatccgtacgtaggtatcattgtatcaagaaatcatataacgtatcattagtaaaagaaggtgagacatttcatttcttgattttgtttgttagtttgtgtcttcaaataggatttgaagtcaagtctcttaaaagttccaatttttttttttaataaatgaaagattaaataaaaggggcagacagagataacagtttcacatgatatccacgtgagctacgtacacatcccgcaaatatagacaagggcaatcaggtgatgggatcatggtacctgtgctcaccatttctctatatttatattactaaagctacacagatcattcatgcaatgaaataaatcaatatgtatggaggtttcgaaagatatataaatttctaattatgtcttgataaaattaatcagctactaagagttacatcacaaaccatttatttaaagagtttggttagcttccaagatatggtagattcaaattaacacaaaggaaagaggattttctgctaattaacttattcctccaaattcttttcattcgtttccatcaaaccctccatcatcgattgcccagtacgttaccaacgggagacactggaattcattctttcaagagcacagtaaatcgagttatttcaaaatttcttaggtgtttcacaattaaaatttctttaagttgatttttttttttatgtaagttttctttaagttgatgtacatataagaatagacgaaattagcggatgaagcaaataacaagttctataattaattaattaatgttacaagttatatccaatattatcgggaagaaaagcgatgcaagataaatctcttacgacttaggcttattcttcaatttttggttgagatattaattagttaacatgataaactaattatatacaataaatagaatactcatcaaacttttagataccatgtcctttcatatttcaacatgagacggtcacaccaccatcacaaactaaatacatgcgcagttatagctcagtttatggttctggttcatgtgcaggatgtcacatttaatgcatgaatctatattcttctcattgtgattctttccatcgttttctgttactatctcctctaaaattatggcaaataagagttattctaattttctcaccaatccatcaaaccctcttttcttccatgcaagtgaaagtccatctcaagtgcttgttttttctccattaaatggtagaaactatcattcatgggatagaacaataaaactggctcttttggccacaagaacaaattgaagaatgtctatggactatggtagtattcctgttccatactttcattgatgtcaaattcgatccatgcagtttggactatggtagtaagatgtgatggttcttgcatggattcattgtttgatttaggacttgatgttgcaatccatctatggatagatcgaatttgcaaaggggacattctcaaaatctttgatctgctagagaacatctatcctatatgcatcaagatacactaaatgtcactgagtatttcagtgaattagaattcttatatatatgggatgaattggataatttcaagcctgttcctagttaaatgtttgattccttgtagctgtgcttctatacagttgttttaggcaaagtgtttggttttggagacgaaagtcattataattttatggggtgttcggttttttagatttacatgtgggggaagggtataattgtgtggtagcatgctttcaatgctcatgttataaataaaatgttagtaattattaatttgttaatttttgttaactgaatatttgaaattcacaatttctttttcctcatcttttattgttaagtcaatcttatattttcagttcatatattacttatataccctgtgtttttttctaagttttattatcattaaatttcacttgactttaaaaaaacagttacattgtttcagacatgttaaacgtgtgatgcatatttttcctttgaaaagaaacatctaaattaagataaaaaaaaaaaaagactgcttgaaatacgattcaaaccaaacaacagacgtgactgccacagaagacgctgaaatacaagtcgagagataatatgtttggaataaatttatggaggaaaaaattacttgatttttgatagtgaaaataaaataataaatagttacttttattttttattgatattactattactatgattttgtaggatagaatgaattacatgttatccaaatacactagtactagtagctagtgatggccgtggtcaagagtctgaaaactggtgccagggtgaaggatctgggtttgtttgatgcgcttgcaaatatgtctgtattttgcaaaggtttggataagttttctgtcacattttggtaggcccgttataccgagtggtccaacccacacaattagcaattggcagagtattatctgacatgaatggtccaagaggccatgtagcattaattcccaaaagctctcatacattttcatcgcttgggatcatcagatcattctaaacacaataggcaataggcaataggcaataggcaataggcaataggctcaaaactcaaaaagaaagtgttttttttttttttttattagaacgtacaattaaggtaccgaattttaggattcatccaattatggaagggatatatgtaccatagcacctaaccattccatgcttcgaataaaataaaaatatatagcgaactaataaagttgttttcgtgttattaccatgttgattaatggatagtcttagatcgaaaggtaaaattcaaaactttttaagcaatttgtccctgcaaagtagctcaagtggtagttatcaggacacgggttggaatctccctataacacaaatcattgcgtttgatcttccatcaggaaaatgttttgctccttaagtgcagttgattgggtaacatagccaccaacaccccaaaacatcataccatataacataaatataattaataagcacactcgcttgcttatcttgcctcaacctctatcacacatagtttactggttcttgtgaattcactttcataatcgaataaaaggcccacactgtcaccaatatgctttggaattttgtctggacctgattctcttgagaagttggcaaacactatgtccaatagcttttggtcacttcttaggctaaataggtctagccacactaccaaccccatacgatccaattatggtcattccggaagccagaagtacataaagaaaaaaaaaaaaaaaaaactccaattatgttagcttatggattggtcagtacctacataattgtgccgaaatttgagatccttaagtcgacccacataggctgaagtagtagccgggtatggttgtcttcttagagctttaccatatggaactgtatcaaatttcccattatctttcttttcaaccattgctttgcctgagccatcttggctttattgcttagccacaatggattcaaacatgatctgacaagcagtgggaacacccaaaatttggtgtttagcttgttagcataattgaatcagtcttaaaaatttgttcctcaccccgttggggaatattattgataattgatatgattagcctgttatttggcttatagtttatgggcttatagtatggattgttaccattagactagcccaaatgcccaataatgagctataattagattatgcggaaattattacctcttaactcatttttttaaatagttttatcaattttaggataaattttaaaattaagcgaatgtttcgttaaattcaggctaaaccagctattgtacacattgtagctcgaacaaccagttatcattttgggctttgctgagaattcctctcactctttcagcatttccctggtgtctttgaagagaattttgtgagtgagattttagctagtttcatgtataaacaaaaagacaaaaatatataaagaacatttagcctcaactaagtaaatttctgcttaagatattcttatttgctcctgtaatcttattgttgtttcttttagatacgtacatatatacttagggtgccttagttctctgataagatggttctagagagacaaataaaaaaagaagaaagtcaagtgtcttaaaaattctatagagtggtcatagaatattaagatataatttataatgttatttagtttttattttaatttcctaaagtcaggtgtaggattataattatttaattgttggcatttgttaggttagatacataatttcctaaagtcaagtcaaatattaattttttgtcataaaatttgatgttaattgctaatgtactcatactaaaaaacaatgagtgcattagtaatccatatatatatatatatatatatattaggttatttacaatatagtagatagttattaattagttctctaacactcatagatgggttgcatttgtcatggtgtgatcacaattcacaagaacacatcttctcaatttttacattgactgatctgacaagaatatccttttacttgacgccttattcattattatgagggcgttcttccttagttgtcttccaaattctttctcaaatcaacctagaaaacaccaatcattataattttggatcctaataattaacggagacttaagatagtttatccacccctaaagtaatatcgatacatacaaaaatagtttagttctctaataggatttcaatatatccttacagaattttatctttttggttaaatatgaggctaatttttttaaagattttagttctttatcttttttctcaagaatgtattttgtaaaaatgaaacctgtgtcaatttcttacaagttgaacctatgttttttattttttaatttttttttgaatgaatataattgattttcttactctacttaaagaatgtacttttcaaatcaataatcaataaaaaaaataaaaaccttaatgagtgatctcaaattcaaaatctagatattcagttagttaaatactcgatggaatttcattaatgataccaagttgcaaccttaatgatatcctgaacactaagcaaatcaaaataaccaaatcaataaataaaatttcattatgaaccactcgcaaatgataccactaaacgagctgtactcaagcagaaaaagatggttacataatgcatatcatttagttccatgactactaatgacaatatttcttctaaataatcccctttttattggcaatatatctaagagaagttggcatgagcaggtaagaaccttttgagggacaaggcatttccagaaactttagaaaatatcaaaatcggtaattagagattactaattccgaaggaatctgtacacagatccaacttaattagaaaacatttgagctgcctaacttccagacccatgcatctgccctttccttaaatagggagattgaatttaatggggacataattacataaacacctttaataattagtgtatgtttttcctagaccaaaaaactcctccacctcaatttacaagcccaaaagtcatttcattttttcaccactctcccgtatctacaagatacacatttttatcttttgaaatttgaaataatctagacaaggaatgtttcagagtaatattagccaattatcatgccaggacaatttccaaccttctctacaccctgttttggaaccaattcagagtaatattagcacaaactcaatattccctccgtatctcgatcagtttttgactgagattaattattaataaaattaatgaatatgataattcaaaacttttgaagagggaagttaataacaactgtacacggtatggttcatttaaaactgcggaggattcacatctatttatataacttttggggaaggggagtgtaataacacgagactgatagaacttgacttgtatcaagggttaaaagaaggatttactctacaaattactatattaacttgattagtatagaagacacatgaaaatgcaaaatccattacatctttgggggttcaattatttgtcagagttcatattagagtactaagcgcatttcaatagattcaagaattcatatataataccccaagaaaattcttcctttatataatactctaccataacaacacaaacttaacctttttgagaaacaagattttttttttatcaaatgttaatttattaattttattaaaaaatgtaaaggattcaaactactacctctcgtttctctctttttccttcaccatttctccggactaagctatatctcttttttaagtaagaagataaattgtagatacttcgaaagtctgcataaaaaaaatcatctgtcatcactccctgttccctatcctatccctccaattagatcttttgacatataaattaaattttctaggcaggttatcacctgaattggacgtcgtcctacctttaaatcacgtcaatccccatgtaaaacctggaacgttcgtgtcttccaatttgtttttcatactatcaaattgctctcttcctctatgttgattatgttttgttccaacaccgacacctcaagccaattccataagcctcatcattactaacaagaacttgggacaactctaatttcggatttgattgattttgattattttggttcgttttataataattaaaaattgtttaatttggttttaaacacctttaataaaaaaatattttaatcattacacaatgaaaatgttttaaattcaatcataaatcatcaaagttatataaatttcatattaaatattatgagatacacattaattcatcaacaacgctatgtacagtccacagataactaagtttttgaacatattattaagaatttgattcctaaccatgtaaagtgttgggactcctgaagactattacttggatggctgatctaggattaactcctcatttttaatctgattacaaattaattgtagataaaattaacaattttgaccaaaatgcttgtgcgttaggatacattattcttcaatgtaaaaatttgcacaaaacccaaactataggattcagtttgataggaggcaagcgaacattaaagcccacttgtaaaagtacgtggccacaattcatgttagactcaaagtttatcaacatattttatcttccaatttattatgaatgaaatttcatgatataagttttgtaaaaaaaaattaaaaatattttaattgagaaagataaaattcatttaactgatttctacccctcgaaagaaattaatatctgattatccattaaaagtattcttttttataggggtgattaaaaaatatattattggtgtacacaatatatattattgaatgagacagagaccttttaggttcaatcttaataattatcgatgcaaaagtgaggcgccgcttgcatctatgattgcatttttctgtattttttcgattccttacattctgcaccacaaagagcacaaaagagaggaggaaaaaaatattttttcagcttttcattttgattatttaattataagaatccacccaatcttagtggtcgccctctttgaaaaagttgccaaatccttaagagctcttcttttgttatcccgtatcctgcattcttcccagctattggagaaaagagggaataagaaagacacatagtgaagtgatgtgaaatttatttgaaaaatggatgttttcatattcaaattttacgtgataggtttatgtttattttctttctataggacatttaatgagtaggacttgatataaaaattaatgtagagaaaaatagatataaaatttgtacttgacttactacgtaatgaaattaggaatgtagttagttatcttgatcttaatgggatcatggctgctaaattttcatattttcttcgttttcgtaaatgtatcttttttttgtgcgtaagagacaataaattttgattttagtttgtgtttagttcataccaccattaaatttagtacaactgttaaatctgaccatggatgcatagtgtaaagcaaaatcaagtttaacttaactagtttgagttacgaagaaacaaaactccatggtgtgatcgatctccttagttggtgggagtatttattaaaaaaatgatttatagattattagtggcatgataccggaaattgttctatgaacatgttttatttcattcattactcacaagatgtgtgacaagattagaaattagtctttatcttgattatgacataaaagaagtcctatagtctgagtttttaaagcacacactatacgctctttataagaataaaaaaaagcacacaatatacgcttgtctttctcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaataaaaataaaaaaactaaaaaataagcaaaaatatttagaagaactaaaaatgctgacagttaattaataaaagactaaaaattacataattttttttgaataacaaaaaattaaaatctaaaaaaaattaaaaaactagaaacttaattaagcctaacggatcagagcattgtcattatttagttgtttccatgtcaatttatttctatataagaaaaagcacgacaactgccagataaataattctagtaataaattctctggtttggaacaagaaaatgcttattttcacccgatccacaatgataacacttacgtttcatgagacaaacatgaaaaattcttttagtggatcaaagatttaattgtcgcacaccgttttccagtactatataataacaataactaagaaagtttatattattaatctgcacattaacttactactctacataacttttgtaatctacacactaactactttgtctacattttattggccactgatggtggaacattcaagtaaaaaaaaaaaaaaaacataaatgctcttggataagaaaaggagaatcagaaccagaaataaactagaatagagctttgctcaaggctcacgccatcctgcaaatcccaaaggtcaaactctattgtgttaatacctttgcatgatgccactgccactaaccaaaccatttcccaatcataaccatacccaaaagaataagatgcttaaactaaagccatatcccgctcatttatgcaaacttagcataacattaatgcattattagaatataatgggaaagcaatgtgggaactttcaattctttttaccacaaatttatctctttggccttttcttcatccaacctcacctttccctttacttcttttttttccccctcacttgtttgtagtggggtgaagttcaacatggctttgcactgcatagattagacactgatgaatgaatctgtcctcccccatttgggggtccaaaagaatttcttcttttttcccacttcagaaaaaaggaggagaagttatcaacttgaattaattctattataatcacagctcagtactgtatagaaagtgattgtagcattatgtcaccttctctccttaaaggatgactgacactgacgaactactgtgtcattttcataagtgaatcaatagaaataatggtaaataaaaaaactcaagtgctggcaaaagcataaataatatctatcatgtcgcaatcaccttccattatgatccaatacagaattacacatattacagtgacacagtagtaggatcgttctatctgcatctcaatcatagcttatctttgtaccgtgtactattctaaattccgagtttcaacaattaaaggcaaaaaaaattgaaacccattacaaacttcttcgcttgtttcacctcttccagaaaattacaaatttataacaccgtctgatcaatttcatgccccactaattgtagctcgaccataaaaactccaaaaaaaaaaaaaaaagaattgctatcaaaaaccaaggttttaaattaccgttacagttttgttgcgatctttaatattacagaaaatttcagataaatgtagccgatacagaaaattttactaccacagaaaccataaaaccttgacgtgttgtgttgcagaccgttttataaaaccttgatgcatatgaaaacatactcaattatggtctaatataacttaaactctccaactggttaattacaaacctcatattatatggacaaccctatgtacacagcaacctttgcagaagcagagtaaaacattaaaaaaaaaagaagaggaattatttattttctctctatatattttgaaaaaatggggttggaagcctaaaatatgaggattataatataaactatatggacatgacatgacccttaggcaaaggttgtgatttgtgaaggaagaagaagaagaattgttacatatcagaaggtgactcagaaatgctctccaagtgaggcctccacacagcaacacgccctcttcttctgtctctttgcgttgacaccttctctgagagtatatcattcaagtagcgatcagaggcaagcaagctagtcatagacatagtcatggacacgttggtgttgttccttgttctctctctgtgttccttcttcttcttcttcctctgctggttcttctcttgtggaggagaaggagggagtggcatgaggaagtaaatcttcccacgttggagctctgcgtcgggtggcaccaccacgatcttggggaccccaccgccgacgccgccttcggcggcatctgctgcggaggagcacggcttcttgaggacatgtttggggtgtgccttcataacatcactggccttgatggtgccactgatttcttctactctgccattggagtgcactatgcggatcacgtcgagagccccacatgggaggatgcaagagatgcagcaccttatgcagtttctcatggctttttcttccctccctttttttgaattggtgtctcgaggaggagtaaataatatactgtgggggaggaaacggatttgactatttcttttagacttgagattatctttgctcctttctctggttttgctaatctttaattagagaggtgcgaaattcggtcgtgtaaatgaattgcgcatcaaaatgatccatcttttaaaggaaaaatataagttgttaacccctggaatcatgatgtttttttactactaaatgaatgtataaataaataacaaatatgtgtatacatatttagggtgcttataaaaatttcattgaattaagtcttgccgtctcaccaaagtgaggctagaccttacgattccaaaaatacttataaggatatctataaactatatttataatgaaattctcctattgacaaatgaattcaaactcatgaaggcatgagatatgaattttatttgtatctttatagcctactagaagagaatgtttatgattaaacaaagataatttaaataaaaattaatagaaaataataaatgtgcagattatgttttagataagaatatggttaataaactcacagaaataaaaatattctaatataataaataagaattatatatatatatatatatatatatatatataagatttcgccttatttttgaaatttgttattttttggtttgctgcttttgagtaggtgggaggaatattttcggtgctaggttgggagaaaattcatggcgtgaataattgtataacaccctgtagtttggcttttgatacataatttggggaccctaccctcatacctcgagttaatactctcttccctttattaagttcaataatattaggttgggaggactgaaagattgggataccaatggtatattaaacgatgggacttctcagcaatcaaaaacttaggaccccttttgaatgtgtcatgaaaagacatacgtgtctcaataaaaaagttgacacttgtagacccctgaatgaacaatattaattattaattatttaacgctaaagtttggttgagaagggtggtgaagtagggtcagtcaatgagagaaagagaacgtgttttggtttggagtgaaatgggagtatgagcgctgggaaatggggtacagcgtagaggaggtaggagagttcgtgatcgttcaatatccccaagcaagagcatgtggattgtggttttcattggaaagtaaagtgtaatggcttttaggtttgtgaagtgctttgactatggccaatgtgtttgtctactagccacatctccaagagcaacccttccaaaatgcttttatccgtttcgttttctttcttttcatacatggaatttcaccattttgccatctatcatacattatacattgaattaaagtcaagtacacctacttttctattctgtccattagtaccattaccatatagatattgatgaggtaatgatggtaaggcataaacattatctgtacagtagtgcaaaactctctttggggcgccgaagcttcaccagtaatcactttcttagataggtaatgagataatgattattaggtattgtctacacagattgtcactctataatgactcatatgggatccatgcaaaatttaatgacacagctcaaatcaaaattatggcagtaccacctgtgtacctcagaaagatacctaatatctatactagtagactactatacgacaagagatgttgctctcctttcctaactgttcaaattttataaattataagcgttaagatttcaacttcaaatatcatagttctcttttaaatagactcaactgaaactgaatgacacagacaaactcacaaacacgttatttttgtcatgaatgtcgccaaattgacattggatggtgtatgttttattccttgttatgtaaagaatggtagctcaaacttcaaagaggctttaagtaaaaaaaaaaaaaaaagaagttaaattcataagataatgacatccaagaaagtgatttgtcctaatctattagggaaagctaggaagtttagaggtgattgatgatatgatttagtatatgcatgtcttgttgcgttatggaactttttaattaatagccattagccaagccttgcgagaatttgccaaaagaagagatgcagttaaaagtatttaattacctgttaatttgagttatgtcacatccataatgtggcccgctctttaaataagttctgatgtagatgttagtgggcatcatgtgaggcactgagggagggtccaaagctgggctttgatattctatttgctctgatcatccaaatttggatgccaagttaacttcgttttattatgcgataagactgacttaagagattaacattttccttcatgagttgagacgagttctattcccccacgcggcactcgcattctttttttttttgttaaaaaaaaatgttatacttatagtcttatactgtacggtttaggagctcagacaggtcgacaaagtaaggacccaccacgtccttagtggagatccctgagtgacggttgaatggagtagttatctagttggtaaccttcttcgtcttatatgtaaggaaaaacgataaanaggagctgagacaggtcgacaatgtaaggacccaccacgtccttagtggagatcctgagtgacggttgaatggagtagttatctagttggtaaccttcttcgtcttatatgtaaggaaaaacgataaatgttattatcaacttgagtgtggaaattctattctaacataaggactaacatgacttgtgttggagtctcattgtaggtattataaatattcttagcacatgacggagtcttaattctgttccttaatcagtgttggagtgaacatattatatcttaggagacttgtatatcacgtagataaattaattcttcgattaatgaaatgaaaaacaaaatatatagtctctcaaagtgtagtctgtcattcaattaagttaatctgtccattaagtcttctacgataactttgaagagtttaaagtctatatatgtatacaaagactattttgaagagtttaaggttaaatatgaaaacttgcaagtcctttaatttatattagtcactaaatttattgtcatattaacctttgaatttgacatctactctactctcatacgaaattaaaaaacattccttgaaattcacaactaatattcacagtctaatataacgctgctataatttggttcatactagtctacatacactgatgaatgaattgcagaaatttgttaaaacaagcaaacaaagaatccagaggtattataaactgctaacctatgtcacaaagagtctcctccattatgtcaatgtgccaggataactaaaaagcagtacacatttacacaccgcaatttttttgtgcaaaaaaattgcagtgttgctctctgtttgcaatgagtttacaataagctgaagagattaaaggaaaaaggaagacgagaataaattattccttttttttttattaactatgtttttcttttggacttttgcgttatctcattcctatgattttctttttgggtccaacttttgtgtttgttattgatggactggattttaatttatcccattgatcgggtttgggctttaagataattatttcagtttggattttttttataacgggccacgtgtttcttttgaatgaattctattcagcaagataatttgttttttaaattcattttaatcgtgttaaacttattagatactagagtaaatggtgtctaataagttctaattatactttatctactattgaatttaaactaatgacttccgccgtatgaaagcaatgttcttaatcacttagttaaatagattattcttcaaccattggatgtagttcaatnnnnnnnnnnnnnnnnnnnnnnnnnnnnnnnnnnnnnnnnnnnnnnnnnnnnnnnnnnnnnnnaaaataaaataaaagtgcaaatgagaacaaaaaggatgaattttctatattgcattattgttatattaaagaaaagttttgtttttttaaagaaaaaagagaaaaaatattttttctattgtttgatcataaataaacgaaagtaataagaaaacttcttattaaataacatttatatcatttttaatatgatgatgaattttttgttttaatgaaaacttctttctccttcattttctctctcaaattactttttttttttaagttccattttttcccgttccccattgtttccttttcagtatcagagagagcatctttggtttgaagttgaaaaagattaattgaatttaaatacattttcatatatttaatttcacgctaaagaagaattaaaaattaattatgaggtcaaaattgatttaggattgaaataattttaaataacatttgcattgaatccaaaattttatactaaattttactnnnnnnnnnnnnnnnnnnnnnnnnnnnnnnnnnnnnntacaatccaaaatttgtatgtcattttccttctttgcatttattttatttccattcactttaatgtcaaccaaccaaagcatagtgcattttttttatttatttacgccaatgtaaacggagaattttatgttgtcatttttactgttggcataagcatcgcacaaataaatacatgaacaaaaacattctatgaaaaaatataatctttctaacagcatcgttcttttaaagaatgtgatatgtttctacattttcttagcatcaaattgatctttgtttggtaggttgtaacctgtgttaacttatgtaagaaagataagtattgttttagccttttaggtgcagagtatattttgtacgttatgctatttgtggaacggagatagtcgatcatcgctttatcttggccaatgacaaatcaaatttggcatgaaatgtatgtttgtattgattatacaggcatttacctaataattaacatctcttatctatacatctattttaattcacttttgagaagagaaaatttatcttatgttggtcatcttttttggtaagccataagtctatttaaattgtgtgaaacaaaaatttattccagtgatcaatatatatttatttttctgattgctttttagatcctgtaacttgtttctatttttcttttttatttgacttggttatatacaaattaaaatactccttgaactatgtttttttagttaattcaatgcgctatatatatatacacactactataaagaaaaatacaatgatgaagcatgcatgttgaagaaaacgcttgaagcaaagaaaaaaccatctgcgaatattttaaatcacatgcaacagaggcatggttccattttctaccttcacattatttgaagaaaaacttgttctgtgttttatttttgcctttcacattagtacaacgtggaagactatggtcacacagaatcatatcatacatacgtccgatgcttgtctctaagaaaacaagcactcgttgattgaaccttaacggctcaaagaggagagtgatccactcttctatgagctttgttaacgccagcagacactagtgtttctggtgtttctgatttctccttagttgggtatgaagcgaaataattcatcccacacactcctaataaattacccgtgtttctttggatccaaatgtaaccatcttttccccaatcttccccccatgaatttttcgctatccagtaatctacaccatcagctgaaccatatcccacaagtaaaacaaagtgattaatcccatacggacttgtacagtttcctccatcataaattccctgtacaaatcaataacaataatagtataataatgatataatattttcccaaatagtaagatattgtatatattactgctagtaattagtagctttgttctagaacctgtgacatttgaggaaaaatatttgtcccataagtattatatttaacttttcaatataattttaattatttttattaatatttctcataaatatcactttaatttttaatataatactaatattattttttcatttatttaataaagttaattttacaaaattattattattttttattaatttatgagtttttttttgtctgacttaagacaacacagaatatatattacttaccccagtgtagagatgaaaatcttttgcatctatggagacactaattggttgctcaaggatggcgcataagaacgctttctctgtctctgattctgtactctcatctgacattattagagtttcatatccgtcaattgtaaccttgtcttgtatctactcccagaaagaaaaagaaaagtgcacaaaacaaagagatgaagggttaaattaattaaaaggaattgcatgcatgcatattcagttaggtattcacagaccttattggctttgcatctaccctctttagctctgtaaggataatcagcatcagtggcaatcccaccatgttctaaaacccattcgaaagattgatagtgccatccattgtaacaaccttcgctttcttccacacaatctacgagttcttgttcagaaaggctaacaaggtctcctgttgctattgcatgtgctgcttcaatggctcccgtggcagaaaatgcccacccactccctatcaaaatggtttcacactccacaagtcattttcaaagagagaaaaaaatattagtgttaataattagtattagtaattacgtactaaaaacaatggtttcatgcacataccacacgagccttggtacttgacatcagtgatgacaccctttttgctccaatcccagtattcaggtgcatcctcacaagaaagttgttctttcttcaattccttgttggccatgttgatgtgtcgtggcacatccttgggagcttgcaagtactttttgctgaactcttgaggagtgatgtcagcaaacttgttcaaccccaaacgatgagagtggggtgattttctgtttgcattcacgtccctgatatagttcaagttattcttgaaaatctcaagtctcgttgcctcttcttcttggttatggtagacccgtccgtgtgcactcttccatagttggaacagtgaagacacctgtttctgtgtggtgaacttagctaggtcaaggtccaatatggaacgatgagatatgctggaactagaagagagacctaagagggagaaaagaaccagcacaaggaaacccataacttggtggaaagtttttatggcttgaaattaagatatggtcacttcacttgtaccatctcgtatatatagtgattagtgagctagctagtaatgactgaagaagttcccacgtagttatgtatttggtttaaattaatttctgatacgtaattgaattgtgatttggaaaaatatatttaatttggacacccaaatgcttagtgagagaaaagagaaaattaaaagagaaaaaatataagtataataagtaatataatgtgatagaaaataaatatgaagaaaaataaaaatataaatggggtgtctagagtagaggaatgtctaaataataacactcttatgatttggcttacaaacatgcaggagtggagtgacagttcccaactttttttatttttaaactagaactttcgtattattttgatatgaattttcattatgcagcaggcacagttccaaagccagtctagccagatatcttttgattattttggattataaaattggatataattctctttctttatttaaaatttatctctttctgtaagttttgtgctaacacaaaatgatttttcattatatataaattaaacttgtatatacccattttaaaaaattcaattgacgttaaacgtgtattctatctgatttcgacttttagggcttgaatcacgatgttttttatttatttagttataattaatttgatgtgaatgtgaagtagggcatttttcaaattgtagcctcactataaccatacttgtttcggtttgttaaaatttaatcaagtgaaattgcagcttactgcacccagttgggtttcaagcgtatttttatcagcttaattaattatttcaaagttgaagaagttttagagtttttgattatttttttttctcaaaaataatctatatatttatttatatgtccgacggcaatgtgtgtctgaagtttaggtatttggccgcatttgattgttatttgtctcaggtttagatcatatgagtctttccttcatttggttcatatgcaatagttacactcatttaggttacttaattagcagggccaaaaaaatatagcataaagcaataataacgcatgtatatagtgatatatatatatatatatatatattaaaaaaatagggcatatataaattgaaaggaatattagtatccttaatttacttgcatgcacttttgtctcactcacacgtgcaaaatcgaaaaatcattcaatattgcaggccttgcactcaaatgtggtccataatggacactgcattcaagatgatgtgtgatataattctggcttttgtttacagaaaagtctgcactgttaaaattattgttctataatcaactgaagttttgtccattttttaaagtgcgtacacgtcttggggaacgatgaatcgttgataagcagcgagcctcataagctagaggcacatcaccttcatcagcgttagtgttgtttgcacctgcatgtgctatttgttattttagttggagttttagtaataagacaatgggacctgctacaactcaatgtattttgagaggtttttttaattagcttttaaattatatcaacattttcagttttagaaaaaaaaaattagtctaattaaccaaattagtgaagggagaaggaaacgtgcaagaaatctcttaagtaaaataccatgtttaaatctttttagatgaaaaataatgattaacagaaaaaaaatcttattaaaaatagttagttaagtttacagataaataatagtcttaattaagtaaaattattggatagtctccactgttatcatgataaccttaaaactggaaaaaagaaaaccttggcgtccttcttcccctgaacctaaaatgacaatcaaaatcatgtccacagacgaagacattttatcctttcttttctcctaaacatagatagaatcacgcccaactcagtaaaaggtacataacgagttcaatttcaagagaatcaaggcgaatgtgtgcgtcctgaataaatcataattgtgttatatgagagttttccattataattgtacgtcatgttattatgaggattgagggttgttcattcggccaaggccgatcttgactggccttgtattgatccattacgcattaaaaaaaagaaaaatatttataggcatctttggattgtgaatttgatctgctggtgagaaaagagagaatgttagttttttattattcatagtaatcaaactcaaccattatgaggtttataacaatcacaaatattactcaaccaactaaccattggttaaatatatttaaagcttaaaatgacagattgcactattaaagataattagttaaatatactttctggtaacttaaaagcgtgaaatattgattagttagaaatatattttataatttaaggcaacattcttaattattattttattttaaaaaatcttaattagcgtagttaaaacatttaattattttaaattagaaaatatacttgttctaattaccttaatttctacatttatataatttatgaattaaaaaatagaaaaaagaataaatattttcgtgctcaattgcattacttttattataataaaaatgtattaatagtttggattttgctgttactctatcaaagttacatgtcatttgatctctcccttcaggactaagcttgactcttgaagcttttatgtgtagttgtgatattattgggtgtcgtctttaaaaaacaaatcaacctttcgacgatatacagctagcaaacgggaaaaactaaacagggcattatacacacacatattgaaacacatgcaacagtagcagtgttctattttatttatgaattatgagaaaatatagttgtgttttattacacagaatcatatacaaatatacgatgcttgtctctaacaaaacaagccctcgttatatataattaattggaccttcacggttcaaagaggagagtaatccactctttgatcagctttaacgcgagcagacaccagtgttgcagctgatttctctttggttggccaagaagcaaaaaagttcatcccacatactcctgctttatggcccgtatttctttggatatatccaaatgtaaccatccattccccatgaattttttgctatccaataatctacaccatccactgaaccataacccacaattaaaacaaagtggttaatcccataatgacttgaacagtttcctccatcatatatgccctacacaaatcaatgaattaataaaattattattttttatatataacaataataaactcccaaatatatactaagatattacagttataattacttactccagtgtaggaaaaatatcttctcagtccaaggccacactaattggttgctcaacagtggcgcacaacagtgctttttctgtctctgatggtgtagtatgatttgatagtattagaccatcaaaaccgtcaattgtaaccttgtttggtgctaattccagaaaaaaggtgcgcaaaacacagagataaagcggtaaattagtaagttagttaatgagttatattgtcaaaaggtaattaaatgaaagagggaatggattatggaatcgtacatattcaattcacagaccttattggctttgcaagtaccatttttagctggataaggataatcaacttcagtggcaatcccaccattttctataacccattcgtatgcataaaagtgatatccaccgtaacaaccgcggctcttattgacacaacctacgatttcttgttcagaaaggctaaaaaaaggtttcctgtcactattgcatatttaaaaaatgcattttttgcttcaatggctcccgtggcagaaaatgcccaaccacttcctatcaaaatggtttcacatgtacactccacaagtcatttccaaataaataaaaagttgaaccaatgttattgttaattagattatcttcttacttttgtaaaaactctcaaatatatttagtagacaaacaaatattaaaaatgcaaaactgttttaagcaaagccttagtatagttctaatgcaattgtttatattggttcttaaaagttaaaattaagagacctgagaatgctattagaacaaattaatgaattctttaaagtgcttacataagttgcttggataaataactgcaaacaaggttgcttaatcattggaaaaataattttcccaagtcaaaatttgaattgttgtgtatgtgaaaagataaaatgagactgatcaataaaaataagttaaaaattcaagttgaattctatcatttgaatgaaaattattgaatatttttaaatcttgtataagaataagaggcttattaaaaagaatgataatattcgtacactacaaaatgagatggatttggtggaaataattagagagagatggaaagaaagaaaaatgtagatagagaaagtaatggatgcaatatataaaaaataaatagagatagacaaaaaaatatggtgaaaaagggatggaagaaaaagtagatgaataataagtattttcctgctaaaaatgagaattaagaagctaaattaatttttttcaacagaaggcttcttaataaaaacacatgccacattgtccttggtactttacttcggcgatgacacccattttgctccaatcccaggatgcaggtgcatggtcgcaagaatattgttccttcttctttatttccttgttggccatgcatgttgatgggcagtgacacatccttgggatcttgcaagtatattttgctgaactcttcaggtgtgatgtcagcaaactagttcaaccccaaacgatgggagtgggcaatggcggatctaggttgataattgggggggggcaatgccccccccttaaatatggagcagagagaataatgttggtggctagtggaaaaaaaaaggcataataatggcagaaagaacaatgccaaagagaaaaggaactgcaatggtagaagtagaggagataagaatttgggtctaatttacttttcgtattcacattttttctttttacagtttcatattacattttcaaaataagcttttgaattttaatttagataattgctatttatagtctttttattattaatacactttacttgtattatcaaatttaattgttattttgtatttttagtatagaattatagataaattttcttaattaaataattttagttatatatataatataattttaaacgaattcataactttatacataaaatgttgatttaaattttttttacaaaaatttttttcgggggcaacctcaccactaaatatgcagacataaaaaaattttcttaaaggtttgagtgcccctccttaatttattttctggatccgcccctaggagtggggtcattttctgtttgcattcacgtccctatatagttcaaattgttttggaaaatgtcaagtctctttgcctcttcttcttggttctggtagacccgtccatgctccttcttccatagttggaacagtattgacacatgttcctgtgtggtaaacttggctaggtcaaggtcgaatatgtaacggtcacttgggatgttggaactagaagaagaagaagaagaagaagagagacataagaggggaggaaagaagcaacaaaaggaaagccatgatgattagagggtaacgactgatgaagttcctacgttgttaggatacaataatgattattatcctaattacatatgtggtggatatgtttttggtttgcatttgcggtatttaattgtgattaggcctacaatctagctatagctatagggagtgtcacacaccaaaataacaagaattaatttttaaattaagcttttgattgttgtgggttatcaaattgaagatagatctctttctttctttaagatttatcactttcagtaatttttgtgctaatacacagtggattttccatagaatataatcaacttgcccgtagccattttaaaaacattcaattgatgttaaacgtgtaatattctatctgtttgtaacatttaattagtgcgcttgaatatcattttaagataaaataaaatagtatagacaatgacttatgactctagctctctctctctctctctctctctctctctctctctctctatatatatatatatatatatatatatatatatatataacaccttttgtttacataaaagtacatactgcactttttattatcaggcaaataagatatataacaatataagtacagaagggtaccaaaacccatatagaagagatagcccttccaaggttaaacggtatttatatgcacatgaaaatataaatacaatctaaccaggaagaagcccaaataataacatcagctatccaacctaataccctacaaatgatcccctctaatgttcacagaataacacgttgcacccaaccaggcttcccaaaataaatggcatttatttataatgcctaacgccctctgataggacttgaatagtttaaggttggcacaaaatgagcaaataacaaaaaattttaaattagaagttaatttttttattattgtgggttataaaattgaagataattttctttctttaattaacatctgtctctttctgtaagtttcgtactaatacgaaaggaaatttctataaaattatcaacttgtatgtactcttttcaaaaacattcaattgatattaaacgtatctgttttctagatttattgaccaaataacaatatttttctaattaaaactttgtattcttttgattattgtgagttacaaatttgtagtttgctttctttctttaagatttgtttctttctgtaaggctagtgtgaaatgaaatttctgtaaattatcaacttgtattatattaccccttttaaaaacattcaattgaagttaaacgtgtattcttatctgttttatacaattaatgcttgtataatttgaaatgtttatttctttagttaatttgatgtcccgcaaatcctatgtttaaagccagatggatggacaagaagtttcaagcttgaaagcaagtttcgtacgcacaacagccaaactattagatttcgttcccctgcccggtgacatctttcctccttaagccccacaactagaaaaggagaaaagcaaaagactagtccactaagaatagccctagttaggatctctgtccccttcttaaactatggcatgccacctcttctactgcaggggattctcgaacaatgaaaagcccgtatttttgtcctaccttcatagaagaagtcctatgtcgtctgtggaacattccatacaaaatattttttcaaattttagcctcagtatacaaccataattatgtttatttgaataagcttccataaagaaaaaaaaataagagagagaaaaaaaaggtaatacactaaaattagcttatatagatgcataaattacaaatattttttttagagaagttatataaaaaacttttataaattcagttatgcagaagttaattactctcctctttttatttaaatttataatttttatggatggatcatccatgaaataatttttaatgaatgaattagataaatttttgttaaatggattggattgaaacaaaaatttaaataaatttttaatagatcaaaatgaattaataaattattttgatctgattcattttatcatccctatatataactatatttaaattaaacagtaattcacacactatgtagtcgagtgtttttattatattaataataaataaaaactcttttagtactttaatattttgaaatatttattgtcatagatgtgaagtatacttttcgaagaaaaatgattattaaacactctttggaaataaagttattaattcgattcatgatataataaaatagaaagagagatgagaaaaaatagaagtatattaataaatatttgtaatttgtgagtgttaaatcacgatcaaaaccactaaactcatgacanaggatctataaacaaggataaattaaaaggcctccaaattaaaagagtaaaggtttccttcattaaatatctacgagattatatttattaataaatataagtgcaaaatttcatcaccaataacatgtcttgttgacattaatagagaccatattgtgatcgagaatcacctatttctttttaatttctcttaaattaaatatttttatttgtattttatttatcacattttcatttattattttcatcgactcagtcacctatttcttttcttccttaaaaaaaggtcgtacagtaaatatgtttaattacctaaacttcatacacacatagttgccgtcgaacatatatattaatcttgactcattggtgtcttgatgcttttatatgtgtagttgtgtagttgtgatattattaattgggtacgtgccatctttcaaacaaataaaccccttcgactctacccagtggagaaaaaaaaacggtaatattcctttcacgtagtcgagtaaaaggaaatacactggagaacctatgaacgatgaaacatatatggtaaagagaaaggcatgaagcccagaggatatctcaaaacacatgcaacagtggcagtgttctattattgactttcacattatttgaagaaaaattagttgcgtattttatttttgtcttctcacattaatacagcatggaagactcgtgatcacacgcagaatcatacatgcgatgcttgtctctaagaaaacaagcactagctacttaattaattggaccaccttcacggttcaaagagaagagtaatccactctttgatcagctttaacgcgagcagacaccagtgtttctgatttctctttgatgggccaagaaacgaaaaaattaatcgcacatactccaattgggttactgatatttctttgaatccaaatgtatccatccattccccaatcttttccaaatgaattttttactatccaataatccacaccatctattgaaccataacccacaattaaaacaaagtggttaatcccatacgtacttgaacagtttcctccatcataaattccctgcacaaatcaatgaataaaaataacaacaacaacaacaacaacaacaacaacaacaacaacaataataataataataatccccaactatttaagatataatatagtaattacttacaccagtgtagaaatgaaaatctcttgcgtccatggccacactaataggttgctcaagggtggcgcgcaacagtgcattgtctgtctctggttgtgtactatgatttgatattattagacctccaaaattgtcaattgtgactttgttttgtgtctacttccagaaaaggtgtgcacaaattaaacaaaaagatgaaaggcaagagtaattaatgggttatatatacacaagctaagttgtcaaaagaaggtaacagataccttattggctttgcatgtaccatgatcttcagctgtgtaaggataatcaacttcagtggcaatcccaccattttctataacccattcaaatgcatgaaagtggtatccaccgttacaactgttggctttatagacacaatctgtgatttcttgttcagaaaggctaacaaggtttcctgtcactattgcattttttgcttcaatggctcccgtggcagaaaatgcccaaccatttcctatgtatcaaaatcgtgtcacactccacaagtcatttccaaataaaaaagaagttgattagtattgaaaataagcatagatcccacgattccttatataagtcaaccttttgaacagtttctataggctttactagctaattattactaacataataacatgcatcacataccgtatagtttgtgagttcaatcttctttaacaaaactaacattctaataaattaatattaatcaataaaaaaaatagtaacatgcatcacataccacagtccccttggtactttacttctgtgatgacacccttttccctccaatcccaggaagcaggcggatggtcacaagaatgctgtttcttcttcattttcgtgttggccatgttgatttgctgcgacacatccttggtgtcttgcaagtactttttgctgaactcttgaggagtgatgtcagcaaacttgttcaaccccaaacgatgagagtggggtgattttctgtttgcattcacgtccctgatatagttcaagttattcttgaaaatctcaagtctctttgcctcttcttcttggttatggtagacccgtccgtgctcactcttccatagttggaacagtgaagtcacctgtttctgtgtggtgaacttagttaggtcaaggtccaatatggaacgatgagttgatattctggaactagaagagaaacctaagagggagaagagaagaaacacaaggaaagccataactcggtgaaagtttttacgatatgtttgcttgttaagaaggtctttgcacaattcatatatatagtggttacagcttgtttgaaaaccatttcaaagagacatttaatttgacgtaaaaatcacatcttgactgaagccggcaattattgcttccacatttttttttacgagaaataatacataatttattctttattttaaatctattatcaatattattatttttatctatctctatctattttatcataaatcataattctatcatatttaattatttttttacttttttttaaatgtgtagtctatctgtctaatgtatacaatgtttacaatgtgtctggtaacaagaaaaaaattaggtgacaaataaaatgaataaactagatgagagaaatagaatgaaattaaataaagacattcgattgaagataagaaaaagaaataaggaaaacagaagtaaaacatttttttaaaattttaaagttaaataatcaattatgaaacactgataaattattatgaaaaaattgataattgattatgaaaccattcgtaatcaactagcaacggagaacaaatgatttcatgtataaaaaaatgttcattatcaattctgaatcattgataatcactgaaaacaggtttattgcacaatttttgcgccaatttgcagagaccacgtttttatttctttcattctttaatttcactctactaagcacactatcttttttatcaatcatttattttctttccctcttctcttttttttctctatgtcactcctacaaacaaccgtaattgaggagaggcttcggttatttgaaacttgaaagtgcaaatgattgttggttatagcaaattcagtttaggtccgtttatttaagcttatttaaaaaaaagctttattgataaaataagaaataattttctttttatgtgttacttaaattgtttttaataaaaatatttttaaaaaacaaattttatctacttaaacttttaaacaaattattctaaaactgttaaaatacgatttcttctcttgtaaaaaatataattctgcagcggtcctgcccggtctactacatcagaaacggtaccatactatagctacctatatataactatatttaatcaatccacgcgttatgcgagtgtcttttttttcatattaaaaaaaaataatgataatgacttttagtactagaatattttgaaatgtttatttgttttgtccaataatttgatgtgaattaggggctaaaagaattcaaataatacaatattaataaaaaaaatattaatttgagactgtttgtaaattatttacgaatttggaatagtaggtcgcgctcaaaattgggtgtgaccagtcccgcttgaatctgggtgtgaccggtcacgtccaattttgagcgcgacccactagatagcaacacgtgtcatgacaaatggagtaatgcgtatataaactttgaacgatcataacttttgactggaatgttcgattgaggtgtagtttgtgtcaaaatgcttgaaattgagaggagaacccctgagcaagttcctaaaggtgacttgttcaaaaatgttctccaaaagaggcctctaagtgcctcaaaattgcgattcaatcttcgaagtcccaaaaaatttcttgtttttctaattttttaattattttgttagttaattgcatgctattttttattttttttattgtctctcttaatttcgatcaaatgacctatcgtacacctcgatcagacattttcatcaaatgctctacgatatgtccgatcgaggtgtcaatgtccgattgaggtgtacgatatgtcaaaatgctcgaaattaagagagacaataaaaaagtaaaaaatagcaggcaattaactgacaaaataattaaaaaattataaacaaaattttttttggaacttcgaagattaaatcgcaattttgagacacttagaggcctcttttggggaaaatttttgaccaagtttagggacttgcccaggacttctctcaatttcgagcgttttgacacaaactacgtctcaattggacattccaatcaaaagttatgaccgttcgaagtttatatatgtatcgctccatatgtcatgacatatatcgccatctggtgggtcgcgtccaaaattgggcgtgaccggtccagattcgtacatagtttggaaacaatctcatattgataaataatttataaataattttaaattgataattttttattaaaattgtattattttggttcgtgaaataggatatttttcaaattaggaacatcgcctcatcagcgtaacgtgttttgttgataagctttgcacctgcatctgctatttgttattttagttggaggtttgggaaaagacgcaatgggacctgcaaggctgcaacaacttaaaatgcaatttttctttctttcaatgtatattagcattttaattttacaaaatcttcactctaatagtttgatttgatgaactacccacatgcatatccaatacgtaagacttatcaagtaaatgtcataaataaaataagaaataaaaaaattgcagcaggtaacaacaaataaagaacgtgtaccttgtggtatggaaatgtggtaggtaggaaccaaacgagtaagaaataaaacaaaataaaacaaatattttgttcagataatatttaagaaaacacaacaactttttttcataaattaaaatcaatttatacatatataaaaattaaaatataaaaattaatttttaataaaaaataattcattttatctctaattttcttctaatgtttgtatgaggtttatttacacatgtccgaaaagaactaattaagctccttttcttcaattaattttctattccgaatttggaaatatcacaatcaaatgagatcagagagtttctcgtagtcttctccttgaagcttctcatatcacaaaagcacattgctcggataaggttgcattaataaagttatgtgtttctttctttggtttttgcttcagctttgcaagtatttttataaaaaaaaataaaaaggaaaaaatgtgaagaatttttttataaataaaaataaattttttattaattaatttttaaaaatttactaatataatttctctaaaatataagatgacatttataaatgaattaatgaaaaatttattttaatttatagaaaactttatttcattttttcttaattttttcttcaaaaaatatttttagaggaactgtgagtgtattacttttatcctatactttcatttcatgtcatgttcatcgtaccctccaaagcttttcgttacaccattgtcttagccaacactgcctctgctctcctctctgtctatttaaaataaacaaatatttttaatatataaatttatatataattaaaatttatgataaataaatattttaaatgtataaattatattttaaatttataataatcataattttaatcgcaatgtaaaattatttttaattattaatattttgataaaaaattatcgaaactaagtttagaaacagttatatatgagtgtgttggatatgtcagtctagtaacttataagttacttcaatcaaaatactatagaaataggtgaagttgttcgactggaatttatagcttaatttatattaagccaacattagattagggttttttacaaaataaatttagccaaaaagaaaattaaattatttaatcaaataggaaagttaaattttgtcattaaaaaaaaattaagtctaactaacnnnnnnnnnnnnnnnnnnnnnnnnnnnnnnnnnnnnnnnnnnnnnnnnnnnnnnnnnnnnnnnnnnnnnnagcttaatttatattaagccaacattagattagggttttttacaaaataaatttagccaaaatgaaaattaatcttatttaatcaattaggaaagttaaattttatgtcattaaaaaaaattaagtctaactaaccaacttctttaagtaaatataaaagccatcagaatgtaaaacaacccaaaaatgtttctttacttgtgacttgtgagaactaggccaatagcaacttaacacaatcaataccgataccaacagttttaataaagagtataaaattaagtaaggaaacaccaattttttagggctcatttgtttaaaattttaaagaatcacttcttttttaaaaaaaaacactgtatttgttacaaattttcaaaacaagttaaaaggaattagaaatattattataatcataaactattttaaacatatgttggaagagattaaatctttaaatggatttcaatatctaaggagattagttattgtctttcaatcaagaaataccttagttcacccaaaaattacttcttttataatctgaaacaaaccgatccttaatgagaaattttttcttgtgagataacaaaaactatgacatcaaatttagcaaatttctgagtataaaataatgggaacatgactacatcaacaaaatcaccgaatgaacactaacaaaaatgattttttttaatgaaacaaaatgaaaatttaacacaataaaatgcgccacgaaggtaatttggctagaaaaagaaaagaaaaatgaaacacaaaattaaataaaacatatcataataaaactcttaataaccagtaactgaaacagaacatgcttactttatcaacatctactcaaagacactaataatcccttcatcttctgacactaataatcccttcatcttcttttcactggactgcgtatcttctaaatattcttctgacgaagagtttgtattttgtttatgtatcatggccccatggggcacctctcctctccccctccatttaaatgatattatccttttaaatgggcctttcggcccaacaaaacaatatatcataatttttagggcgttgcttcctacaccccgtatggcagtccaaattcattcgttgctaccacacccaaaaacatcaattttggtttgtctctctttacgttgtgagttgtgagttattgggttgaagtcgttatgagacagtgaggtttggagcactaatgacggtgaaagagttcaagtagttttcggaggcactttggagaggaaaaggaggcacatgggcacatggccatgaagaatgatgatgattccactttaaattaagggaccccataataatcctgaaaaccataaataatatttatctcgtactcgtacaatctaagcccttgttgttcatcaccaaaataatctaaccccttgtttaataaataatagataaatgattgttacttattagtttattgggtaaatagtttaatttgtaaatatgtaaaaataaataaaataattaaaatgatttatatattaaacaaatttacctaatttataaatttgtataattcgaaaaaaataataataatgtttacaatatgaaacaacgaaagcaagtttcctactgatttagtgtttaattttcttctcgatttagaaacggaagatcaaaattatggatggaacattgcaaggacaaagaaaatgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcagccaggaaagaatccatactttatgaataattttatctttttatatcgacaaaatttgagtttcatttctatatattggtaacaatgtaatgaatttttaaactattaacaagtaaagaatcataataaatatgttttttttttcttttatataaaaagtaacctttatagttacacttattttatagtaagtttatagaagtcaataaacttactctaatgataacttttttgactaattgacaatatcaaaattcgtttatagttaaatttatttattaaagtattaatgtttacnnnnnnnnnnataacataacaaattaatataaaaaagtttcataccgatattatattaaaattaaattgaaaattattattattattttaaataaattgaaatatatttttattagcatgattaaattctattaataaaatactatagtggggacattttcttgaaccactaatcattagcgaatcttataaatttaatgccacaaaatttaaataattaaattccgctggttgttttcccaactcaacaatacattatcattacattctattatcgtggacctaaatttaaaattaaaactctttattcaataaaacatttactacatcagcaatatagaattattcataagtaatattttgtagtaccatatatgtacttagaagcagacaatacattgttataattaaacacaagtgaaatggtaaggcacggttggtggtgtcctctaaacgtaataatttatttactcataaaaacaaagaaaagaaaaagtactaagaaacatccgctgcacctgcactgtgtccgttgccagagtcaatgattaagtaactacgtcacaaacaaataatcagcacacctaccaaaaataacaaatactaaaatagatggaaaatcatttattttttctacaaatagcaaaaatcttctgcataaaaataatcatttcgaataagaaaataattattcactacctaaattgctaattgtgttataaaaaaatctataatgttaatttaaacttaataaaagagataaaagataaataaaaaaacttaattacattaaatttttaatgttaatttaaagaaaaaataatataaattaaatggttcatttcattacattaaatttttaaaatttattttgattttatatatttttaaaatttttaatttgattcttttttttccattaaaaacatcaagataatatcctgttaatatttaaattttaacgaaatactaaatataagtataataattaatttaaaataatcatgattaaaatgattaattattttaatatttaaaatgattaattattttaaaatttaaataattaatcatttcagtaaaaaaaaaatccacactttcaatagtaaatccatgaatatgaatgaattattttatttactttaattttcctacacacaatacaacagtatcatcaaatgaaacaatttaataatagaaaccacacccaccaattccatagcttcagaactccaatgaagctccatcaccactagcgaacacttccattgtttttatctcacaggatcaatcgatatcaccagcaccaccatggaagaggtggcgccgccgccgaagaaggaaaacccgaaccttctcctggggcggttcgagctcgggaagctcctcgggcacggaaccttcgcgaaggtccaccacgcgcgcaacatcaaaaccggagaaggagtcgccatcaagatcatcaacaaggagaaaatcctaaaggggggtttggtctcccacataaagcgcgagatctccattctccggcgcgtgcgccaccccaacatcgtgcaactcttcgaagtgatggccaccaagaccaagatctacttcgtcatggagtacgtgcgtggcggcgaactcttcaacaaggtcgcaaagggaagattaaaagaagaagttgcgagaaagtactttcagcagttagtttccgcggtggagttttgccacgcgcgcggcgtgttccaccgggacctgaagcccgagaacctgttgctggacgaggatgggaaccttaaagtctccgactttggtctcagtgccgtgtcggatcagataaggcaggacgggctgttccacacgttttgtgggacacctgcgtatgttgctcctgaggtcttggcgcggaaaggctacgatggtgcaaaggttgatatttggtcttgtggggttgttttgtttgttctgatggccggctatttgcccttccatgaccgtaacgttatggctatgtataagaagatttacaagggtgagtttcggtgtcccaggtggttttcttctgaacttacaagacttctctctaggcttcttgatactaaccctcagacaagaatttctattcctgaagtcatggagaatcgctggttcaagaagggtttcaagcagattaagttttatgtggaagatgatagagtttgtagttttgatgagaaacagttacttcatcatgatgatgatttggcaacctcggattctgaggttgagattaggaggaagaatattaatagtaatagtagtaatgcatggtgcgctgccgaggcctgcgagtttgaatgcgtttgacatcatatcgttttctcagggctttgatctatcagggttgtttgaggaaaagggtgatgaggcgaggtttgtgtcatctgctccggtgtcgaagattatatcgaaattggaggaggttgctcagttggttagtttcactgtgaggaagaaagattgcagggtgagcttggaggggtgtagagaaggtgtgaaggggcctttgactattgctgctgaggtttttgagttgacaccttccttggtagtggtggaggtcaagaaaaagggaggggataaggccgagtatgacaagttttgtaactctgagttgagacccgcgttggagaatttggggatggaggaatctgcttcttcttcttcttgtcatcaatctacacacattcaatctgaactccaacaacatcgaacactttctgactctgcacttaacagacattcagataatgaatgtttatacgaaccagagttgggtctagcagacgagactagtatctcgcaacatggtgaatcaaagttagaatgtcaacaggaaaatatggccatgtttactatctgatcatgtcttgggctctataattgtttccaaagaacgaaacatatcggaaaccaaaaaagacaatgaatgcttgcattaattaaggtagcaggagaatgacagaagatgatagcatactaattctctcttgttattttaggctgtgtgtaagttaaattttactttctttttccctcaagaattttccggcattgttaggtttgctccttgactggagcattagatgctactgtctttgtatgtccaaatgttgtatttctgtaaggctaatttaatttaaatatagtgaatgaagtgtacatgttcacagttcacagttttcatgtcttggtaaattgctctgtaactgtatttattttctttctttattgcaagtaatgagaaaataataatgcaactttcttgtgattccgtgaggtattgcactggatttgggtgtctagtgcttcatattaactccatatattcatcaccttaatttggaatgagattgtgggaattcactctaatgctatatttggtaagaaggaaagaaaacaaagtgaaaggaaaacacgaacaatataatttcttttatttgaatgaagagaaaataaataaaaaaagaaaaaaaattgatttataaaaataaaaatttaaaattttcttttttttattttttttttaattcaaattttaatttttttttcctttccactctctttctcctataccaaacataggctaaagagaggaatcagaatgtcataacaacaacaacccgtcctagtatatgtaaccaaatcaggtcaagatttcatatcggtgtaaagggaaatgaaagccttatggcttatactattaaataaagaagatttccttcactgtttctcgtttaaaataagtgatctattttcccctgaatcatgctgatttccagcgcatttcttgttgatattatattttaaacaatggaacaaagtgaaaagcaaatactcatatgccagagtagagaaaatgggagaaatatgccggatttatcaacatagatgagattcactcaattctgaaagcattgtagagcattgatcaaatgaatgataaatgccctgaaaatccctcctatatccaaaaaataagcttgttgctttcacaccgggcctacacatacaagtggtgcctattatttgacccaaaatgcttcagcaaaacagacaccataagtttgattgtagcgtggccctacacacttacaagtggtgcctaaggaaccgtcgtatttactaaacatagcaatgcataggtgttatgtctacaaattataaattataaactcttaagaaacttagttattatttcatgaagagactttttaagtgaaaattgacttgttagaaaatacacacatgttttacgttatgtacatgccatcactaatctatggtttctggatcatttggtactttgtgctgatgcaatgaagcctggtgttgaactagattgagcgcttgtctacttgtcttctaactcatccttcaccaattccaatgcttgtttctttctgtggtccaaaaacagagagccagtggtttcaaataattcaaattgtaggggcccttgtggctaatggaaccgactgttggaacctatttggctgttcaaaaactttttcatgtccacctttctgctgtagctgctgattttatatattcaaaaccaacctgggaagtggaaggctgaaaaagatgcatgataggagtgttttgtatttttaaattgatttccctaggaaataatatcaaacacattttttacttattagtgcggatttgaatcacagatagtattttctttttaaataaaagttatatttgaataaagaatattgattagtaatataatgtgatatgattggtatataattttatcttttatatatgattataggtttataaacatatattaaatgagatcaattccttaaataaattttaatatcttaaaggattaattcttaacttttgtagaggataccgaattaaaaaaaatatatttgatttcacttttttagatatccattacttcataacacacatagctagtgtttgctgtgaagaggaaatggattaataagacatctataattggttggactacttacaaatgtccaatgtccagtcctacaaatagatgcaagttgaacataaacaacatgcccggactcattttaagattttcaattctatatttgaagttgtcatttaaattagaagagacaaaatatgttacttgctcgatgtaggtggcagattataatggttggataaaaaaatattatttttagttttaaaagtgaagcacaaatttgattttctcaagttttttttttataaaaaaactaagcttagatccggtcatcattaggttaagctaaaagaatctatatacaattcatattcaaaactcaagtcttatattttattagacgagtttgaaccaccctactaatccttcttattttactcctctaatttaagccttgctatttttaatttttttttcatcatgttaagtttttatattaagagatattatcttgtctctactacaataagttctttccagttttgtcactaaaatgcaagtggacactattgtatcgtgcacgatacgatttcacaaggtattttttttcttcttaaacgaacttaaaaaaattgtaacaaacaaaatagaaaataattttaaaaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattattaattattttgttgagcataactgaagctactaaaaaaaaattatgtacctaatagtaaaaaaaattaattaataaaaataactaaaaaataactaaaataacttgacgatatgaccttaattaaatatttatttcctaaactttcattatatatgtgcattcaggaaaaaaaattcattatatgtgagtttatgttataaatttgattataatttttttgaaataagattaaaaaacttatttagatatgttttagcaaagaattataaaaataaactaaaaaacgtttgacaaatcataatccatttctgtttaagtttaaataaattgcatggatgtttttctaaaagcttccgtaatagtgaatacagaggttctataatatttgggcttatttagttatttattagactgaccattttttatttattagttaaaagaggtgtttaggaaattttttaggtttatgattatttgataaatttgcggattttgttttatttttattttttttaccattttctttattctgatttgtggttatttcataatgaacgagtttgcgttttaatagttcaaattttttcccatcatgtgccttgagttgaaagacttttcgaggccacatgattacgtgagggtagcatctgacttaggtgattgtaaagtgtggggaaaacaacattggagagattaccaaaatgaactaatgaaattggagagatcatatgaggagataaattaacgtacatcatcaaatccgcgtcctcgcatgatttgctgactcacaattaatctctaaagcgtcatcactatttttgtgcataccttaatcaaaatcataaatgaaaatgttttgttaatagaatctagcttaattgattaaatagaatatataaattattataaatttattgacatttctgttttgatttttacatataaaaaataataaaaacatcctccacactaatcagaagcacttggcggcaacccaatcttgtgctcgtatacattttccctctagagtgaactaactatggttattgaatgggaaatcagcagctaaagtatacagattttgaatatgtggcacaaatatgaaaaaggtaaacgtatgtagccaaaagttaaaaaagaaatgtgtcacattaagaaataaagtttcgacatcaaagatatatcgattgcatccattgcaaataagataaggggtgaaatggcagtctgacaagtgacaatactaaatatctttaaagatatttaaagtaacttacaaatgttgtttgtttttgtttttcctacctgtaccaaaaaatatatcttttaaagtaataaagtgaaatgaatggtctatatactgccaagggtgtgcaaaatatctctataaaccgaactaaatatttgaacataagccaagttgcactgtaagtggtgaaactgatagttcaataagtgtttgtcatactaaatgtggtttttgttgactattaaacaatttagtcaattaaatgcatatagctggtgcagccgaataatctaatcacgtagtttgatgcatattacttaattgtggaatcaaataaagctcagttgtcgttgtttatgttgtgttttttcaactattctgcctcccttttgaaaaatgcctacctgtttgttctggaattggtagactatcttaatcggggaacagtcacaacttaaaagtttcattaataataattgaatagacccgtatagaagttgcatgttcattgggactgaaataccaattaatttgtcaagacttttttacatcccaatattcatcaacaaaagtacaatttacaacaccccacttgcaaaattacataacacgcttccactgggacaataatagctatggtattttgattatatggacttacgaaagaacaaatagaattaaagaatttgagtagcaaataccatatagcattatcagaaagctgtactcttccagcacggtaaaggttagagagagacttgacttagaatacacagaagagagttagatagaactttttaagtggcctccactgataagatctccagttcagcccaccagagtggagagagtcttgggacagcttgctcgggtgatatatgaagcacttccctcaatctgggagttatgtccttcattgtaggtcttaaccttggatcagattgaagacaatctttgatcacctcacagatgacatcaagttcttcatctttgaaggactgcagcgtgggatcgatcagatagccgatgcttcgcttatcattcaagtgctcagcagcctaggaagttgatcaggatttttttgttaagtgacatagaacaatggagttgcacttgaaagtacaaggaagggtactttcaaaggaaagaaaaacaaagtaacgggcacaaatttcaaacttacccagttggaaaggtgaccttgttcttcagagtaaggtagtttcccagaaatgatttcaagcaacaatactccaaagttatagacatcagtttcaggatcagcctggggtggcaactcagaagatttctgtgattcatctccagttgtgttggtttttgcatgcttgccgaaagagatctctgatatctgagagcaatagaatggagatatgttacttgttacctaacacacattaaaaacaaaaaatagaaaggtgtataccttagcagcatagtcatctgttaataatatagcaattgaattgaggttggaatgagctactggtggatttagatcatggtgcatatactgaagacaataagccacgcccataataaccctcatccttgcgctccagtcaagaggttcaacttccttaactgaaaagagagcaaatatacacaaattcagcacgttgttttttacgaagagaacttaaccctttaatcggatttgctatgcacaaggtaataacttgagcctttagatagagatggaagttgttaccatgcagatgctcgaataagtttccattcggagcatactcaaacaccatcatccttgtgaatggttcttcttcgtcacagtacccaataagattggtaaaattcttatggttaacacgggacaatgcagcaatctgaagcatacaaggaacacaattagcaacaggtaattaagaatcgacagtccctctcaattgaattgggacttctaattcaactttttcctttccattgacttgaaaaggagaaaacctttttgcgataggctgtctccatgttctttgaccaatcatgggcagaagtaacaatagttgaatcaacagcaatctcgactccactggatagtgttcctttgtatatggtgcactcatcaaaactattaataatattgctgaaatcttcacaggctgtttccagctctccctgattcaacttggggacccctacattacatacaaggacaaaacaccgcaggaattttggattgagctaataacttaaggaagagagctcagacaaaattgtttcataggttgacactttagatagtatatatattgcctaacaagaagagaatccattttcttgcaattagctgaccataaaataatgaaatacgttcataaaattgttgttattcaaattagaaagatgatgcttgaacaagttgaacaggagactctccaaaccttaaaaaaaggtaatggacttattgtaacttacataaacaaatgaaaataatcaatcaaattactatagactaaagaacatatatgagggaagtcagtatgaggcgtttaaaatttggtaaacaaacattatttatgttaaagagtcattttcaatatcaataatttattcatttactgaaataatacctgttataaatgctttctgcaactgtccacttattcctgtcttccaaggctttattacttttgctgctcgtttacgccaaatgcaaagcatgatcacaaaaacaatgaccaagacagcaacacctgcgattataataatatacttccatgattttccagatgcaccattaggtgaattttgttgacttgcttgattcacaggtggagaattagaagatgaaggcaatggtgcaggtgactgattttgtttcttattgctgtctggcacagctgggaaagctccactgctctgggtaattggaatagaactgatctccatagtaggcccaccactgaaaggtgcagcagcaaggttactggactgatcaagcaacttacgtcgtgctgaattgattagatttggtacattctggccaaactctgactcatcagagcctacatgatggaaggtgtgttttgaaagtcagttaagagcataagtatcaatttctcacaggccataaaccaatcaaggttctccacttactagtcagattgtcacagtatttctcttcataggcatggggagtagcctttcctagcttgaaccttcaaataagagcagactatgttagtaagctaaacatgatgaaagaagaaaatatatgtacatattaagattgatatggggaagaaagttatctacacacagtggcagtgccacagcaatgacagctttgaggtaatttttgagtgttcctttaagtggaataacaaatgaatcttccatgttccattgcttgaaatttttatggcatatatttttttcaccatgttgttcttgttgttgtatacttttcacacgatgcatcgaaaggtcaaaaaatcagaaactcaaccattcttgttaaccataaaggatgcagcatattaagataagtatacaatctcaagaggatggtactactaaaagtttgctactgctaaatctaatcttaccaccttagcacagctataagacaacacaaaaatttcagttcctcatataacaacaaaaaaataactatggtgatcagataaaagaaaatcaaatggaaaaacaaacactgaacaaacgaaattctgcgagtctcttttgagtttatatggttgaagtacaccacaaactttcaatgaacataatgaaatgatcaacagtttggattttcaccagtcattgggctatcaaatgacaaatgatgaacagattgcttttaataattgttatttaggtaacttttaatcttcgcagcacatatgcaattagacaagagccaatcatagataaatagagtgtgagttctactgctataaatgtgtaaccaaagacaaactgggttttaaggagttaaaacaattaactaaaaactgaaaacagaaacaaatttcaatttatctttacctccatagacctccagttaagaaagaataaacattgcattggtgttgatgcagaaaaggttaaacagatcaacaagtgccatcagaaattcagaatgaagatttgtatctatttaagacaatatacagaaaccccatgtaaacagaaaattaagtatttcatttatgacaatatgagatctcagattgattaatagaacatcttaaaccaattaaataatgacatcattatgtataggcacatgaagagtgcagttgactacatggaatatatttgacttgatgcctgaccttgtggaaataattttccagtgattgtccaaaagacttcattgtttgcaaaaagaataaaatttgtgacaacagtagttcttatgactaattaacttgccactacataagtaaaggtaaaggaaggaaagcataaggtcactaggtcaggaaaaaaatgaagatacacttacaggtgtgcaaactttctattcttgccacgagataaagttgccaaaggagttaaatgattgttattagagggaaatctgagctcttgagaatcactgccttcaaatttattgtcacaaaccaacctaggaaaaaattaaatttgattgtaggtaacccagaaatataactaaatatatgaagaagaaaaaaaaaagaaaaagagttaacttacaaatgttttgacaacaacaccctgacaatttctgctgggatacatccagtcaagtcattcccccttaaatccaataactccagcttgtctagacctccaagttctttgggaatggtaccagaaaaactgttcttgtatagtacactatttcaaagtaacaaagggagcaaatctgaattagagatgtatttgaatataaattactatatgaagtcaactgaactattggattttaaaacttcctagcccatatttagtctttcattaaagacatatattaacaaaccgtataacattgagttatagtataacaagaactaaaataaccaaacagaagggctcatgataatctgtccaacagagacaaggaaccctcatggacactaacatgatataataatccagctgagagcaaactaactgtaattctttggagttgagtacttgagaatatagctacttttagagtttttgatggggagagaactgctatattgcaggaaggcaggcttacaaattaacattgcatagacgggagaagaaaagaaaagaaatgttgaaaaggtaaagaaagaattataaaaatcataacacacaaacaaaggcatcattttttttgtttggttacacagacattatttactgctattggtctcctgagttcatggctacattccagacagaagggaatgcggcatagtgtgattaaggaatgtgaaactgatacaactgtaacaaggtacatgttagtatgagcagttcatttttcaagcatatcatgattatttactaaatttaagaatgacatctatgtgacaaatgctgagctcttagatttaagttacattattataagatcaagtttaatcagagctttcaccagcataacatgtgttttacttttgacataatggtaaaaaaaggggggaggataggcggacacatgaatcaagaacccttacagggattttagatgacgaagtttcccaagctcaggagccaatgtcccttccaaagatagatcaggtaggaccctacaagaaggcacaaaattctataagcacataaaatttagaactgcattcacatcaaccaaaatggaagctttctttaagcatcaaggacaactatatgtattactgtttggtaaaaaaaaatactatctcgataaaaaatttaaaaagaggaaatcaaagggagttacttacagcgtttgcacttgactatcaacacaacgtacacccagccatttgcaagggttgcaatcgtttggattccaatttgccagagcagcaaaaggatcagaagttattcttccccgaaattccaacaaggttaatcctgctatgtccattccaaatgcaacagcaaaaatcaaacatcaagatacaataaatgcattacatgattcactgtaaattagggagactaaaaggacaatccatgcaaatcaccttcatcgttcagagaccaacactgtcgagttccccacagagaaatcaatccaacataaattcggagccataatccaaatggcccccatatgctttccattggcatgagaaggcaatgtcactttggtagcgacaatatctatatctctttaaagtcaggaagctatatgatatgtcatatcaaatttacaaaattggaaggttttctctgtacatagaaacccttccacctatttggatgaagcagcagaaaatttactaactatgcaaaacttacactttacaatggaaagcaaaaacaattgaagctcttggtttcagggtccctcattttgtgtatcaatctcttccttacaaccttttgctcaacaaaagcatacccagctcaattcgtcctctcaatgatgattccaaacaatgtgggctggggctgtaagaaattacattacatccagagaaaaaaaaaataaacaaatgtttttattccaacaaataaaaaaaataaaaatgaaaatgataaagttgacagcaaatcaaaaccataacaaaagaagaaacaaggaataaccgcatgagcaagcaaactttcttggtcccatcaatgttaaaacaaaaaacaaaagggggtaaaaagggaattgaattaccatgcgaatgggagaaaagggtgcaggaaaagaagccctttttgcgttgaaactgaaggatcaacaatgtttgatttgatgatgcgatgcaatgcaatgagttggtggtgacaggttgggtggggggtggattaaactgagacaaggaaggagtgagaagaagaaaaaaaaggcagcaaattaaaagattgaaatgaatataatgttgttacgttaaattgctgcctttgtgaagaggaggatctcagagaaacctttctccgaccaccttcataatcttacaatgttggggttcttttgtctctcttgtctcttgtctcagtttctctctcatcaccccccaccacccacacacacaattcccccttctcatattttttttttcttcctaaaattcgttgtaggccccattggccaccacttccgaattactcgcacgcgcttttttttttgttactgctcgctcactattattatttcatttgtgtacaaaaatggattgggatagtgtaattaataaagttcttacattttcatttaattaaaggtgcatgtaaaatgttactaatatttttacgatatcatcataattaatttggaatggaattctttcaaaacaaaaaaataacttggaatggaatctcttgttaattcccccatttaatagtaataatatgactaatgtagtctattattagataatagattctactatggagcaaatcagtacccattctgacccaaagactatttcaaattaaaatggctaaggaattgcttgtcacgatctaaagtaaagacaaatcaacaaaaatatactaatatacggcatgacaattaaatgcactcgtagtttagtgtctgactatgtaaaattgaccacctaaccaggaagatacatatttcaactttacttgtattgttcaacttaatcatcaattccttctccatatttcaaatcataaatgtcgttgctattggttgcattttgatcatgctattcctgttgaggcttgtctctaaactttaaacaaaatttatatttaaaatttaattaatattttttttcttatctattgtaaaattatttcttacaatcttcttattaattatttttaatatctcaaataagatttgcaaaattttaattttaaatcattaatttcaacaatgacaatggttgcaagcattatcaataatattttagaaataattcatgtatttgaagaatatatttgtttggtatactttcatagttttaatgggatgtgaaatacctttaattttcttttatttaattttcatatgatatctcatttttaaaataaatcaagatcttagtatgatgatactcagtataatttaaaatcttttcaagattaataaaatatcatttcaactcattcatttccaaagttttcatacttttagaattcatataaaaaataaaacgtatattatgaaaattattcaaattgacttttaataaataaaaaataatctgatacgaaaaagaaactttagttaaatgtgtaactaacattttctcccaaatctgttttttcatcaatcatacatctattcataaaatttaaattctataataattttaatatatatagtgttttctcaaaaaggaaaaggaaagtggagtttaaaatagatgtaaaacgattttcttaacttgtttctactttctaatatataaaaaacacacaactcttttacttcaataaagtagagtttaaaagagatataaaactattttcttaacttgtttttaataaaaacaactctccttttacttttattttaagttgaatttcaagacaaaattgtagaaaagttggtttaacgataggctcaactgaaaactaaaacaagatacttcttcagttttactttgtgaacatacttttgggccatctgaaaaaaaaaaaaatgcaccttgtatttaccacgccatgctcttgagatgaatagtgaactgaacagcaaaacagagacggttttgcgaatctatagcgtgaattacagaaacacggtaaggaataaggatcctgtcaatgcaattgagcacggtttaggtccttttttccaaaaactaccaaaagctgtctttatgaagctctataggaatgacgaatatactttgccctgaaattgtcattcccaaaagatgaaaattcttttaatagcattgacgacctaaccatttgattgaaagaactgtgtaagattaaagtgaagagtccgatctgaagttactgcctccatggaatcatgcacagaggggattttattcactgttggtgatgttagtttgttgccgtgaaacgaggaagaagcttctacagtttttctgtattctgtttcttttatgtgtttctattctgttatgattagttttttggtgctgtcaaatgattcgttgtaatccttttatgtagtaatgtagtatgtataatgcgaaaggaaaagtcatactattcagttttcaaaaggaataaccttaaacgtgtatcctatttgcattggcgtggggtggggtggttacaaaaatatgagaaagtgatataaagaaataaaaaaaatgttaatacacatttttaatgtatttctattatttattttttagagattctatttattgttaaatgtatttaactcacaattctattatttttaaaaagttttaattaataataaagaatatttcaaaaaaatatatattgatcttttttttacaataacaaccatgaaattcaaacttcaaatttcatgctaactttcaaatcctctaccactatgtcaaccttagtggttaaaaagaacattaattgtcaagaaaaatgcatatacaattataattatccttttccaaaagattttccccttaggtagtcctgttttgagttcaagaattgatcaagagtgtgcttttcttttctttttttttttttttcgagcaaaggagaaacccgaaacaaaaactacactattacagggtaaggtcaccaccccagagcaaagaaatgcaaggatacggaggttgaaggctccaatgagctcccaactccctgttatgagtctctccagctagccaatccgctnggtaaggtcaccaccccagagcaaagaaatgcaaggatacggaggttgaaggctccaatgagctcccaactccctgttatgagtctctccagctagccaatccgctccatattaacttctctaaactggtgggaaaaatacacctgcctaaggagtgcgcgatttaaaaatcactcagataacttataaacttatacagtatttgactagaaccaaaagcttatttagtaagctttattttagtagtaagttgctagcttatttttatgttttttttttcatgttaaattgattcattttaagataaagtaatatttttaattataatttcatgatcaagttaggaatcgaaattcattccttgttattttcataagttacttaaacaaacttttagctcaaactgctaacttttttttatcctcactaatttactttaattttgtctttatttttattttttttaaatttggaaactctttcctaccttgtcactctcaattatgtcatacatttgattttcacatcttttattctcacactcacaaagccacaacatgcatcttaaacaatatgtatccttaactcatcaatataaataatcaaatcttcattttttttataatgtgatattttaaaattattttcctcatatatatatatatatataatcaaataacaaaatatattatgttatgtcattttatattcatcaattaatttcatcaaataaatatttttaattaaataagctaatttgtaacttttccttccaactcctagtagtaatttataaacattcaactaacttataaatttcaaagtatatattaactgattttactaaacacaacctaaataaattatcggggacagtgcaataactcaaattcaatttgcctttagctggcttagtattatctaactctagtctgttagttaccatcacttctcatcaatggtggtaccaatggcgagattaattagcgcgcagcatcattgccattgatgatctctatagttttcttttatatatggtatttattagtagatgtggcataaagtgatttgattacactatacaaacgtggaggtggtgcagaaataaaataaaaatatatcaattgaatatataaaataaaaataattcctttaattttgttttgaagaattctcctaaaggttgtaccgccctcgaattcaagtactaaccttgtccatcaatgacgaaataaattattggggacactgcaatacccaccgctcaaattcaaattgcctttagctggcttagttttatctaaccctagctagtcagtaagtcaccatcacttctcatcaatggctaccaaaatggcaaggttagcaacatcatagccattcatgatctctgtattttatttttctttaaagtgtggtatttattagtggacatcgcataaagtgacttgagtgcatcatacaaacgtggagttggtgcaaaaacaaataatatttgaactgaaaataaatccttaaatttcattttcgtcaagtatgttgatatttgattttgctgcattttgtttgatagagataattgttaaggatgtatttaatttgataaaataaattatatactaggcgatgtaattataattatttatgtttgatttttataaataaaaaaacataggtaacacaacttaaatatagataaataacaataaaaacttatttttatttatttaataaatcatgagacaacttttatctcagaaagacaaaaagtaccaacatgttaaataatattttttatgaatacactacatttcttcgtaattgtcaccgttatgcatttctattgagctagctgaaaatgtgagatcctaattactaattagttagtagccgacatttaaccaatttaacttgttctcgggccaaacaattagtacaaccttagactgaattttttttaatatcattaccttagactatgtattatatatcagagtctccacgtattacataccctgaccataagtgccatattactatcttacttcgagaagatagttagactttgatactaaatgttataaataaaaaaggaggaaaaaatttcttaatacatttcttgtttcctttgaaataaactctcatacataagattgcctcttttacgtacaaccaaaatggacatgttaagatattacaaactaagaagaaatttatacttcttaatttaggtaaaagtccttattatcatacatcctaaattggaatgaattaggattaaaagaatagagaaatgaaaagaaaaaagagagaaaataatatatgtgataaataataggatgaaaaaatgagacacaacaaaaatgagttaaaaataagatacaagagaaattgatcagtgaattattataaattttcttttggtaaatgctcaaataccagtagcgtttatataaaacttcgtttgttaagcaaaataaatttgaattgtcgtacaatgtttttcaaatcataaaaacaaagtgagtatttggttaagcgttgagtgaaacgtgttcgtaaacactgctaaagtctttaaattcttagcatgcattgtaggaaatcaaacactcacattctgcaattaattaagctgactggaaagagcatataactgacattaattaatttttagtaccacccagagctcttcaataactctccttcttcttctgtcagtttgctgctagttatttaaaggccagagccagatacagatgcatgtttttaactatattaagctggccagacaataacctacgtatatgatagaataataaatagtattactgtattagactattaggtggtaccatctaaagaaattatggacatatatatactgctttgtatatatagaaattaacgttgcatatatatatatatatatatatatatttattggtaaataatatattaataccctttgcctttgggagttagcctctttgacacgtatgcattgtcactgcacatattttttgtttgttgagtatgtttcatattgtacctttaatatatataaatgggctaagtttatataatttcttgtaatctgaatataattatacgacttcatgagagagtataatgaaaagttggatttaactcacattgaatgaaccaggaatatatattatttttgtttttccttttctcttttctcaattattatgtgattgttcggtactcaatattgtgtttggactttggaaactcttgtgggacaactctatcggctttcttgaatcatggttatctgtcaaacggtaattacaattagttgatatagaagtgaatgaagctgaagatataaggttggtttaagaatgaatgaaatcttcaaaaatcaagcggtttctaattgttaagacatacctagtggttcttatgctttttgatcagtaggaaaatgggaccactgagctggtacatatttgtctttttcacaacgatttcctactaagcagtaagcaccccattaccaatatgttctgttaatatgggaccgctactgtttacttatttcacattttcattattatccttactctgtctgttcctactaaacacccccattacaataattttgtcaacattggaccactgatcggattattaagagtgggaacgagtgagacatgtgtaaatttattattcatatacaattacaatgcataagaggtgtaattggataggtcatttataccacatgtgtaatgtatcttctttttttatttatttattattgcagtggtgaaatttatcttaaagtttcttcatacctaaaaatttatttattttgtgataagatatatttaaatatagactacaaccttgttctaattagattaatagacaccagctgacaaaaaaaaaagttcagaattgttgtcaaataacgggctcttttaagggacttttttttactggaaaaattaagggagttaaacctttagaaaaactaatttatatatatatatatatataataagtatgaaatatttattgattttgttaataattaatttctattaaaaatatgaataatcagttttagtaggatcctctatcctaattatatttttctatccaattcacttaatttaagtaattcaaacttaattttacttgaactaacataataatattggtactacttaaatagcggtaattaatgacatacacctactcagagaggtcaagcctaattaactgtttagtaatttaaaatttgaccttttaattcaatagaatttttctgcaccaaaaataatatatcgaatttttaaaataacttaatttaattagtaataaattttacgaaatggtgaaactttccatattaattatgctttacttaaaatttaaattacatgagagtttccataagaaagatattactagcaagtttcgttattaattattattttaaaaatttacttatataacttgtaagttcctatcaggaaattaaactaaattattccgtgttctattataaaataatacaatattcaaattattaaaatatttaatgataggtacaaaaattaatgtttctggaacatttagtattgatttatataaaaataaataaatataaaaattaaaagtaataaattcatgaatattttttatatttcaagtaaaactataagaaaatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaaatatttaatgttaaaaatataaattgataacaggtataaaaatataaattaaatataaagaattaataatcaacaaaactagtaaaaaactgaaaataagaagaagaaaaattgtaaggtctaaaaaatagcataataattcatttatattatttcattttgatttaaaaaatatttttatttcatttcatttaataagtatattttaaattgataaaaaaatgtaaaaaaaaaactattatcctaatttctaatatgagaagttatttaaagtaaattaaaatgttaaaagtgatcattattttaaaacatatatagttataaaatgacaattaattaaatatatttttatattttttaaccctgaccagctagttcaactaatttaatttggccaaattataacatgttaatttaatcaattagtttatttacttttaatttccatatttaaatttttagctacctatttcaattagctcatcgacaaagtaggtatagcaaaaacacccaaattaaagtctcaagtaggataacaatttgtccctgaatatgaggatcttggtgggaattgccaggaccccaaggttggagattttttttttccacccttgttgggatggagtaaaataccacctaggcaaatttaaaaatggggatgagaatcacactccctgtctcgcgggttcatttatatccaagaaagtactgaaataaataaccttatttaatatttacatttcaaacatttttttcttaagttgattttaccggtaaaaccgttcgatattggtttttgagagaatactggatcaactaaatgtaattttattttattttcctttattctatctcttcttcaacttcttcttacttattactccatctaatcttaaatataagatagaaaaaaatacattatactaattaagaaagttaattaattacatttaattacatcaattttaataaaaatatttttttcaacttatcatttattagaactttgtatcaagaataaaaaaagtcattaaaactaacatctcaattaaatgaaggatattttagaaataataacattaaataagataataagataaagttagttaaaaaaatatatatttaaaaggaaaaaaatattcttatatttaagagcataagtaacattgtaacattttatgagtacttggattaatactataaataatttgttatactgttgcagtaaatgacgggaaatttaaatcgtctactagtaatatctttcgtttcgtgttttgaacacaattccaattaatttcttctttaaccactgtttcgtaacagttcacgccacgcataaatttcttatttaagtcaaattgtttgttctttaatatgttatggagcaatcaaaactcgtttaattaatcatacactagtttcttcctctatcaagaaagataaacagctacattgggcaatgttaattaattattctttgaaaaatttagtcaaggagttggtcgaacacacgtcatcactaaaaaagtttaaattcatgcatgatattcaattattgttgccagcactctctctttaattggtgaatgtaagcgtatccatgtaaattcttaatatagatttatgcctctcagggagttgtgtcgatcttattctaataatgttttaaaaaccattaaactaataccaatatgataccatatataagctaggttatggtcttttttttggtgaaaaacttagttatggtctaattgctgatgataaaaaagttatggtctaatttgttcgatctcatttttaaaacactagtcttttttcagctaattttcgtatcatggcacggactccagtggttaagtatgggaatttgtgtagggtacacaattttttttttactattgaattaatctttgataaattggacttcccatagtgtatcattcctccttcaggtctctttcatgtaccccaatgctatcttgcacgttgtcatcagaagcgatttttgacggttcctccattgtgaccacagccagtcaccacccgccaccgtcatttccctccaatcacaacgactattgccacaagcaccaccatcacccaccaagcctcctccattcattctcccttttttcaccaaaccccttatgcatttcaacgaataagaaatttgaacaatatatcaagaaattcaaatctggattatcgcacaacatagtaaaaacccatatttgaaacacaagctcaacatagaaaaaatccaaatcatgaattcgaatatgacgaaaaatgacatacaacataacaaaaacccagatttgaattaacatacaacataaaaaatgctccaaacatttggatcttaatcaaactttttaataattgaaatgctctaggcgagtgcgacggtgacgacctcggtgatatgcgtggtgttgtcgactttgctcgcaaacctcagagtgccacacacaggtgtgatcttgttgaagtgaatcagggaggagttgaatcgcaaaacggggagggaacaagcacactggatctctgtgcggtagagcttgcggaggggaagcgaaaaaggcagcagaatcaacttaggcttttgtacacaatgacttaatgcaaaaccctcaaattggtgtcgttcgtgtgcttcggattgatgaacacgatctccactttcccaaatgatggaattgaggaaggcattagtgcagtgtgggaagagtgatgacataaactcgaagttcagagaagaagagtgatggtcggaagggtttgtatgaagggtgatggaattggggaaatgttgttgcagtaggcattaatgagggcgaagggaggtggtgagtggagagggacagcggcggagggatcagaaggaggggagatcgagaagaatatggaagaggacgagggaatgagaaagagatgagatggtatatttgtgcgggaaatgcaccataataatttgagtaagattaatttaagggttaaaaaaaattgtacatcatatacaacttctcgtacttgaccattgtaacataacatgtgccttgtatcataaaaaattaagaataattatctttcaaaattttacttcaatgttattcgaaaaaaaaaaaactgttttaaataatttataagataaaatatgttttaactttttagtccctcaattttcaatcaaagtaatctttgttcctacttcccatactttaaaaataacgattgtgattttcgtaattttttataattggtggatttcacttgtctttatgaaacttaggatacttggttgaaggatataaaactcacaagttatataaaaaaaaacattgtttttaaagtaatttttttagtaatcagtataattagcatctctaattacgatcctaagatttttctatataggaaagaaaataggatgggtccaaaaatgttttgcctctacataggtgttacaaattcaagctatacaaaattaggagttgtaattaagtgagaaaaataacataacagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctcaactttatttctaattggtattttgaaaataactggtttattctgaagactagtgattgttgtttataactttcccttttccaaaaattgatgatctagattttcaaaaacttgtttgttaatgcaaatcagaaagatggaaatagatatttgggtaaatggttacttttgatctaaaaatgtaaagtgataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagttgtaattaagtgagaaaaataacataacagatttgaattgtgctttttaaaattttatttctatctacaaacctttttgagtccactctggtgctcagaatgctctaatgtcttagcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttacttttgatctaaaaatgtaaagtgataattaataaattagtctataaaagaataaaattaagttctgatttagttctttgaatatataaaaattgtaacacttatattttatcatataatttaatattaaattagtctttgaactttacaatttaatgacaaataaatttttaacaattacaacttaatatccaatagttattaaatattatgacttaataactaaatggtcccataaaacttaatgatagaacataattatcatactttttatacatttatgaattaaattaatttttttctttcagaaattaaattattatcaccttacactttttagaatgaaattgaccatttatcataaatattttatcctagttcgcccataatttggacagnattataaaagtaaaaaaaaatttatatataataatttataattaaataattgtgtaaaaaaacctttagattgttaatatgtatattacttataaatgcaaaatagagaagtaattaagcctctctatttataaatgcctatataattcatgcgttttcagaaataacaatatataattaacaatttattcatgcaaaatatatagagaggctaattaagcgaatgaattccaaagattaaaaaaaatgagatgcacatgcttgaacatcagtaaactcttcaccattttattttataagatgtttttgtgatatatgatttaaaaataataaattccaccacaataatattaataatctttaggcatattctttatatggaccttgtgcaccttaaatccaactattttttagtaaaaaataatatgcacattttctttagaaaataggcgaattttggggtggagaagttatcaagtgatccatgggtgaaacactaatattggcccttagatttattattaaaatactgcaatggtttagattaaaaataaatattcttttaataaataaaaagaaaaaagaaaatgataattttatttttatcttctttatgtcatcccaaccccaacatcggggaagctcccaccgaaaattggcaagtgttatttgataattttttttgcttatgataccatgtgggtcctgtagatcgttaattttattcaccctctccatcagtcttcttttcttgacacagcctttgaaaagctatcaaggagaaaattctatttcaattaaatgcttgagatccaatgacgagtcattgcaccccattctgtttttgtaacaatttcatcataatcaaacctgcaaccaagagtttctgaaagccccaacttgaagtgcctcaatcagaatcccttcctcccttggttaatgaacgtttgcacgagctatacgaacgaacatggaggggtcgtgatctcaaagtggaggacgtgagtcacgtacgttaaagcatacctcacttttattgatggcttcctttaaataatgattatatatttagataaaaaagagatgagactgagtactttacgtaaatatataatagattacgttgataaaaattcgtgtatattaatttcttcctattttttcctttgacatgtgcttgaaataccgagggacgccatagttgtagttacttgcctgcagctcctacttacaattatagcaactctatagttggatctattgaaacacatacgcttttaaggagaaaaaaactggccaatgtaaattaatgtaacattaatggagttcttttttatatttttctgaaatatataatttcgcctaatatttaataataataaaaaaatatataatatctaaaaaatatctggtactttcttcatttatttattaatttcaaatattattaatcagaaagactaatctaattaatcatttgatttagaattaatacaaaggattgtctaacaagtttttttatggatactggctaaaaattaaaaattaaaaaataaataaaattattgaaggaattgatattttttaattaactttttaattagtgccatataactacacttgttaattaaaaaaaaaacttttattcaaaatacgtatagttactgtgtgtaatgtgctttaaccaatcttatggtttccaaattgatcagcagttgatcatttgtaaactataaatttagcactataataatgatattgcttaggccgtacatttatccctcgttcaatgatggattctcaatttcaattaaatactaacagcaacatgcaacatcctacgtgagtcccaagagtaaaaaattaaactaatccgtggtgataatgatttctcactcattatattcataataattattacgcaacagtacgcttgaaaatttttctttaaattttttgtcaagaccaacaaaaatatagataagtaaggtttaccaaatcacgaaaggacaagggcacaagaggggataatataccttggcacattattaattattgatataaaactcttttccggtgcttgttataagacatgattctcctttatgggtcaatcaagaaatgcttaatatcttgtaatattttatagttgtagatcgctgaggtatgtccgtataataatgtaatgctaggttggacgtcgtcatccatgaaataatataaaaatacgcctaattctttgaaaagattcttatgcagtttaattaatatatcttgaaatgtcaactctcatgcaaacgtgaggacaaaaccaactctattctcttaaatttcttaatctctattgatataggctctcctattttcccttcctctccacgtaatcttgtctctgccaaacccttttctttaattcttcgaatatctgtcatcactgtatgtttctctctctctatcacactctcactgtgatcgagcactgggcttgaaatgtacatatatatatatatatatatatatatatatatatatatgcacatgccacgcaaaacgagctttggagtttggcgccatctagcaaaacctaatttctcggctgattccaacgttgtcccaatctacaggtcctctttgtccttttgggacaaaaacaacccaaagtgggaaaatgaccaaaatttgtgcccttatgatcagcacatcttatgggagagacatgttttctttgtttggtttcggattttagaccctgccatccctcattttttttcatgtaccaaacttcagacctgcctccctcgattacttgtgcattgaatttggtgagtaattaatagtataatgtatttttcttagttttttttatctcactttattaccgaagattaatttttttgaaatgtagaggttattgaaatgactttaattgtaactctcattacaaaatatataacattttttatatatgataccaagaatcaaacatttatcgataatatgtttgaggacctcacttatctgtcaactatatgttaaactttgttgccttacaaaacgtaacaacatattttttaaaataatttttctattaattgaaatttattgaaaaatatatatgaagagtgtctcagttaaaatgatttttctattaatataacaacatactttctaatgaattttacttgtgatttctatacttttattaataaatctcagttaataataaagagtgtctcaagaaaataatgtatgtatgtataaaaaatggagcacgtgatatataataggagcaatcaatacaacattgaaacaattacttgatcgggtccaaatatactgacaaatagtatttgcactttttttaaaaaaataatatatatattctttttatttttaattataagattcttttaactaattcatgtgtcttaagaaaaatttttaatttagttaattacattaaacctatcaattatttgtattatcatttcaaaattattattttcttatatgtctatctaattaattatttctcatcaatgtttggagaaaaaataattaaataaaaatatgtaaaaaataataattaatacaactaaaaattagaaaaaaagatcttataaaaatggataaataatttttttaaaaatcttataattaattaaggacagtatatattataagtgtataataagataattaatatgacgaaaaagaaaagaaaaaatataatgttataaaaaaggttaacatagcatactctctttatttttgtgtgtatgcctcatgtgtgtatatatgtacgtattatatattattaattacttgtcagaggatagataaaccagaattcgcaatgtcactttttagtttttgagttgtacgtgatgacgggttgtgatcacctgaaagttagagcaattttcatcatttaacaaaaaacctggattaggaaaattggtgttaatagtaataatatctggggttgacaaagacatgactaagttaaaccgcatatatggttgcggtattcaacaaattaaaagagttgggtgcattagaagtcaataaagttgatataaatttcaacgtcccctcccagcttctagattcctttagaagaaagcccgattgtcaaatattttgctaacaaatcctctttttcctacagattctcttaacagaagtaaattactatattggttaaaaagtgagatcttaatggttaaaatactcggctattgctatgttcagttacagtattaatttattttgattataatataatgcttggactttggactttaatttggacttccttatttcaatattgagtaaattgagaaatacctatattgtcttttcctctccatttccatgaatggaagtcttcaaagttagagtcaagattccagtcatatagctcatgcatgcacttaattagaaaagtaaattacaattgtctattatgaaatcatgaaatgcatatttagccaccagttaccgttgaaaatgcctcaaaaactaaattatacatgtcgtttatttatatttttgcacatttcccaccaaaattgactatatatttttaaaaccacacacccctattatattacagccttatattaattaaggttgtccaatccctaatattctacaaagcataccaaaaataagacgtcactgttaaacatacagatcaaagaagtcagtggaaacatatggtatattattaaaagaagagatattttaaaaatatagtatatgagagaagcgactgagaaaatgcacacattattacgacagaaaaacagtggtattgaaatgggaacaaagtcttagtttaggtgggaagaaaatgaaaggttgattatagaatggggtccacaacatacatgcacctatattaagaatatggagctagcatggtcaattaaaacgaacagtattaatattattcatatatcacattttctaaactcatattttacaattttgtacacgtgaaaaaagagataaataaacattcccctcctttctattttttttttcactcataaaagtgaggtataaaataaaattacaaaaaataaagagcaaatatcataattaacatcaaagtgcatgagtccctagcacaggtcaaacaattaagataatcacgagctagctagttagagagtagagacagacagagaggtagattgatttttacaactgtcaagaggggacgaagagaaaaaagggttagaggagaaaagggtaggaattaagtacaaaagggaccagcaacatctgtatccattatgtaggtttattacaatttaaggagaacaagtagcctgtccgaatattgttgattctcaattttttttttctttctttctttcttttcctttcgtaccataaaagcctctctaatatcttaaacttatgactctaattcttctgctgaatgatatgccaaagacatcccaaaactaagaccatatatcctctctctctctctctctctctctctctctctctttccccttccaagcatatcaaagaacacagcatcatccaagactaaatccagcacaatctgtccatgagttatgttctttaaagttttataacaataaggccacgaaggttctccataggtgactaagtgaagagagatatggttggatatatatatgcagtgttgcatctatgatcaataggcttggaaaagaaagaaaagaggcacatcatcgtgaataggctcattggaagagaaagaatagaggaacacatcatcagcgtgaatggttggtactttagggaaaaaggtgaaacactcaaaatcaaagtattttttctttatttttttaattttgttgatttcttggacaaatcatcaacgataccagttcaaacaattcaccgttttcatgggttttgtccccgtctcctttttgtggtgtgtactttggatcatgaatactattcttttctctttgatttcttatgattacatataaaatgatttctcttcgatattacttcccgaaaacacttgaaatttattcatacacaacctattgaggattaatttcttaatcaattcctaagttttctcatccaaagaaaaattttaagcaccggatacgttcttctgaaccgcatttccctacccgagatgtgttatgttcatggtaatgaactgactttgttttttaatatatctttcataggtttgcggccggcaaagcaattaaccctttttcttcatcatacatctttttctaatatcaagagaaagaaccataattaaaattgagatacaagtgtgtaagcgcaccttgttcttgtcctgaaagcccattttacacaagatatcataaagcatttgtacagataaaatgacaagaaaattgattataaaatgttagttaacgctgaatgaaaattttctctctctctctctctctctctctctccatctctctcttccgctatatcctagttttcttgcttattcactacctacgatttacacatgaatatatatgcgtgtgagttcaagaacatgatcatgtgagtgtgtttattttgtaaatctcccgaaccctttacaagccttttgaaatttattatttcagtgattaaattgaaacaatatatttcttgttatatttccggagtaggaaatggcatgacctaaactaaagtaaagcgtttgttcatacaatttccatctttttagtagtaatgaatttcctcgtctaccacttgagttaattcctttccacttaaatacatagatctgagtacttaacacatccctcacaaattttattcacatcttctcggtagagaagttggttgcacttttatactataattcttcaatttgacctactactgctctttgtgccataacttctcactattcattgcttagtaattttctttggtacaatttcttgtaatctagctagtgactattactttaccattgaattttaaagcttcgtaattgttgtagagaaacgacagcctgttctcacaaattcttctttaaataactattcccttatattgtttattttgccaactttgatctgcacatttaaatttatattaatgtcgtgtttgtttcagacatgaaatgccatttataatttgtacacattgataaagaattgaagttggaggtgatcctgatcgagcaacaacaaataaatatgtcagatgaatataagaggaatgaacatgctgatgatgactcttcaatgggatcatcccagaaatgctcatcctttgatttgaatgaagaagctagtagtgaagataacaatgacaacgatgatgagggatgcgaggaagcaaaggaagaaggtacttcaactaataaaagtagcagcataacaaaggaaggaagtaatgaacggagaggtggcgtgagacaatatgttagatcaaagatgcctcggcttcggtggacacctgaacttcatctatcctttgtgcatgctgttgaaaggcttggaggtcaagaaagtaagtgagacatggattaaagaaatacttactatatacaatgagaaaatatgctatgcactcatttcttcataaattatcatgtataataaatttattaatttttataataattatgatatcaataataattttatagaatattaatataaaattattttatgtatgtctattaaattcatataatattggtaatgggctcaaggtcaagaccagtagagttcattgttttttattttattttattgatgtattgatcataaagtttgtctttatttagccttttaatatgatattactagagttttgtgttccatttacagtacccttgtattctctcttaagaaattttagttagtaaaaaaagcctattatttgccctaaaatgtttggctgaaatctttgcatctattggtgcaggagcaacacccaaattggtgcttcagctaatgaatgtgagaggcctcagcattgctcatgtcaagagtcacttgcaggtagcaacaaaattgcgggtttgatattgtattttttccccttgaaacttaaatattgatgttttattgcaataaataaattcattgttatgcaattttccttcagatgtatcgaagcaagaaactcgacgaggctgggcaaggtgagaactattttaaatcttgcaaagcgttctaaagcaaatgaatccttttttgtgtacaataagataggaatacaacttaattagtatgatcctttgatatatatcttatatattttgtaagatatagtttcctctcctataatgccggatgcaaagttcacaactcacattgaagatgttataataacacccaagatatagagaaaggaaggttgattagcttagaataacaataagaatgacaagtgttatacttaaagaggcaagtaattaacttcttttcattaatatctagctttttttcataatataatttaattataagaaacaatgttttttaaaaatgctttttttactgcttttaagaagtttaataaaactattcaaaggaaaccaatcaaatggagtgattttaagtaatgtttggccaacttatttttgggtctctcttttttcttaaaaagagaagttgaatcaaacaaaattttaagaaaaaaaatagctttttaatgaagaaaaatataaataataagtaactttcatgcttgaaaattcatataattattaaacatttttttcttcaaattaaaaaatttatttttaacttcaactttaaagtaactttaaactctagagataatccatcaatggtgtcttagtattgtgctttcatctaatagcattgatcattgtaatgtaaccagttgagagaggaaagaaaaattaagctggacggttgctggtttagtatttcgtggtttaaccataatgattgttactctagaacattatttaattaagattaatcatggtcattttgattttgtttctataacagactggattaaaatttggtcctagtcttggtcttgagtctctgccaagagggggtcatggctgtcttttttctcatttcatttcagttatttgtatatagatccatagaatgttttgtattgttaatcttagtcacgttgtagttataggtcttatcactatgggttcggtatcttttgtactcagctcgttctcaatcaagtcttattataaaaaaaaataggaggtaattaaacggtaagactccagcggggcgtttggtatgcatgagaattactagaatcatgaattctgaatctcatactttctgattataaataaaatttgtttgattaattattaaaaattattagataatttttttaagaattaaagaagttattttaattatttatcatattatataatttaatgaagaataatatgatatttttattttaataaaaaaaattaaacccaaaaaaaaacaagattttcacctttcacatgaaaagttttagtggataactgattataaaacatttctagaaaacattcttttccaagaatgttatttttttaaaaaatacatactaaaaatgataaactaaaatttctaacctatgattcccagcaaattagaagcttttcttctaagagaaggacataattaaggttgggattacttgattttacctgtcatttttactatatattcatccatattcactttgcagtattaggtcaaacatacaaatcaacccatgaacttggtcgtatttctcatgtagcccatcaatccatgaatcctagtcaacattttaagatgggaaatggaggaattattctagcaagtgattacaacgaccacagttatttgcagggtctcatgcatccctcctccctatcacattcacattcaaaagccatcgattcaaggtaaccatgcatgcacattttaattgattttattccctatattttccatggttttgcaatctaattaatacatatttgcaaaatatatacctatctatcattaggcaccaacaatggtacttcaataatcatcaaccttttagaagaccaagttactttagcaacgaagttatctcctcaacagccttacaaacgcaaggaagatcaatatcttcaaacaaaattaaactaaaggatgccaccagcattgcacccatgagaccaagccagtttcttgaagagaaaaagtggcctcccttagatattatgaacaaccatcactggaagaaaaggttacctgccaatattacttctaatgctgtgtcacaacctgttgtacatcaatttggcaccactgcagcatctctgcttagaccaggtgagttaaactttggaaacaacacaagaatcaaggagcatctatcaaactccgacgagcatcgcaactattccaacagtttaaagctagaatttgagcctccatttcggattaaggtaattaagacttaagaaactaaaatatttgtatgttctttttttttggcttaaatatattttggtgcttgaaaatatgccattttttcatataaattagatttatttttagtctttatatttaataaaatgaaactattacattttcaatccttttcaagaattaaaagcatattttttttatactttttaaaataaaaaaataaataaaaactagacacttagaaaaattaaaattactgagagaataatttatgtgtaatttaaaaaaatccatcactaacatataataaaaaagaaatttttcattactaaatttgatcactaattcattgatttttagtagtgagatatattaaaaaaccttcatattcgcatgagtactattaatgtattgaacttttttttttttttttacctttttcactattaatagaatttttatttattttttaatcaaatgcagtcgaatcaagaaaaattgcagaaagagaagcaatgggtgcctgatttgcgactgagtttaagtcagagagatggcaacaatgatggcaagactgatcattgcagagaaacccaagaaatcaacacgaaactttcactttcatagaatttataaccatgtcaatgtataatgcaaataccacaacccaaccattcatatagtctgagtaaagatatatagatactaaaacaaattaagttacacaattatatgtcgctacaacgctaaattatgggcttgccagtacatagggtttatcctcacaccaaaaataataataataattaaatcggatttgaatgtaaaatgaatgtggtggtcgtgattacgagtgagttttcaacagagagattttgtgtgtgctagtatttggtttgataaggcacaaagtaaaataaaagagagcgaaggaaaataacacatatttcatcatgttctggcgctaaccttttgtgtaagtacatccaatggatacgtagttcagcaacactgagagtatggctatcaggccttactgcaagagctccattagtacttctgcacctacagagaagatttatgttggaaaatgcatggatttagtagctatgtgttagaaaagaaattgagttgcacacacaagttgagttttatgatgagcgtggattttttacttactagtgattgtgtttttggtttgttgaatatcactagttgtgtagttaaagttaagttttgaagcagctatataaaagagtacttgaattgtttattctctctgtcacactctctataccaaagtatagaagaacaagtgaatgtgaatccctctctcactttctattccaaaatcgatcatccaagaattcagttgaattttgtttaagaactgtatctgctgatcaggatgcgcggtgctccccccccccaaaaaaaaatgttttagaatttatatgtatatttatttcgtttttaaaataatactcaatattttggtagataaaaaatattttttcttagttataaattctatagcacagtaactgttcatgcaacagagaaacctagggaatcttttaattcagatagagattgaagaaacctcaacgaattttattgactcttttaacaaaatgggttaattcacaaaattaattactaaagtaggtgttttattaaactatttatctgttatggatgatttttgctatataagatgcaagaggtgttgtcctgatatgtatcaagattataattagtttttagttttccttttatttctagaaacgtttttcttattgttttattcttttctgttataatctcacacagctaatggtgtgatgcagtagtgtgcttggttaatgagagtttgtcacatatgcttttttatttcctgctctctctctggtatatatgaggagcatttcttgttttcttcaagggtgatgaatatacaaaagcatttcagctaatatggtatcagagcccaaacgtggcactgaaatggaagtgccattagggagattaacaaagaaaccaacaattggagatgaagagagaaagcaattgagatcacaacaaacatgatgtgtggcacctgtatctaatatccacgaggaggaagaaaatgcagatgactcaccggacacatgtgctacagaggagacagaagcacaatcaactggggatgactcaatggaaggacaagaagagcgaaacgtggcagttggatgtattgaggttgtactttggacaggagaaacaggattggagtgatgaagtaatgccaacagctgtgaaacctgatctgggctgaggttggagtttgggccaattggggcagtatggggaaaatgcccatcagataaaactgagcccgtcgaattttggcccagtttggggctactgcctcctactttcccttttgcgcgtcccttgaagccaggtgggtatccatggaggcggaagcatttgtcaacagtgtgaccagtcattgagcaatgagtacaaaacggacgacgaccctttcctggcaactgagcagcattcacaatcgggagagaatggacacccaaatgcatgtttctttgacgttcttcctggagcacaagagagaaaacttttccaagggatggcaaaggatccatgagcaagatctgtgcccgggttgaagaaaaggaatcgttaagtcccatcaaaaacaggatggagcgctcttgctcacgaaagaggttccagtctttcagtccaccacaacggcaggaaggcagtggctcaaattccttcaactcatcccaaagtatcttcaatcgtgtataatatgagttgacatctagagcaccttgagtgagtgtggtaatttgagatttcaattgaaaaatccgaggaccatttccttgttgaaatcactctttgagatcaacccaaatccctgctgcagtgggtatgtagaggagactatcagcgatttcgcgtgagatggaattgagcaaccaggaagtcaccatgttgttgcatcgaatccaaaaagaatggagtaagtcttcggaatctggggaaggaagggaaccatcaacgaactgcaatttgttctttgcagtgagagccgtggacatagctctattccaggtgtggtaatttgttccagtaagatggtgagtaacaagcacaatatagtacccaggtgtgtttcttggttatccacctgggtacaaagcttataaaattctagatgtcacaacaaataaggttttcatttcaagggatgttgtttttcatgaaaatgagtttcccttcaaacatctgcctccacatactaatgagatatttgctgattctgttttacctactcaagtcccttcttcaaatcccttagttgataaggattccagtttcccctcccagccacttgaaattcgaagagtgtctgatagggttgtcaaaccacctacatatttgaaggactatcattgttatactgtgaattcttctacacagcatcctctagagcatattctctgcaattctaagctatcctcttcatatgctgcttttattggctcggttaatttacatcctaaaccttcttccttctatgaagctgtcaaagttccttcctggcagcaggcaatgcaattagaaattgatgctttagaaacaaatgggacatggtctctggttccccttccctctggcaaacgagccattggttctaaatggatctacaaggttaagttgcatgctgatggtaccttagaacgttataaggctcgtctcgtggctcaaggttttaatcaacaagaaggcattgatttctttgatacattctcaacagtagctaaaataacttcagtgcgtttactacttgctttagcctccttgaatggctggtctcttactcacattgacataaacaatgcttttcttcatggtgagttggatgaagaagtcttcatggttccacctctcggttatctccatcagggggagcctcttccacccaacatagtttgtaaattgcacaagtccttatgtggtctcaaacaagcttcgagacaatggtttcacaagttttcacaagttttgattgctggtggccttgaacaatctgtagcagattcttccttttttgtaaaaaggaaaagagactgttttctggccattttagtatatgtggatgatattatagtggctggaaataatgatactgaagtgcaacaactaaaaggttacttgaacaatcattttaagttgaaggatctaggtaatttgaagtactttcttggtatagaaatagcacgctctcttaaagggatttccatttgtcaaagaggatatgcattgcagattttgaaggatgctagtttaactggatgcaaagcaaaaactactccaatggaggtcaacataaagctgtcacaagaagaaggtgaattattagatgatcctctaccctatagaaggttgattggacgcctactttatttaactattacaagaccagatttatcatatgcagtgaataggctcagccaatttttagctcatcccagaaaacctcatttaaatgttgtccacaggcttctgcaatatgtaaaaggaacggttgggcaaggcattttttatcctagtactgggcaattaaaattgaaagcatattcagattcagattggggagcatgtaaggatactagaagatctattactggtttttgcatcttcctaggggattcattgataagttggaagtcaaagaagcaaccaacagtagccagatcttcagccgaagcagagtatagagcaatggctaatgttacatgtgagctcatttggttaaggtctctctcgattaattttggcatattacatcaggaagcagcattgattttttgtgacaataaagcagctttacacattgcggaaaattcagttttccatgagaggacaaagcacatagagatagattgccatctagttagagaaaaggtgttgaaaggagaagtgaaggtgttgcatgtttcttctcaaatgcaattggcagacttattaaccaagccattgtttcctggccagtttacaacattgctcaacaagatgggagtgttaaatatacactctccatcttgagggggagtatcaagattataattagtttttagtttttcttttatttctagaaacgtttttcttattgttttattcttttctgttataacctcacacagctaatggtgtgatgcagtagtgtgcttggttagtgagagtttgttacatatgcctttttctttcctgctctctctctggtatatatgaggagcatttcttgttttcttcgagggtgatgaatatacaaaagcatttcagctaataatatgcaccatctttgttaggtatttagtgttgctcgagtgaatgttaaattactaattttaataactaattctcttgtcacatttttacttaattttctcattcaaattgacactaaatacggatgactaacacttattaaggtggtgctttttaacacaagacaaacaaaatatataagatatatacttgacaaaacatgacaggtaattagttgtgtaaaacacctacaaaataactcattttgatgattaaaaaaaaagtcaattttattacacatgacttgacatgcatgtgtagtgggtatcacgtctatctatgctacatgtcatcttgccttttgcaaagggaagtggtacatatgggttagtcttctcttctactagagatttccaataactgaagaggatttctacttgtgtgtatgatgttgctctaacgtgtgtagatgggatggtgcttttatttttgttatcatgttatagatacaaattatttattgattatgttgatgattgttaaaaaaatttattggccacttttaattttttctaataattaatttttgctagaaaattgttggaagtagaaacaaaaagaaagttacttcgtgaaaaatgataaacataagaaaagggggcaaaactatttataggaaattagggtattaattagaggaattttaaaataatattgaattatcatgattgttgcacaaaaccttgaggcagttacaataactccctcgaagattgaaaaattaaaagcccactcagagttcactacatgttttattgaagatgaaaaaaatgaagatagtaaacttcgaatgagaatgtgaaaaaaatgatgtcacataatgttcaatatacatagtcacttagatggaattattattaacttgagcgccaaaatacattttaagcatctactaatttttcgtatcatcttagtcacatcaaaacattgacaaatcccaacaaaacttgattcttggtctatcaagcacatcagagtcaacacttttcaaagtcttattctaagtcaacaatccatgtcgaagacatcaactggccacctcaaaccattccccacatccatctcgagtttggttccttttaaagttttcggcaagagagagaaagactcaaagattttgtgtgctcttaccagaaatttccagtattgaagaggattttattcatccatctaagacaaatggacatacttaagaagttgcagtcaatgtatttgtcagagaaaacttgaaaattgtgtgcttcagttttcatagcatttaaataatgtagaacaagtattttggataaggtattattaatcagtgtgtttaaaatattgatcaaaaaataaaataaaataatatttattgtgtaaatcataaaagaactaaaaaatcataaacaaaataattttcaatctttttgattaataagccgtcaagactgtgatcaatgagatgtactttgccctgttcacgtgctaggtttactagaaggatcatgaagagctcatatgaagcttatttttttaaccttagaaaagttagttatgacatttctatagtattttttttttctttttgtaacttattataataatcaagcttatgaataaattcccattgaataagtgctattgcaccctaaatcggaaattagtttgattttcatacttggactgttggacataaatttatgaaagtgaaagaaaaagacagacaaaaatctcaagaataatttatgtctgtaataatgtatataaaaagaagaaacaattatgcatgaataacagtaattactaatgtcgtttatatatacattcatatgtataaaatgtcgatacttaaagattagctgcatatgatgaaacagaaggttcctttcccttgattagcaagctgtcaggaagtaccaacaaggtgaaaaggcaaacaatagtagtgcatatgcacttctctgggggtagcttctgtaattttcaatccaccgaaagtaccactagtccaaagaagcttcattgtttttattgatcaccaaaaattatattgattcctctctgtaaaatactgatatgatgtcaagaatcattgaatcaagattaagaagtcaacaaatggaaacaaaatccaatagaaaataataacataagatatgagggtgtataaaaaaacaaaaatctaacctatgctgtcatgccaaaaaccaatagaaggagaactaaatcccataagcctgaaaaaaaataaaggacatgaaaagcttggaccataacatgatatacacgccagaattctatctctatgatttcatatgctgagatttatacacgagtagttcctgtagagaaaagttaaatgtgagtttttatcggttttgtgacttaaccattgggggaagactaaaaataaaaaatgaaaggctaaagggattaataaggttaccttagaacaggttatatgatcatgattcaaattcgaagatttcacttttgtttcccacttagtatagcttgatgctctactaaaaccctgccttttagcctgggaatgtgtaccttgatttgaacgtgggaatgaattcttagaagaaactagaggcagggcacgacaaagccaggattcagaaggtgactttggcaatggtggtggggcaagaggatgcagaacatattcattgccaacttttcctgaatcatcaaccactacaatttgctgcttgttgatctctgcatctttgtcaaatgaacttggcacaagttgcaaggacatcgacttttgattaatttcttgatcggctgccaatctttcagctttatcttctttggccatgagatgtaacatgctagacaaagttggagaattggcatccacaggattcaacacttgggaatccaaattctcctccaaagcttctaggtgcttcatatctcgaaaataatctagtagggaatttctgtcttttcctaccactgttgtgttacctaaagaacgcgaactagagcatgatgattttattgtacttgcagtatctatgtacaatgtcttttcaatagtaaggctcccgaagctatagcttttttttgcttcttgtgatagcacctcttgaatacttgaatgccctctactcgggaatttcaatttgccagaatgattattatcatcttgtttggaatcaccaagcaactttgctccaggaaagggaggttgaggtttacttcgaaaaggagacacgccagcagaaacagctcttgaacgacgaaagggagagagcctacctagctgcttcaattcacctgagtaggtatacctgcttgattcactagtccattttttaattacatcctgcttgtctggtgatgcagctctagagcttgattttctcttattaataacatcccaagcctgcagcaaaaattcatgactctggtaaaaatgagttcaagtcatgattggtgaaagtgttaatatacagaaggagggtaagggtgggaaatgggaatggatcttccaatgttgaattttattgtacttataatgtgacattgtgtcaatctctcttcatggggggtattaaatagagaaatagatacaaattttgtgaatattaatgaagagagaaataggtacaaaattttcacatagaaatgtcatgaagggtacaattgactatagaagggtgcaatgcaagaatagaaagtaagagttatgtagttgttaccttctttatagatggagctggtctatgcgagcgactatgagaacttttatcaggttttccaacctcataggcagaatacaagggaaactgattccccattttcgtcccaggcattgaatttaataagcacaatgaatttctaacacataagcggggaaataatccgcaaactttagctgaattatttgcataatcattagtttcatcgtcactttcctcctcttcttcttcctcctctcgacattgaccagtatatggtacaatgtcagcgatatgtctactaacaaatgacttcttttgttcaggaaccaatttgataaattccctaggttgttctgtcagaacagtttgctttctagaagaagcatattgaggaggctgtatagtcatagcctttgctgcagttaaaaacctgctcatcatgaaatcatgagcttgtttatcagtagaagaggctccacacatatccgcatccacattatctaagccactcacaccactcacactacagttcatagacaatggctctgtaggtgacagtgtttcaagtgcatcagaataaacatcaccatcatcatcatagtcatcattctcttccaccttttttattttctcatctttacgttctttgtcacaatctattttctcacttaaagaatttgatatgcttgggggcctaaagttatttgcaacattaggttccttttccaatgattgtttggcaacatttgtggattttccaggggggggagttggggtaattgaagcctttgtaggaggttgaggttctgatccatcataatcctttgaccttccagggatatgctcccaattgaaagacactgcgacaggttctgttacctgatccaaaatggaatctgatttgtagtgtggaagtgtttgtggcttctctaatatctttctatttgcttcagttaaggatggtgatgtaccaaaagagcgcctcaccgacataagaggagcatcaatgttcaatttcctttcattcatcatgttccacaccaactcaactgaactcttctatgttgcactctcaataataagttcaagaatcaagggaatatcatatgctactaatttcagcacaaaaaggatgtggtataagaatccttctattcaatcaagaaaatctgaaaagagggtgcaggaaccagatcattacattttaaattacaatttaaacagcagattctctgtttcaaatttcaattcaaccgacttgaaccaagatcagagaagtacaataatgcaaccagagagcaaaattttaaaccaaaatgaactcatgataacaggatattgatgactgaaataactttccgttttctccaccattaaccaaagaaaaagagaaattctgtaatggtctattgagattgtggaacgggaaaaaaaggtatgcactttagttataaaagttttgacatttgttgcttaggaaaccaaatattcaagcctgggatgatcggattcctataaaaacctattttcctcttctcaataagccaattatacaaatatttaaccatttcaagtcttgctatcaaaaaaacaacaacagaggtaactacgtacaattaataaattaaacagataaagcaagagaactttcatgaatcatcatatatagcagctaacaagcttaacttaaggtcccactagagtcaacatcaacatcaatggtaatgaggaaaaagatcaaacaaacctatttaataacaggatgaaacatgggacgtggtcatcccaggcatttgcagttcaagccaaattgaatagtgtctggggtaggtgtgtttttttttttttttttcatggtcatgtagcattaagaatgcgaattggccagataaaactcaaaaaatgggatagaatagaatcatcaaataagtagtgagtgaacatcactgggtgagagagttcagtcccatgagagatgaatgaaacacgtcacaaggaagtggttggtaagttgcaaaatggaatgaatgagtaagaataaaggaaagcaaagatagagacagaaaggttcggtatttcgtcttcttttgctttatgcctactttcggattttacatgtgtctgacgaagacaacaggatggactaaatattccactccaatgctattagtcggtacactttttttcactgtgatgaggtgccgttgcaaccacgcgcttgctttttctactgatctactatttaatttttattttgtattagtgaggagaaagagagtgaaaaaagatagaagagagaaataaacattaaggagaagaatcccggccctttaagcaaattggattttcttttctgccacaatgagagaaaacaaatatgattaatttggagttggatcaaaaataaataaaatttcatcaaaaattattttcctcaaatgaattcgaatattagtcaaacaattcaaccttaattttaacatattaattactgtttacaattatttagttaaataaaattattttaaaaattaatgagtatatatgtatgtagataattttaaatttcaaatatatcttaaatttaatttattagcatttttaaatattttgctgtttttcttcatctttatttaccaatttgaattgtaaaaattaagtttattatgtattttaattatgtatatactatctcacttcaaaaaaatgaatttataataacaaattccagcacaattgacatataattgagtcctctaaaaaaattgtcaaattgactttgttaaatatgtttattagagtttgaatcttggttttatacataaaactagaattcattaggtaatgatataaagattattattgagtaattactgtttaacataaattatgaatatacaactacattaaaatatttaaaataatttttttattcataataatcatatctaattcaatcatgatcacttataaaataatattgatagttttagtcgataaaagtaaaatacttttcaattgtaaatgatataaatttttaaaattttacacttaaaattattttcccaataaaaggataaaaatatttgtaatttctttaaaaatttattattttaataattaattcaaaatattacactattttgatgaaaaaagccaacttctcattcactggtttggcagaggtaatgcacgtcctcagtcctgcggagaaacgccagtattacatctttctcgtctttttctgcactataatttgcaaaagaacacccatggaccatggacaatgtcaataactattaaatttcagtataaattgttatgaattaccgttaacgtacgcttaagtttttagctaaaagtttataaataattttatattaacgcattctttcgaaatttacttcttatttaaaatagagaattcaaacttgaattcacttaatagtaaaaattcaatacaataactagatatataaaaaaattaactctgcgaaattcaaatttttacttaaatgttcataagtactgtaaatttatatgggacaattatcaccattacaaaaatatcgttttttttttatcattttggtataaaaaaaatagcgttgggggacctctcgagtgggaagatggcatgagactcgtgcgaataaaattacatataaataaattctagtggtatatgacaagaatgaataacacgtacttactccactcacaaatttggattggaccacctaaaaacaaaaaattaaattataattttacttttttataatttttaatatgtaatttggttctcctgatttttatcatgatttttgtctctctattttaaaatttttaaaatttaatccaattctcaattttccaaatatttttttcttttactttggtccaattaaaccctattaatctaaaatattcacttaatatatcatttaaaataatttaattaattaaaatataaaatgaaagaaataaatgtatgcataattaaagattgaacgaaaattgtaatttttttaaaatagaaaaaacaaaatcacatagaaaaacaggaaaatcaaaactacagattaaaattataaaagaatcaaaactaaaatttaaccaaagaaaaatgagatatattatgaacacattctttagcgttagtgttgggacacattttctttaattaatcaaaatttattgaaactatgaaataaaaatcagagaatggttaaataacatgtgatttattttacaaacttttgtaatttttaataaaatatgtctaaaagaatgtgtgtcggagtatatttttaacattttcgcaagagaaacaaaaaaaaggcataaaaaataggaaacgaattaaacgtgagtattcgatcaatactagttcacctaacagctaggtggcaggtgaagcaacttcatcacggactcaatatatatgtcacgcagcttcacaagaacggcataaccattaaccaggttactgatttctgtgaatgatgactttccaaatgaccaagttatttattgttttcttgctccttgtttccttcacatgtagtctctcccttgctatgtccagtgaccagttggagaagttttcttgggaggatgaagaagtgtttcaagtgtggcagaaggagcataagcgtgaatatggcaacccagaggagaaggcaaagaggttccagatattccaaaggaatttgaggtatatcaatgagatgaatgcgaagaggaagtcaccgacgcagcatcgcttgggtctgaacaagtttgctgatatgagtcctgaggagtttgcggaaacctacttgaaagaaatagagataccctcctccaacttggagagtaggacgaagaagctgcagaagcgtgatgatgatgatgactgtgataatcttcctgattctgtagattggaggaacaagggagctgtcactcaagttagagaccaaggaaaatgccgtaagattttattttattttccatatacgtgcatctcaacaataaactttttgatgtctcaaatttgtgttaaaaaaataatctctttattttcaagtaagtgacaaaatgagttgtgttgttcactgtagccggctacatatgatatgattttctaacttagaattaaaaaacatttttcaaaaaacatataattttttattctcaaaattaattaattcatacactataaatattttgcgaaacaactaaaagcaaagtcattggtttacatagatttttgttttttttttttacttcttcaaaaagatgcgaatagtaaaatagtttcattatacaacattaacgaaatatacatatatatatatatatgcacgaattttttggactgatttaacatgttattttgttagaaagccattgggctttcagtgtcaccggggccatcgaaggaataaacaaaatagttactgggaatcttatcaccctatctgtacaacaactcgtggattgtgaccctgctagcaatggctgtgctggaggcttttacttcaatgcatttggttacgtacgttatagataatggtggcattgacacagaagctcattatccttacatagcccaaaacggtacttgcaaggtctgggttaacacttttttcctagcttagtttttgtattttcaaattttaaaaaataaataaataaattggaacaataaatttagacattgtttttgtcttcttaatttaaggttttctttttctttttcttgaaggcaaatgcaaacaaggttgttagtatcgataaccttctagttgtggttggaccagaagaagctctcttgtgccgtgttagcaaacagcctgttagtgtgagcatagatgcaactggccttcaattttacgcgggtgtaagtatctttatttattgacaagtggttaattgaatatgaataatgcctagagattaaaggttattcaaaattgaaaactttgggtatgttccatgtgtatgctaattgtgtaaattattgatttctcataatcacagggagtctatggtggtgagaactgctcaaagaattcaacaaaagcaactcttgtttgtttaatcgtgggttatggttcggcgggtggcgaagactattggattgtgaagaactcgtggggaaaagactggggagaggaaggttacctcttaataaaaaggaatgttagcgatgagtggccttatggtgtatgtgccatcaatgctgcgcctggttttccaatcaaagaggttgcctcatctttggctttatagtgaattagactatggagtactatccatccttttgaaacctataggtttctctaagcacaccaacattgtagtcttgtcttggatctgggcatattactacttaagtacttgtcctttctccaaaaatgataagtttatgaactactagtgcgttttttaattcgggttaaggtgctttaatataataatggatggtggtagttctaccagttggctttggttaatttatttcttggagcatattcataactggtttatgacttgtaagcaaatatttcgttagtaaaaatgttaagcacaaggtatatatgtacaactcaaaacgtcaatatatataatttgtatattgtaacacgctaagaaaattgaaacaaaatatgcatgtctttgttaaaggaaaaaaaacccaacctaaaacatatgccttctcaaattctgttatttcctattctattctattttgatcaccaaataagtcctgcaagttatcattgacaatataagtaggtggagcaacaatagtgggaaaaaaccgaatactaagtggttcatggaattcaagtaaggtgaaaatttgttttatgtaactggaatatgcattcctattaatggcgaataccttaggataagcattgctattaactgaaaaatatctaatgatttaagttaatataaattgttcataataaatagcttaggataagaatcttctattacatcaatcattgggttgttgcagaattataagacctcactttattcacatgattgagaatgatttatttaataaaagaatcaatatatatttgaatcttattgtatacaaaattttattggatcaatgacaattacatgttacaaatgagattagtctctaatccaataaattaaggggcacccatggtatctaatctaagaaaaaaatatatgttagtctcatagattgtattctaatataattgaatagataaaaaaattgtacaattcattcaaaatactggtaaattcaattcgttaaagtgcatagttttgaacaaaataaaattatttaaaaaaatctccgttataatttcattcttttattgctacaattcccaaacatcttctatccattccatgaaaaggaaataggctcaaccctaagagtgtgatttggtttttatacgtactaatcttcgtctcctctcaggaattaagatggaagaaaaaatgtaagaagggcttgatgttcttgaagttgttactttctgtcttgatgaaaccaggtttagaggttgctctatgaacaaaaataataataagcttaacattgttaaagagtgatattcatagttacgtttaagttttacgaattgtctcgttgaacattttattctccttttatattatatatcatactcttctttttttgtcttgatcttatttatataaatttattcttctacatgtagtcctattacgagataaatttgttcaaacacttgtctccactgagtctattatattgttcagccctttttaatttccatgttacattggggatttatgcgtagatttgtccttttgagcgtgtcagcagtgcactattgcttctgatttatttgaatgatatttttttcaaaattcaaattcatctgtttgatttagtctgtgatttgtgtttttaaaattgaactaaattatacacttatattactttagggttagtgttatgtattttatgttgtgtcacttgaatttcatagtattttgtaagtgttatatatataaattttttataatgtttatcgttttctttttttgaatatatttaatctaaaatggatgaaagtttggtaaatttttattatagaaagtttgacatattaataagtttcatagattgttattagtaaatttttaatgtaaattaatttaaaagatgaaaataaagtatataaattttaatgaaataatattttaataaaaattacaaaaattaaatcaaatcataaaatattgatttggtttgattataattttattttaaataaaaattgaatcaaactaaatcatgtatgttttataagtctggatgactttttgatgaataagtgaaccaaattgactcacaaatgtccctacttttgtcacaagccagctgcaaggtcgatctcctttatcatcagattatatagtggccttttctttgttgagtaagaagaaatttagctggttgtgaaaaaaattataattcttgcaatttatttagtttgttttaatatttttttattgtaggctcaaaacgcttgagggaaggacgattggatccttgagctagggaccaatcatattttaatagagtgccttcctttgataaccttaggtcgtggggaaatgatctattaaggttttctaaggacttcttagtatgttagacttagaggttcaagttctaacgccaattgtttggaaagatccaaatatgatggacggagcagacagctcaggcagcgacaatggctgttcctagtgaatttatgagacttgtattcaccggtgcaaacatttcaatgtcaaagtcaaatcgtgtaatatgtgaattgaataatgaggttcaaatgtatatctgacatgaaatgtcttacatagtgatagatggagagaaaattggttaagtggttactcttgaccatgggtcgtcatagtcattttttattattattatggaaagattgaaaaacaactaaaaacacggataaagtactttaaaaatacaacaaccaacaaatcagccaacaacaaaaggaaaatctctaaaaaaatgtttggatgtgaacactttttaaaatattcaattagactatttatgtaaacgtagtttccttgttaccaacacaaggtcgagggattaattaggaatgaggagttaaaaatgtactatattgcttacatcacctaacgaccacgaatatttaaatacagggtgctttcttctatatttgaagaatgagcagcatttctgccttttatgtatgctacattaattcaacgagtgatttcggtcccccaattccacagaaaattaaatgaaattccgttatctgaagatgtttgtcaatttaagactaatgcatagtgggaatgggattagtggtcgtgacttgtgagcattcatatcaactagcaaaggccactgccagcacctggtttcaactttcaaatctcaatcaagccaacagctgcaaacgaaatacacatatcccctcttatcagtaagtcagtgtttagatgaatattgataaaattaattttgaatgaaattgattttaaaatcatgtgatttatgtttgtatgttttattatagaataaaattaacagtaaaattcaagtataaatttttaattcaataaaaaattattcaaaattatttgaaccctaaatcaattctaaccaaatatattaaaatatatccaaaattaattataaacttataatcaattcttaatcaaaccaaacacacaggtcccgcttgccgcaaagtaactacgagtttcatacatctacgtagaatatatactacattcactaaagtactacaatcaattaaaaattcaaaacttttaagttttaatgaagactttatcatttcttaattattattttaaaatttaactaagtttttaatctctaattttttttaaaattatgtatttagtttctaaatttttacttaattgatcaaggtcttttcactattttttattaaagttattagtctctaaattattatttgactgataaatgtctttcaaattttttcattaatatttttaatccttacacttttaaaaaaaattaatttttaatccttaaaatctcattaactaaataagaataatagattcgaactttaattaatttttttaatttattatagttaatatattctcgtcctaaaatcactctattgacgactttacttgttgattatctctggttcacgatatgaatccgctaaggaaccattcgtcaatcaacatgcacctggaattgattcttggcttctactaatattcatttgttaatgcaaataccagtttatcagaaccacgtgagcaagaaatagtaggctaaagcctaaaggggaatatgttctttaatttgttattttctacccttaatacatggtttgtgttcctttttactaacactaaaatcatagctaatcacgtacaactgacaattttcacgtgatagaagaaaaattatggttacaagagttccatcttataaaaaaaacagtattttatcaactaattgtgccatgagcacaactttaatcattcttctatttctttattaattgactaaataatgttgtcagatatcacatggtttcggtgctctagaactgtttttttttaatacgaggcacacttccgatttgttaataaaagagtactcctacatcttatcttttgattgttccaactaatatggtaaaatattctcgagaactgagcaaatcatttttagtagtaggcttacttttctcttcatgaaattctattttgtttgcttaatagatttaatatttgttcaatttagagtttgatataagtataactattttgatatagttgaatttaagttactgaatgtgattgaaatatatctaaattaataaatatatttggtaaatcaggctttccagactcgtcaggagagagtgttaaattgttgaattgggctaaatttttttcttgctgcaaatttttattgttcaaacttagtcttatgttaggctaacgggttaactacaaataaacaaaaaataagattaaataattttataaaatcttaaaatatatatagatttaaaaaaattaaaatggttaattgaatgattgggtaaattaaactcaacttttccggtctaaattttaggagctaagcctatcccaataggccaattgagccaggatagatagacttaatttttttaagcgttttttttttttttgtgctgattaaaggggcaaacgcccgaaaaacaataaaaacggaacagttacaccaagcattgaaactcagcttggatagtagatactacaaacaagggtacctccacaaaggaaactaaaccatgatttaaggacagaccatacttagcaaaatggtcagccaccttaatacaatctctaaacacatgaacaaattgaacactcataagaggcacaatgcttgccttaatcgcatccacaatacacttatcactaacatgaagatcctgcctttaaccatacgaatagcatcttctgaatttgagtggatttccaaggatcaaaatctttttaaacctacttcttcttgtttttattataagcaataaaaccatttatttattttttctcaaatataagcaaaacttaactaatcttgcattatttaataagattatctttaaaatgttattcatttaatagagtcaaagacatttgttatgtttgatattaagttttaaggaaaggttgtttagaaaaaaaatatttttgttttagaattaatataatttaatgaaatttaataattcttaataagtgtgaaataaattttttaacttatcaagagggagtaaattttatcttaattaagtattgtttagatcaatcataaactcgatctcatattaccaattaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttattataagcaataaaaccatttatttattttttctcaaatataagcaaaacttaactaattttgtattatttaacaagattatctttaaaatgttattcatttaatagggtcaaagacatttgttatgtttgatattaagttttaaggaaaggtagtttagaaagaaaaaaaatatttttgttttagaattaatataaattaatgaaattaaccaattcttaataagtgtgaaataaatttttttacttatcgagagagtaaattttatcttaattaagtattgtttaaatcaatcataaactcgatctcatattaccaattagatgacaatctaaattttgtttatactattaatatatttttatactaattttgatattttatgaatttactcaatataagactaaacaatagacaaaaattacttatgtacatgtgttctactattctaaaatgtaaacatatatttcattaaaaaaatagacatcttcatttttttgttaaaaaacagtaaataagttattcattaagagtgaaaaatgtatttttatacttatatcaaatcataaattgtggtatataggaaatttattgatttttatattaattaattagttatagtaacattatattttaattgttatataggtcacatttttatagaatttgactgtcaaaacgcaaaatgaggaatctttaatacaagatgtttaagcacttctcgtattccttcagtttaaactggcctttttttagataactggcattaaattataattaatattataaattgataaataaattcttttgatttgttagtagttatccttttgtttaattttgttaacgttagttttcacagttaattttatcataaaaaatattattacattgaaaatgtaaaagtataacatttctatttttttctattttaattattaaaatcaatcttaaaaattactatgacttttttttgactgaaaaattacaaagacgtaatgtttaaataataataataataatgatcataataatgtattggcatagatttggtaatgtaattatggagaaagcatgctactttataattgcacttgtcacacttgtgcttaagtgtttttcaataatttttttttgccttttgctgttaaataatagtaataataataaaattaagtattattttcaatattttctaaacttatgagtgattgtgtgtatgtttggttttcattgaaaaaataatatcatggtaaaaataattttatcaaagtgcattaaaacatgtagtaaaagtaaaagggtttaaggaaaaagcatggaataaagacaaaatcctcaatttcttatcctttgcttaacacactaatccattccatcaaatgattcaaatgcactcaatctcttttttcaattttcataccattttcccagttactttccttacctaaccctgctactccttttcatacatataaataatcacaattttgtccattcttccaactacacccacaaccaggggcaaagtccagagcttttaaggcgctgtgcttggattcaaacatgcccagtttcatttttttattctaaaatctaatgtttgaggtaaatcctcctctttgtgtctgattcgggtgaaacatcctattggtggtaatccaagtttcattttttacctttttgtttgcgtgtgtttatgtttttgtaacaatatctgaaggttatgtctcaaaacatgaaaaggggttgttgaaagatatgtattttccgccttttatttgatcgcattgttcatcctctgcaaataacagaaggttttttgtttttttttgttgggtttatcactgtgggaggaatgcgttatgtattgtcaggagtttcttttccaaatttcttcaggttttgaaatactgagtggaagaatttgatattggggttatggatcaggcaaagagcaaaggcagtgttgagattttggattatgtcgatgaaagggtggatgaggatttgaaccaattggttgaaggaaatgcaattgatgcaggaggtggacatagcttggatgaaggagttaatgtaagtggggaagatgggactccaaaagagatgtacaatgatcttcgattgaatagggagctaaaggaggggtctcaagaagctaatgatcagaacatgggtgacccacaagaaattaatgatacattgtatagggttgatcaaggaactagttatagttcaagaaatttggttagtggggaagtacctgagacttgtgttgcaatagatccttgtactcaggttgagtgtgtcaatggagataataggaaattggaagcaaaacctaatgaatcagagttgaacaaggtgtccatgaaagtgacaaatggggtgtctgagacagataaaaattcatgtgtgattgatataaaccgtcacagctgtgatgggtttagtgagaatttggaaggtgaaatgatttgtaggatttgccatctggcctctgggcaaccattggaagcagcagatgttggcactgcaagtagtgctactactcatacagatttgattcagctcggttgtgcatgtaaagatgagctagggattgtgcatagtcattgtgctgaggcatggttcaagcttaaaggaaacaggtaactgttgcttttgctaatacttgtttatttctagtatgtagatcaacattttgtttagtttttcttgaagttttttgttaatgcctgcaacattgaacatgccctgaggatttctatgtttctgattaattagtattagtatttagtaatcctatttggcacaatttcagaatttctgaaaaagaaatcgtcttgggctatacattattttaataatttgtaacatttatttcttttctgataatagtcggttgtttttttcttttgcttaataggtagattttttcttttatttcttgtcttatgaaatctttgaagttctgctgcatacttgtactgttatgcatatagcattagcgttactattgtcattattaaatttcgttatcatcaataggaaattctaaattacaattttattgctattattatcttatcaatattaaactcataactccaaaatatttgtaaatttgaggatgaacttttgaaattgtcttcattgtttatcattagtcagttggttaatgtatgcagctcatagctgtttcaatttttactggtacatctctaactggagaactgacatcattgttatgtgccgtgacacatggagtttctattggtaatatacttaaatgaggggtgagctgggcaaatgcatccagaccaatgttgtcaagattgcgagtatgatcgtatactcgtgcgatcttgcgattttcagaggggtcgactaggttactcggagggaggatcgttgactttgcggatcgtttggggatcgagcgtttgcttgcgaggtggatggatcgacgatccgttttgatcccaattgggtttcgttttcggtctcgttctcgcgagagttttgagaggaggtgccgttgttttggagctcttcggagagggcagtggcgagaggctggaggagcttctcaagctcgtcgatgagagcgaggacggaaggtttggagcggagaacctcttcctgctccttgttcagaggcttgctctgggtgatggcctcttccatggtgagggtgcagttcagcttcttgcggagggcgcggaggttgcacctccttctgttggtctttgcttaaatcggagttgtacggtggtgtcgcctcggagaaggattgtttgcggcggagaaagagataaagagtgggatttggtttggtttggtttggtgtgagtgtgtttggagagtgtagtatgggtttgggagagtttataatgagtttggggttttgattttgtgtgtttagaatattgggaggaaaccgagtgggccgaacttgttggttttgtggacatcttcgattggcttccttggatccaattagatatggacacagcaatcttctgtgccagctggatataacggatggatatgttgagttgaatcatcctacacagaatcataccatgcaaatcaaagagaataaggatattattattggatttcgttgtgatgctaaaaatggaatttgatttgattgtcatttaagtatttcaatttcaattgtttatgaaaataatttcctggttagctaaattaatgagttcaaggaatggcagtatttttttgttactatctcagagtgaaaaaatgataaaccagtattgtttttcttgtctatgttattttttatgtatatgcatgtatataaatataattttacatatacacgtaactcttacgatcctcgagttacgatcttttacccccccttccgatccccttccgatcctcgagtttgacaacattggtancccccccccccccttccgatcctattacgatcctcgagtttgacaacattgattcagcacctggttggttttccttctgaggtattagcaaatggcctggtttctagtggttgtgaactgaggttgattgacatccaaaattccaaataatgacatcaagcattagtttagtgtatagtatatgaatatatgaaataatatgagaagctctctctcaacttgcttcaatctagagctttgtcagagtctcagtcgctgttttcaatattgtttacatcaaaattcgaattacgatatgatgtttcatatgtatgctaaattcaaatttttgtggttcacaattatactgttcctggtgaagaatggtctgggaataccattttttttggtcatttgaattctaatttgtttttgaaattactctaatgtatgtacttttttcatcttaggacccttaagaatttgaaagctgttgggtgggggtgggggtgggggaagctctatcagtacttttttttccattcacgtcctatgtacttgtgggttattctttttgtaatttgatatcctttcttgtttattaagctgagagagaagagtttacatgtgtttttttttaaacatttacatggttataagaatgttatcaccaagcatggtcaatcttgtttcacattcaaactaggttttagttcaataatcctgaggttccttttgttctatgttaccttccatgatcacaggttgtgtgaaatatgtggtgagactgcaaaaaatgtttcagatgttacggataatggatttattgaagagtggaacgatactagattcatggacagtgataatacctcatccagaaggtttggtggatgctggcgtggacaaccattttgtaacttcttaatggcatgcctggtaatagcttttgttctaccatggttcttccgggtaaatatgttctaatggaggagtcaaacactattcttcccttcaaatctttattcctgcctaaatgatgagtgcatcatttgctccttgcatattgtttttctgaaggggtggtaatgcttaaccatgaccaacttcacatttctcagggtatgtagttccctgaagccttgaaatttggttgtaaagaaacttaccaacttggcaagttatggccaaattgtttcccaattgcattcttttaattggagtgcgtgtggtttactgagatatgtataacagcgggatccattttataaaggagtaaagcaaagaagataatttactgtttcccaaaggcataaatgttatgttagaactttgaaacagtacattattcgctgtaaaacaatcaaacaaaaggagcctctccttgattttccttctccctttttcgttttttcacttttttctaatctctgttgacttgtctgctagtatgaagttcaaagaatccaatgtcatttgttgtcatcaatgtgtttctattgccttctttttgtttgcaaatgttctagcttctaacctaagtaaaattggtcttctcaaaagctatatgctccgaacgcttgccttaattttgaagctacatatacgaggggcaaaatttaatcgtgataaaaaaatttaacctatggattaaatacacatgtaaacttgttggggatatgacatacacataatacatacatataatattaagaaaataaaataaaatcctagtggggcaaattatattcagaaggttatgtataggtttgtcactgatttgatcatattcctcattttactaaaagattatgtttggtgaaatatctttgaatataattttaattttagtcatgttttataaaatacagatacgggcatttagttatccaatctgaaaaggcacaggcatcgaagttaatattacccatgcatataatataggtttgggtacgggaatttttttaaaattgagagtatggagacgaatgcttcgagttcaactgtaatcctttaaaaaaattcacaagaaatcaccatatgtacgtagtgagtcattaataaatataattaattaatataaagcttattgtatcaatccgttgtagtctagttggttaggatactcggctctcacccgagcgacccgggttcaagtcccggcaacggaagtgtttttttcaattttgcaaacaataatgtcgtaacattattaacataagtacacgtgggaactgagaagatcagaacgaaaacgaggcataatttttttctttttcgtgtaggtaggtaactaggtatgtatagtgggatcaatgttgtttgaagacgaagacagaggccaacgctgaccatgtcgaaaagtatagcaacgttgagcacttatccaacatatcatagtcataggaacaaatcaaactatgcaaaatctccgaattgtttcatcttcttcagacaatctaggacaacatgtctgtcaccttcgaatttggacctttcttgcggtagcagtgttggtgtctctgcggctttgtctgagaccacccataacaacgtaaccgtggacaaaaatgcaaagatttgcaagttctgcgaaatgggtgatctgagaaacgccatggaattgctctcaaggtcacaaaaatctgaacttgagttgaatacttactgttctttgttgcagctctgtgctcagcttaagtctttggaagatggaaagaggtttcattccattatcacttccaatggcatggcaattgatgaggttttgggggcaaaactagtctttatgtatgtgaattgtggtgatttgattaaagggagacgaatatttgatgggatcctcaatgataaggttttcctctgaaatcttttgatgtctgaatatgtgaagattggtaattacagggaaagtgtgggtctttttgagaaattgcagaagttgggaattagaggggattcttatacatttacttgtatcttgacgtgttttgctgcattggcaaaggtgagggagtgtaaaagggttcatgagtatgttttaaaactgggttttggttcttataatgatgtcgttaactctctaattgcagcttattttaaatctggtgaagctgagagtgcacgtattttttttttgatgaattgagtgacagagatgttgtttcctggaattccatgattagtgggtgtgttatgaatgggttttccagaaatggacttgagtttttcatccagatgctgaatttggggtttgatgtggattcggccaccgtggttaacgttcttgtggcttgtgcaaatattggcaaccttacattgggtagaactcttcatgcttatggagtgaaagttggtttcagtggggatgtcatgtttaacaacacattactagacatttattctgaatgtggtaatttaaatggtgcaaatgaagtttttgtgaagatgggtgaaacaactatagtttcttggacttcaatcatagatagctgctcatgttcgataaggtctacatgatgaggctattggattatttgacaatgcaaagcaaaggtcttaggccagatatttatgctgtcacaagtgttgttcatgcttagcaacatcttggataaaggaagggaggtacacaattacatgaaaaagaacaacatggggtcaagtttgcctgtttctaatgctctcatgaatatgtatgcaaaatgtggaagcatggaagaagctaatttaattttctttcaacttccactcaagaatattgtcttatggaatgcaatgattggaggttattcacaaaactcactccccaacgaaactccagagctgtttctggacatgcaaaaacagtcgaagcctgatgacattacaatggcttgtgcaggcttagcagctctggataaaggcagagagatacatgggcacatattgagaaaagggtacttttcagatttacatgtagcctgtgcacttgttgatatgtacgtgaaatgtgggttactagttcttgcatagcaactgtttgatatgattcctaaaaaggatatgattttgtggactgttatgatagctggatatggcatgcatgggtttggaaaggaagcaatatccacatttgaaaagatgaggattgcaggtattgagcctgaagagtcctccttcacttccatcctttatgcttgcactcattctggattactgagagagggatgaaaattctttgattccatgagaagtgaatgcaacacgagcccaagttagaacactatgtgtgtatggtggatctccttatccgctctggaaatctatccaggacgtacaagttcattgaaactatgccaattaaaccagatgctgcaatttgggatgccttgctttctggacgcgggatacatcatgatgtggagctagcagaaaaagtggcagagcatttttgagcttgagccagagaacacaaggtattatgttcttctagcaaatgtctatgcagaggccgaaaagtgggaagaagtgaaaaagttacaaagaaggataagtaaacgtggattgaaaaaggatcaaggctgtagtttgataaaggtccaaggaaagtttaatatctttgttgctggggatacttcacacccccaggccaaaaggatagactcattgctgagaaaattgcgaatgaaaatgaatagggaaggttactctaataagatgaggtgttcattgattaatgcagataataggcagaaggaagtgcttctacgtggacacagtgagaagttacccatggcttttggaatattaaatttgcctccagggaggactgttagagtaaccaagaatctaagagtatgtggggactgtcatgagatggggaagttcatgtccaagacaaccgggagggaaattttgttacgagattcaaaccggtttcaccatttcaaggatggtttatgttcttgcagaggtttctagtaaatcatcgatcggaaaaattcaatagaggggaagttctcccatgtcagtgtatcattcttctcttcgtgagaattgataattgcgtatttcaggatcacagttctcttattgatgtaggacgcattatagattaggatacaacgtcatggccaaaaagtgtatgttgaagtgatagccatagtgtgtagaatcagtgattgaggctaccgtttttgtagttacgtcagaggcaactttatgtcctaacttcgtctgtgaagtgatgttattcatggatgacttatctaaacatctatatttggattggaaaaacattgtagcagagatctataattggggttcagatgtaacattttttctctgaaatagattagtggcaggatgttatttatgatttgtgactgtgagtgatctcagtttgcttttagattccaactttttttttttattatttctgataatgttgaccaatcttgactcttgagaaggggataaaaatgagaatgaccacaaaaatgcttaaaaaatgagaaagtcagcgcagtgtgttgtgtttgtacccattttttgaattaggatgccacgccacatactaaacatgtaacgtgtttgaggtattttagattcaaattgctctccgttaagtatatgattcagctgaaacattacttattcacgtaatcacattcaatttgtttctctaccgttaaaggaatgtgaatcaaataacttcacttctcaaaagtcacaaatgtagtccttcaaaatcattttcatgggttaaaataataatggattatatcattcataagtctttacagtctactaattttaaaacgaaaagtaaagatttatagtcacaaataaaaattctgaagttgaaaccgtgatataatatacataatgtacaaagttatacgacctataaaatttgctttcttgatttttgcatcaagagttacaattatacatgataccatgccatcaaggtatatcattattcaaatattgatttcacccaagcttagccatacaacaataatggtagattgttactttgagcctgaggttctctacatggccatttatcttctcattttccctcaaacgttcttggactgctcaaacttgccaacttaggcttcagtgcaatattttccttgtagtacttcgtatggggctaattaatttgagcattccaaagtaaaccaagctgtaatatatttagctacttaatcagggtatgttggacatctcataccaaaccatccacaataaaatcagcatggacatcataattgtatcatagccagacatccacgaccatgcattattattccctacttaccaaatcatgtgatcaaccatgaccagctcaccgttgttcgtctcctatagatcaagttgtgccaataaataatggaatcactatattaccccatatatatagattagaaccagaaataaattaaatataacttcggcttttttttttctttcccaaatgaaacaatggtcaaacattatttttagggaaattacatagtacaagagatgcaaatagaaaagactataaaaaagtttccatttaaacaatataaactattaaattgaaaaattctttcacaggtttaatttagaagaaatttaaattagcagaaagctaagcctcataagaaacaaatggaatagtaggcactttcctgtgttttctttttggttggaagcacttttcttttaatacaacacaatttgcgaaccctaactttatgcctgagactcatagttcgttcggtggaatggaaagaaaaaaaaagaaaaaatttaaattggaaagaaaataaaaaaaaagaaaaattttaaatttttgtttttagaagtcaagttttcttttcattttccttttattttattttttcttttcaattttttttaatttttatctaccatatttctctcttttaaattaaatacatcaatactaattttataatttccaaaaaataatatttatcaacaaagtaatgtatattacaaaagtgtcctaatgttagaaaatgtattcctaaccctctcaaagtctatttgataaaaaaaaaaaaaattatagtgtgctactcaagtttactagaaattgtattcctaaccctctcaaaagtcaattggataaaaaataataatgaaagtgtggtactaaaggttaatttgagacaaagagcaacgacagtgtacatgtgctcctcaaagtttatttgagagaaaaagagtaatgaaagcgtggtgcaataatcaaaagtgtaattgaggctcgctgggtcagcaaaacggcgtattcaatgagaagtgtgagagaaataagaggttatagcacaagttaatcacatctttctgggtaccacatgatgctttctggataccatatgcatcatccatccccaccacctcttctcctcataaacattaatacacaactaattacaaaagtggcaaagaccatcatgataccttgtatataaatgattgcaccgaacaagaaattgattaaaaatagcaagtgaaacaaaactcgcacattaattttcccctcctgtttctatcgggtgccacattttggcaatctctcatttctttttcaatactcttcctcttcaccttcgaattcgtataataaataaatgaattaaacaaagaaccattttgaataaatgaccaaaattcctatattctaaattcagaaaagcgtaaatcaaatttttcctcagcgacagcacttggagcacagtattaggaaaacaacgagaaagacaatggaagaaagcgctattgccacaccaagaaccaccttgttgggcccatggtgatgctccttcatgtgacgggcactgccaccaccatcatcatcatcttcatcataatcataatccccatcactgccatcatccgcagaattagaacgcttcgaaggtggaggagacaccggcctcccaaacttatcacaaggagcaatctcaagcttcacgataaacttggaagacataacggaacggttataacacaagttcccattcccacccaccttcaacacctccaacttgtcgataaaacttgagttgaaaggcacaaccccgtgaaggaggttgttggcgaggttcaagtgtttgaggttcctcatttcggaaatgaacgtgggaatagtcccgttgagctggttggagctgagatccaagtgaagcaaaccgggtatggcagataacgaatcagggacgttgcccgagaacgaattgaaagccaaggagaggtttttgagggaaatcaagtctccaatggaagagggtatctcacccttgagtgcattggaagagaggtttaaaacttggagattttccaacatggtgatggaggggggtatgttgcctttaaggttgttgaaagagaggtcgaggtaggtgaggttgggggaatggaggtgtttggggagagagccggtgaggtgtgcgtgggagatgattagggtttggagggcggtgaagtgggagaggatgaggtagggtttgatggtgaggtaggacagggtgaggtgggtgaggtttttgaggcgggagagggaggcggcggagaggtgggggaggctgttgatggaggttagggagaggaggtggggagggaagtggatgggggaggagggagtgatggggcagttgaggaggtggagggtggagagggatttgagggctgtggaggagagggagtggtggatggaagtggaacagttggtgagttggagggaggtgaggtgtcggaagggtgtggaggtgtcgcagaggaaggaggtgggttgggagcatgggtctcttggggtggggatgttgagggattggagggctttcagttggtttgggtcgagagggagggatagtgagagggttgtggtggggaggaggaagaggagaatggtgatgaggcagggagggaggggtgatggtatcatggctcaactcaacggtcagaaaggcatgcaggagcaatagtgactagtgagtaggaagaagagtgatcgtagtgagaacagaaggagagggacttcttatatggacatcgtatttaaatgcatgccacctgtatcttaaattaattgatgattttgaaaaaaaaaaaaacttattaaatgtcatttgtaatagatttcacttcttattgtcaaatgtttgaacgtcattgatgaaaattatataggttttaaaaattgagggaaaatgtttataattttcttaaattttaagggaagtttgtgtgtatatatatatatatatatataattctttcaaatctcaaaaaaaatatgtgtaattttaatcttttttataagatatttaattaattttttttcattaaagttagttctaaaataatgtgacaattagaaaaacgtaatctattaatttgttaattttgtttacatggatagttaatttttttaaagataacaattgagtaaattatatgatttagttcttaactatataaccttgtttcaaactaccgattgcattttctagtagattaataacgatttattttcaaaaataaattttgatacatttgcaaattgttgtagtaattgaaattaatttcctaaaaaaatgttgcgtgggtgactgttgtcatgtcaatatcatttgttcatatgatatgttatattacatgtttatgtgaatgtcatgttatatcgcttaacaatttaaattaataataaaaattaaaacaaaataaacgaatttataagaaattaaaattgatcaaaatatattttaggaactaaaaattcatataaaatgagactcaaaaggttcattaaccctattaatctaacttgagctgaggtatttatgtcttccatttcattctttggtacaatggaaggaataatcaatactaatgtttacataaaaaaagtgaaaacttatccgtttaaaatattaatggtaccttacctgggaatgttttcttggggtcagaacttttcaactgaattagaatagtgcgagtgggatccagctcttccatggggttcctcagttccactactcttacattaattttatttcatttagctcgacctttgatggttctctctttaaccaatagccggaccttttattattttactaaattgataaatgataactagtctttattatcacgtcaacaatggtttggttttcagttcgacaacaaaaagaagaacaaaaacggggtaaaaggaagcaatgggggcgtgatgattattatatttcttctctttatcgatctctctccttttcaagattattttggcattttagtttccttgttcttacgttttatattataattaagttctttatttcttctatatattgtaattattatgtttttcttttgatatatcaaaagaaaaaacataataattacaatatattattttaagaaattaaccctttgaaactacgtcaattactgtctgacatccttttatttgaagtttttctgtatcttttatcttcgagcgtgtaacgagtgcatcagccatgaatggcggtgaaaaactttttccataactccatgattaatagagctagagtatgtggttaaggatacgagcacgtgcactttagaaaataaagtatatcaatacgatggctaaaatcatgtgtttagcaaacatgcatgcatgttgagagcaacaggtagcaatgtgactgctaaaattctctaacatgcgtttttgtgtgtacttgtgtcagcccaaaacaatagaactcgagctcatgaatattggactgaaccaacgattgatttggtgaaaagctatccaatggagcaaagaaaaaccaagataagtaataacaactcaatgaaaaatttaacaactttttatagtgtaatctcttgaatgtttgtgcttccatatccgagacattctcttcagatcaatctttctttcatagcccacttatataatgtgacagaattaaccaaaaggtatttaatgtgtcacttacaaaacatctaaattattacaaagaaatagtactagcatatttcaattataaggatttcactttatattgctttaacatgctactccactaagatgtgcacaccgataggcgtagtaattatacaattaagatttcataatgctcatctatatatttaatcagtctgttcgattatatcaaaatcaacttcgctatggccaaatttctattagctcaatctcagttgaaaagttgcaacaaagttttcaaacaacaagctaaaatattattaataatggactaagtctaactcaacttttaaaactaaattaaagaaagaggattatttgtgttttatgaggagtattatactatagttatttttgttatgcacgtgagaaatcttaacatatcaacgtcatgtttaaaattagataactagctagagtgaagtttgtaaaactcaattgggcctaacccttccatgctccatagcacctaataggcccaagggaactatatttgcagccccatccttttctctttaattgcacacccttcaattttttttttatgtaattgttttacaaaaatatccttttaagacattaattttcataatgtaatcatttttttttgacatattacgaaaagtagttttcattttttatgcaaccaaaactagttttcataatataataaaaataactacaatagtgaaaacagtttataaaagtaattaaaactaatttatgttaagccaatcatttaagctattaatcatattaaattaactttgtgagtaagtaaacaatatattgacaaatagacctattattcgattaaaaaatttaagaatttttttttgtgaacactattttttcagccttgagcttagacttaattctttaaaatattgaaatctgttcaacaagttgattctttcaacaaatattattttatacatatagacttgagattgaaccatttttgatcttatgtttaaggaacaaattaatttataagctaatcatatcatactatattaattaagaaattcagttgcaaaacaaatttagctaacgatttttttctctttaataaaaagaaaaataatacttaaaaaatgttaacagataaaatattttttttcacaggaagatataccttttagctagtagggtgttatttttcaataaatgggagaaaatgaaacacgtacgtaaatatgacgtgtaagaactttggacaatacttacctcctgtttaataagttgggaagttcatagcctgaaatttaaaggaaagaataattcatggaaaacccaataagtcaatgagtagcagcagctcatgtctacagttgtctgtgaaattcaagacccattttttctcttcaggataaatgaaatagagcaaaatccttaacatattttaattactcactcaatcttggatgatgtgtacaatccaatctttaaatgattcaaatatatctcatatttttttttcaaacatatattgtattaattcttatcatagataatactttaggatttaggagtaatgcaaaatgccttcaacattttctcaaatggaatattatattcaaaatgtatgcatttatgtttgggttaattatatttttaaatcttaaactattttaaaatttattttttaatttttttaaaaaaatttgatcaatcaatatcttttaatttttcattaaagttttagttcttgtgttgtttattgatgttgtcaaaatgttgatgcgaaatcaatttttttttattatatttttgtgacgattaaaaattatcaaaaatgcttgataaaactttaaaataaatatcaaatagttgccaacaatttttaacggccaaaaattactttttcctgattctcacgagtaataataaaaatcatgaagttcatacaagatcatacagagtccccaaatcaacataaataataaacaaaatcccttgaatcaacaaccttttctcttctcccctcctccaatttcacaattgtaactccttaattctaatttcttttttcgctttgttttccttgaccacgttctttctttccttgaactcgaggaggtgggctctgccattgctttgtttaatacttctacttaaggttaaagcaaaaatgaattaaaagtttttattgtttaagttatgacaaattcataatatatatgtaaaatgtactgcacaaacccttctttttgcaacactcaatatatatcaccaagtctgaaaaacaagtgatacaaatgaagggtttgtttaatacatatatattttgttaatttgtcataacctaaacaataaaaactcttaattcatttttgctttaatctccagaaagagttaaaataaataatggcacaaccctcctcaagttcagggaaagaaaagaacgtggccgaagataaaaataacgcgaaagaagaaattagaattaaggaggagctacaacttggaaacgtaggaatcgtgaaattgggagtgacacagaagaaaagagaaaatgttgttgatttaggaatttttattattatttgttgttgatttgagggttgtgtatgatattcatgattttcttagtatgagaaccaagagaaagtaattccggacagttaaaaattatttgaaattatttgatattcggtttgaaagttatatcaaatattttctaatgatttttaactgttaaaaaataaacaaccataaaatataataaaataataattaaattaacatcacaacatcatttaacaacaatagatgatatggactaaaatcttaacgaaaaaaaaagttaaaaaatcttgacaaatcaaattttatttaaaaacttaaaattaactttaaaaaaaaagttcaaggaataaaaatgtaactaatctttacatttctcagagtataattgtaaagggaaaacaaatacgcaaagcagaggaaagcataggcacatatgacaaataatagatttatttatattacaaattcacaatcccctcgtctgtcaccataaaagaatttgaccataaaacaaaaactgaaccaacaaacaaatgtggtgccatctcgagaaagaaattaaagaagaaattttagaatacatcgatggattggtacgagatgtcgtgctatgagcttctcatcaacctccacggagtgcccttttttgcttggtgaagaggtacgtggcacaatgcccttaggaaatgcactcagaaacaaactgttcttttttggagatgggttcaccttcttgtctaaaacaagctttctggcttttaaacacaagctaagtgaagcatgaacaggaacaacaaagtgttaggacgtgccatattaatgtcaactgcaacgagcaaatgaagcaattgggaaagagagagggaatgactctacgactatgggcattgagggcaagttattatatacttatatttgatgaatataataaataatattattgtgtattaaatacatatattattaatgtatgcatatctgtgtataatatttcataaataataaatgtttattaaatatgacttttcatgcatgtaaaatttataaatatatattaaaattttattattaaataaaatataaataatcaaaatcacacccatgtatgtatttatgtgtagttaacacatacaataatattatattatttgttaattatattaattaaatataatatatatttcatctgttccattataattattgtgtaagaaaaaaattatttcaaaataattgtcattttaatctttaatataacattaattactttttttatacttatgtcccttgtaatattagtaatggaaaaaaatgtataaatgaattaaagataatataaaattaaattttagaaaattactacttttttttatttgttgattaacttttcttgttttcttgttttgtgtaaaataacctaacaagtttattattttgaaacggatggagtagttaatattacatacacattcatatgtatttaatgtattaagtagtattagtgtatttatttaattaacatttaatattggcttgtgtccaatcaagaatttctttgtataaatatttaccatatctttttaaaattagattcttattaaaggaaattaattatatcatattcttatttgaaagaatgaaaataaatctaataaatcatgaacaattttctttttattttactaattgtaaattttctattaattgtgaataaggaagaggtgttggatttttctctaccaaaaagtacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttaatatctcttttaagaattgatcttaaagaacatatattagataatatgttttattttgtttttagttatttaaatagaaatattaaattgttcagtaaagtattatttgattttagtcatgactcatgagtgttagagaatataatggtaatgttgtcatagtgatggaaacagcaaaaaatggactactaactgaatttcaattttttcaatggactgaataatctctatttttcacgttgataaattatatactcaggctaatggttacagattttccattcagctcacatggctacaccgttcaacaaagaactaacaaataataatccttgtataacgtgcacaagctgtggatgaagtcattatcccatgcacccttttggtaagcattcttgttgtgacttaacaatctatggcaatgcaggtctcggcgatggtttcactgtcaactgtattcacaaatggatttatcttgacccaaacaagagaaaagacagaggccaacaacactgaccagagaacaacaatggtcggcgtgcggttttggcgacccatgagacctttgaggaatggatagagatgaaaaatcacccagaaagcaaagaaaactttcccaaaaagggttccccaagactcataccctccattaagtgcatcagagaatccagcaacaacaccaaccatgttaacaatgataagagttgttggaggaatcaagagagtagtccactttactaagtaaagttccccaaactcactgtcctctgcagccttagcagtgacagtgaagttggtgtcaacaccagccaacatcttaagaagtccttggaacacggcaaacagatgggctgaaacacctccaataacccagaactgctcattacgccacaaatcttcgatactaacaccactccatcgcagctcgagcacactggttattataattgagaggaaaagtcctagaaagagaacacttgcaacttttgaaagctgtgtcaaattgtatagaacaacatgatgaaaggcattgatgattagtaaaactgttatagactggtctataagactataactatggttataaataattggtcaaactatttatttggtccatctaattgtctctttcaacttctactccttacatgaataaattgcaagttttagtcattaccgatgcacatataaagttttggtctctattactcaccccagagagcattttttgacagtgtaaaattgttacaaaaatttcttgcggtgataaactgtcacacaaaaactatgcagagaccaaaccttactgttttcttataaaaggactaaaacttaaaatggagacaactatagggatcacgtaaatagtttaacctaaataattttcttttgttttgcttactgtatttcaaaggacaattggtatccattcggattaagctgaattgataacaactctctctttaactatatatcctggaacaaaaagatgaggaaattaccgttggtatgataaattttcctgtgaggaggcaaattgcaggcagagaacagtaagcaatgagaggaagggatgtgaaagggtagacaatggtgtttatataagccattctttgtagccatttgagacggcctccagaaaatccataccagagggggcagtgcctacttaggaaaatttcaattgatccaagggcccatcgaaggacttggtgcaatctatcagacaagttgataggtgcagaccctttgaatgcaggcctcaagggcatgcagtaaattgacttccatcctcgacattgcatcttgaaccccgacaagatatcctcagtgactaaaccataaatccaaccaatctggaaagagaagatgatgttttaattaatcaaaaaagaaattgagttaaaaagtaaagactgtgcatctagaatgagattttaattggtacaagtacattaacaaaaatatcattggaagagagaataggaaacttagaacctgaaggactttgtacaaaaacatttgcattaaaggcaaacaacctcttttccccataaagtcttttcttcatatccacagctaattacatgaatggcctccttgatcagcatcgagggatctgcagattcaggaactcctccattctccattagtgttgattcaatgaaaacagtagacaagccaaaagttttttcaaagctcattttgtgaaataagcattgacctctcatgctcatcataatctgcaagaagaaaagaaaccagaagaatattgcatagaagattctgttatatgcttctctagaactgattgaaaaaagtaactgagcttactgtcaagttccttgagattaaaaatggcggcctcaagttcttccctctttgcatttctttgaaagtctgagacatcgttggtggacttctttgaggggaagcaacagcatgaagatcttggtaagctgggcatagaaggagggctataaccataaagtgcttgtctattgaaaacacatccagtccccacatatactggtccttggatgccatccagtcctttcatgttaacctgaaatgaacaattgaagtccatcaaacagggatgagggttggaaattacagagttgtgtccacaatttttacttcagggttgttaacagttactgcattgcatgcatgcaaatgcagtgtgtatttggtgaaatcattgcatataaggagatgtcgtttttctgtcgactctagataaaatcattgaatcgatgttaacttacatcaaagaaaactgtgttgcaattggcatatcaatcactgcgatcaataccataaaatctctgggggaactgcacataacacacatctctaccaacttctggatccatgagaaaacacattgcttcccgaacggccttgctgttattaacataatgatcacaatcaagattgagaatgaagggagcatttgtgagaactgcagacactctcacctgcataaatccatacaaacatcaagcataataaaatcttaatgaccttatacaaaatattagtgaactatctatacataccagtgcattttcagcaccagctttcttgtgatgttggtaacctggtcttttctctctggaaacataaaccagcctgggaagttcatttccttctatgtcacgggcaccagtgtgtccaagaaaaacctggaaatgggaaacataaattttgcttaaatacaagaacttgtaccaattattgattgctagaactaaactagtcaatcttactaacataaatgttttccattatatgaaaaaggaaacaattttttttcacacagaatgactcagtactttatacagtgttcttttctttatgcctatcattgtcaatactatagttgattacatacagaaataatggatatacctgaatcatgccagggtgatcacgtgagttatttcctggccaaggtgtaccatcttgcatggtccatccttcttctggtgttttctgagccttagctaccatggcattaactcgaactttatactcttcatagtctctctgtgacagaattgaaaggtaaatcaatcatgaagaggttgctctaagatactcaatttgggaaaacaaggtggtgaatactgttggaactattagttaatttagaattggaatatgtccaattgcacaagggtcagaatctgagtagtcaagaggaacaacataatttactacaactgtacaaaaacaatttaaatagaacctgtatgataagtatgaatcagaaacagatgcaaagagatgaaaggatccgagcccaacaatgttgtctccttaagacaatttgttccctccaattgatgccaaaggttaatgaacaattgtctcccaggatagaacggatcacgtctgaagattgatggcacttcaaatcaacagcccaaacgaacaaagacaatgcttgaggaaccacagagttatgtgatatgaaatgcactagtgtctaagcgagactatcagaaaagttaactatcagttttctacttccttcctttctccttccttttttctgactgtctctgtgtctatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccattcctttcgacaaattttcaactaactctctaggaatccctttaattaatggatccgctatgttctctttagacctcacatagtctattgagatgattccattcgagagtagttgtctaacggtatcatgtctacgacgtatatgtctagacatgccgttatacaaaacattcttagccaagcacccccacactttcaagtatttcaaggatgattgctttcatttccatacttcgtatggtatgctttttgtcttcttgtgaggaactctattaataatatagtttgccatcaaaatggcttccctccacaagttctatggtaaaccggacgtgattaacatagcgttcatcatttcttttaatgtccgatttttcctttctgcaatcccatttgattgcggtgcataaggagcagtcctctaatgtataatcccagattctatacagaattcctcgaaggggccatcatattctcccctacgatcgctccttatagccttaattttcttgttaagttgattttcaacttcatttttatattgtctaaaagccacaagtgtttcatccttactattaagtaaataaacataacagtatctactgcaatcatcaataaaagtaataaaatatttcttattactcctagatgatacagatttcatatcacatatatcataaacagaaacactgattaatcacacagatcaaacagaaacactgattaatcacacaaatcaaacagaaacactgattaatcacacagatcaaatagaaacactgattaatcacacagatcaaacataaacattgattaatcacacagattaatcgttcaaagtacagagagtagacannnnnnnnnntaattcacaaagatagaatatactgaacccagattcaaagcaaattgtcttaagattgatggaactattagttaatttagaattggaatatgtccaattgcacaagggtcagaatctgagtagtcaagaggaacaacataatttactacaactgtacaaaaacaatttaaatagaacctgtatgataagtatgaatcagaaacagatgcaaagagatgaaaggatccgagcccaacaatgttgtctccttaagacaatttgttccctccaattgatgccaaaggttaatgaacaattgtctcccaggatagaacggatcacgtctgaagattgatggcacttcaaatcaacagcccaaacgaacaaagacaatgcttgaggaaccacagagttatgtgatatgaaatgcactagtgtctaagcgagactatcagaaaagttaactatcagttttctacttccttccttttttctgactgtctctgtgtctatttatagacaacaaacaaccctggtgaagagttgtcagtaaaccatcgcgactcttggcgatgaaccatcgcgactcttggcaataaaccatcgtaaccgttggttatcggagcggttgggagtagttatttttctaacctttcccaagagcggttataagtagttactattttgaattgttaaccgcctcttattcataactcatagagtttaaacaaaaactccaacaaatactagcaaatcagatacatctaactatcaaaactgttctatcactgaaatcataagtaggaagctttacagacttaccttcattgctctacgctccttcacgaaagaaggttgcaccttgtccttcaggaaatcaatcttctgagagaagtaaaactcaggtgctcttggttcaattgaaaacttcctgcaaaatggcacccacttccttgcaaagtcagcagtctccacaagagattcaaatgtgagcattgcagcaccatcatctgacacataacaggatactttatccactggatagtcaaccgcaaggatagaaagcactgtatttgctgtaatcaatggtggctctttcaaaggatccactgtactgacaaagaaatcaacagctgcaagttcattgggttcaccctctctttcaaacctggcatggtattatagaagtgcgcatcagcatccaaagcaaaggctcagtatcagctcttctaaatattactttattgtatggatttaattttgattaagagtaaaacttccactctccccgaataatatgttaccatatcatttaaagtatttgactcatcaggtaacagttatcaactcgttacagccaaaatcattcgatgatgtgacaacacatgatcatattcatcatgtagaactttttacacgggaagtaattaaggttaacatggaaaaattattttcattagttcatttttataggttgcctttcacaatttctattagggaaagaaatagaaacaaacatttccattctacagtatgatgttttagtgcaaatcatccttaaagcacaaagcaaaacacatccaagtatttcacaactttgtgcatttaccttgcagacagattgtcaataaacgtttgcctattgataggactccatttagggaactgatctagcacccaggaaaatacacaaaccagatctcacagatgatagaagtcaaccaaagaggaaaagcactttcaacagggtttgtaactcgataatggaagaaaagtcccaatattatcaatcgcatgattatcacagttctgtacggtgcaattttggattttgacattggaataactactgaaagtggtgcagcagcagaagcctctgcgggcctgcaaatcatatcaccatgtgaattatagaataaatatattaatttttatgatagattttcaataatgagaaatgtaacaagtcataaatacatgaaatatattcaaattaaatcaattgtctagcaggtgcaaaatcagatggttaataaaaatttgatgaatgatcctcaagcaattaataatatgctcaggtaaaaaaatagatttttaatatgtcaggggcttgagtttgttattgttctctatacagaggaagatttgataaaatatctggtaaaattacaatttcagtaccctgaagtgtaaagacaaaggtttgtgatctcatgtcatcagcttctgacagttgaaatagtaaaaagaatgcctttcattgattcttcgtctcacattagacggatgaaatattgaaatgtttatatttagatttcagcttataactatcagacaacattaccttggaaaatgtatgttttctcacaggatttgtaaattaataactttttgtttttgtctgattccattcatcaaaccaaacatctctaccctatcctcacataaacttatcattagagttatgcacaagtggcatataattctatagcttctcattgttaacctaattaaggaatcaaatttttttgttaaattttaaaaattgctttatgttaaatattacagtttattttccatctccgcaaattgttgtcatttctcattgagcttactgtgtttcttccatctgctgctctggaggaattcaggcctccttttcttccttggatgcagcctttttttcttgttctttttatcctttcccttccagctttccactctatttttccagattgattttccagattcctcatttacttctccagaaaaaaccattttgtaatgatcaatgcttacttctaaagatattgtagtagaaaatattgtctgaagtatcattcacttaccactatcgactgtggacactgtactgacatgtctagcatggagtccaacatcctacaaaattcaaggtgtgattataagtgcaaatgcaaattaacaacgtaagaatattacaaaaatttctgtttttcctcaaaattaaagctatttagtacttgtgcaactaataattcctagtaattatcacctgagagttactgatttcggaaggtgttgtggattgattttcatgaacctttatctcatggaaatcatcatcctcattttcgtgaacctttatctcatggaaatcctcctcctcctcctttcttctctctagaatttacaaaaggaaaaagaaaaagaaaacaaacttatgatgtttcaaaattcattgaacgagaaaataaaccactttttgaaataattttacatacacaatgttacatactttttctttaaaagatttatagataaattaaacaatgttacatacttttgttttcctctttctcacaaattaacactaatactctattactttgtcgaatgattcattaaatgcattagttttaattagcctcccaagatcaccagtctcaaataaccattgcatggagactgaaattgggagcataacaataacgtgagtcacaatccacgtagcaaacagaagcaaattataaattcttagttggaatttagaaataaaatgtagtagacattaaagggttaccttcatagggagtgccacacctcatgcagaccctatggtcctcattaatctcatgctcaaagcaatccttgcaaattgggatattgcattcatgacaagccacaaacacttccccatttgcattaagtcccacttgttccccacaagttttgcagaggggaacactagattgcaccatcttttagttttgcaccacctatcaaagggccaaaatgtcagtatatctctcagtgaccctttgcttctcaatcagtgctcatattggttttatatgaaaaagcataaacccgtatggggggtggagaaagcaattgtgtagcaatgcaatggatttgcatgttggaggtggtggtggtgggttctttttctgaggttggaaagttggtgtcatagtttaagtggcacacaacataagactatctgagtgatgagaagcaaagtctattttttcgttgaagtgtgcaatatatcaatttaatgtgggaagtgtaagggaggcttcagatgacagttgtgttggggtacatcagctgatgaagtgaacaatatgtcaattttggaagtacaaggagtaagtatactatttctaattgattcaatgtttacaaggaaaatattagtgacatactttttaatatcttcttttaaatattgttttcatcaattaaattttattaaaaattctaaattttgtaagttttatgttttgcttaattcaatatttctcttaattttatttttttaataaattttaatcaataaaaaaagaatacattggaaagtgtctcaaaatgaattattctcctactataagggatatctttgacataaaataatttaaattataattctaatcccttaattttttaaattcatgattttggtcccatgatttttagttataatatttggttctttaatttgataaattgatgattttgatcttcctaatagattattaacaaataattttaattaattgagttattaagttaattaaaaattattaaaactttaataaaaatattaatcataatcgtccacaacattgggcttctcagcttttctgcaaactcttcttccacctttaccgttgcatatgactccacatgatggagcacaatattaggattaataatattattaaagcttgttaataattaataattttatttaatttataattaatttaataactctattaatcataattattagttaataatccattagatgaaccaaaattattaatttataaaattaagggatcaaatattataattaaaaattatgagaatcaaaatcatgaatttgaaaaattagggatatcaaaattacaattttctctgtgaaataataaaaactagtttatttttgagcctatgctgcccgatttaattatctctgattttccaattttaaaggaataactttacatcacttggtttgtttgttgccagcaataaatatatttcaattcaatattgctagaacgttaggtcatgccatatatatatacatcgaatacgccatttctcctgcaaatcatgaaaatagaaatgatacgacacattatcctccgaaatattaaatatactaattaatatatttttaatgtgcagtatgattcctaaactaaaaaacgttaattcctatcattctcaataacacgattagatggcatccccatagtttgttatcattttaacactaagatcattataaaattgaagtaaattaaatataattagtgcataaaaactatagatgtaagaatttgtttacttcgacaaatgttcgtttttatttcctattttcatttttaatataaatacattattctattttattttttattaagtaaaaaattatataaaaaaccatgaaaatagtttttttactgttttttttatcaaaacatttaaaattaaaaaattaaagaagatttctataattaagaataaaatcatttttacaaaatcttttacaacacactacattggattcattttcattttggctctgtgtaattcagggtgttataatatcaagtattgataatagtgtatttttaatttgatattaaattattaattcagaatctaaaattgattttgaatatatttttacgtgtttaattttatgttaaagaagaatttattattgattctaaattgaaataactttgaataatttttgcacattagatacaaaattttactcttaacttattttataataaaatactcatacataaaccacatcacttcaaaatcaattttaatcaaaatcaattttatctatccaaacacacttataagagtgagttactttattcagtgttcactaacaattactcgaaaacgatcaacttaaacgtaaaaagaaatacatttgcacgaggactcttagcaagagaagcttcacttctaatttctagcatacattaaacatttacaaataatagctttgacagccaaaaattagaagatagcaagagatatctggaagagcgaggcgagataacatagacgaatggaaaagtgcaagtaaacacacatggcatgaatcacaccatcaccatgtaaatgaataattataggtcatcattgaacagttcctgtaggcaatgaatcagggagagaatcgcaaggcaacctaggcaggtatatctaggctaaaagccttgggccattagcacctttcctgtcaggaacacgatcttcagagcaagtgcaacattacagtttcaaacagtcattttaggttttgtttgctctccaggaatactcattccaagaatcactgtcatctagctttaaactatgttatagtgtagacctttactactttagatgtgtcacacacaacaaggttgtctgtatcagctgaggtggtacacagccaattgacctgccaaataaagagtacaaacgaatgcatcagacatatttggcagaagcagaataattaaccaacatccaaaagttccaattaaattaacttttattacaaaactcacttttcgaggtacttcaatgttcaaatgcaggatattattgttgttgtcgtcgtcacttaacccagcatctgaataacgggaccaattccataccttcaccaacttatcatttcctccagatatcaagaatttccctctttccccaaacaatgaaaatgccctgtgtcacccacgagttaggggacaagtgagtttagtgttacagttgctatattgcagtcacagataatgaattgacttacaggctggaaacagctgcagtgtggccacccaaagtgtaatccaaatgcaacctcttttttccattttgatctgcgtctgtattgctagatgaactaccatcttttgatcttgagtgtgatccttttcgtgaatttgaagagctttttgattttgtagcagccatttctgtttcgatattaatcacatcaattgctccatcaccccttgcaacagcacatattttgtctaatttatctagcatgtcgacttctggaacagctattgcatgaacaaaagcaggattgacacaccggccagcaatgccactactcacatcaaatgtagctgcagcgaagaaagggaaggatcaacagtttagtagttttacttttacatgtttattaaattgagggcgagccctaacatagtgctaaattgtgccttgatgacttgttggtcatgaatttgaatctgaaaacagcctctttacatatgcaaaggtaaggttgcatacaatatctttctctcttactttcgcatagcaaggagcctctgggtaatggggtactttttttttttatcagcaaagataatatatatatatatatatatatatatgagggcgagccctggcacaacggtaaagttgtgtcttggtgacctgttggtcatgggttcgaatccggaaacagcctctttgcatatgcaaggggtaaggctgcgtacaatatccctcccccttacctgcgcatagcgtggagcctccgggcaatggggttacgtggcttttatatatatatatatatatatatatatatatatatatataaatgataaagatgagtacaagtagtactgaaaaaaagaaaaaacaccccagggagccaaccggaactttggcaacctaatacatgatgacaacccgcattaagatgccaaaggtcaacctaaggttaagctcacatgaaggttagaaaaactagacaaaaaactttctagcaaaatccatctctcatctgactagaccaatgatagaaggggatattaaatcctttctccaaattgactaaccaagaccaacaaaaaaataaggcatcctccaacagcttagatccattgaagttttcgttatggatctcaattgtatattactcttatcatttttaagagtatgtatgtttgcataagtaaataaacgaaaatgccaccatgtaaaatatagttgcaagtttcaactgtgaaactataaaaacaaaattagcacaaggatcattaatttacattgcactaagtaccagctgttagttcagttattatctaagctgaggcatgtatgcctcgtgacatgcatacatatatcgaaaacttccaggcttcagtgacaacattttcatgttttggataataactgcttgtgacttgcattctccattgtcaatagtcaccaaccatcattttcatgttttatttcatcggtaaaatatttttaagtggccaaaccttttgtttttatctactgtggaatcatggccaaggatgactatggttgcaaaagctttcgaacataattaaaaacaatcattatcctctaagttctcttttgctgaatgcattcaaaaaaagccgtagagaagtgaggacttaatatcattgcaaatgtcaaattaaaaaaaaaaaaaatcaaagaaggctctaatttagatcattcaagtaatctcatgcaaaacttagcaaaggcaaagtaagaaatttaagaaaaattataccaaaatccactactttgtaggggcgccctttggagaagtcccacaacatgagcatggaatcaagacctccactaatgactggtaaaaaataaaaaataaaatggagtcaactttctatagatatgggtgcaagtttcttgaatactagcatgaaacttagacaaacaaatggagctgttattgtaaaaccttataccacaaggttccaaaatttcatttcaaatagaatcttgtgcttgtacaaattcttttgattgttctatccaactcatatttttgttataactttcctaaatatattttttcatactttaaaaccaccagtagtttacatctattgtgtatgcatgactgttataatgttactattattgggggcacaaattaagttgtttggggtgaaacaatggcacaaaatttatcagaaatggaaatcagaaaattaataacatttagaagggagtccaaatcaaacaaaaagttaatttgccgaagtcaatggttataacacagatatagaaaccctcataagattactactctataaatcagagttgaaacaatctgaactcaagaagaaaatgttgcagtaaccagctatgtcagtttctttcttgatttagcttttttagtaacatttatatatattggaaaagtaaacatatcacccaatatgtgtctgtgcatgagcacatttgcactagctcaatggcttctcgacatatattattcacagtacttcctaggaattccaatttagaaacaaccagttatcataggactaggactagagcatgctcaggtactattgtcaagcagttcagtgtctcatgtgcttaatagagtgagagagttagaatacacagatttttggtctttgaccaaaatatccatacaagcattattatgagactaaagcacctcaggcaatgtcatgagccatgattgagaccctcccaacaatttccttcttcatgattagttagcatgtagagtttgattaaaaaattctgcattcctttccaataagacaatgggtattctaacatacaaggacaactcacatatttactctagacataacagtcatatctttttctcattggaaaccattaattgcactatgatgaggaggagagacagagagattcatatgtgaaaaataagcaagactatatgtaaataccttcccaggttctccaaggaaggaattccacagtgctacatatctacaacactaggttaaggtaaattatcaaaaaatcaaattacttattaatcacaggaaaaaaataataccagaaaaaattgggggaggggggtggaaaataaaatattagtgggttgagataaaacttctgattacataattagcatccatgtagtgaagaagagctaaaaagcaaggatacacttgtatgaccggctcgtagtgttttatacaggcattgctgacgaatgtcaattatctgtaaaagaaattttaattataatgaggaaaatgaaaatgtacgatacttaaccattaacttggcttttcttaaattaaagaaatggtagatttaaaagtgtacactaaacaacgaatagtaaattacattacacaagaaacgacgtcagtttttaaattatcaattacaacacagtatatttccatgttttatggcatgtatcaaatcttttagaataggagataatgacttttatatctctaatgcattacaagtggaaaggatatattcattagagctgataaatgagataatactaaggaaatcagaataagcattgttgtataaatacaaggcataccttcacctcaccattatcatctgctgcagcaagaaatgaggactttgagttgcatacaacctgcaaaaccagacagataattgtattataacagcatttttaaacaaaagaagctcacctaggatagcatcagttgataacttgatattccaacagaatgaagaaatgcaaagcagctataagttcaggaatagttctgtaatctagtttaataatttcaatatcttgtgcaggtgaagaaagccatacactgcaattgttggaaagtcgccttaattgcgatcacccctggcccaacttagttatggcttctttgggctgccttaattgcaaagttgaagggggggtgtttagttccacattgactagagatatggcttaaatagatcttataaggcttgtggggttgagtcaggccctaagccaaaattccaagagcaatcatacttacaattctgttttataccactaaacacaaaacagattccatataaaagtcttgtacaaaaacagttaagatgacaacaaaaatcatacatacgatttctgatctacatctgcatggataatgttaagtacagtcaacaaatttgcttcaatttactttatataacaagaagcagttgggacattcaacaagatctggtaagtgcataacatttatttgaatacaagtcctactatctagcatctaccttgtttatctcttctttgttataattataattctccaatggcttccattgggcggcagccttcagcacacaacataatacacagaggatcagtataatgcaataaattaaggtggagcaagagaataaatcaagaacaacgtatatccatatatcctcaagaagaaaataaatagtgcaataaatgcttaccaatcgcacatcaaaacacttgatttcctttcctgaggagacataaaccatatcttccatccctgattcaaatggcaattatttgtaaaagatgcaagtaaactcatctactggatgtatcgatagaaaatttcattgtagttgggatgtgtttgatttttcaaaaacacttgtcccatgttgatacaaaaaaaggctataacgaacccttccgccatttacatcaaaataacaagtcgaaaaccaatattataataaataaaacagacctgacttgaaacaaagggaggaaactggctccacgctaacatccatcaccagtctcggctcatcagggcatcgcaagtcaaaccagcaaacacgaccatcctgttttgtttcagaatcacaaccaaacagttaaaactataaatttataggagatgaatcctgaaccctagtgattggaaagagataagaagagtatggaaattggagaaggagctgacatcgccggaagtgacgatgagatgagagcgttcacgtgaggcaatgcagcaggttgtgctgtcgtcgtgacccttgagtcttcgatgcttcagcttaagcttcgtcgcatccttctcagccatcgatgatgccgtttcctcgaaacctaaattggttcaggtgtgtgtgtgtgtgtgtgtgagattatataacatgtaatggattaattgattgcacgaaacgcagaccctatttggttgctgcggtgatgattgggaattatggagtcaccgaaccgaacttgctgcggtgaaatgaaatgaaaccgcgcggcaaagcctcactcactcacaccaggtgcccggaattaattctctttgatatgctatttatgtgttcgtcgaatgtcaccactgaacccgactttcgtgacacactatggcccttatttttcaaaaatatttttctcacgccccagagtgttagatcattagattagatgagtctccttaaacatgcttgggagttggaattagatactttgatgttctgttagatttgatttgcttcactttctttcttcttttttcatactatataaaaagtaataaaatagaaaaaaaaatcttaatataatccaagaagacgttaatgacaatgttgaggacttgaggttgttagcaaagacttatttaaaagattataacaaatggttctatccaattacttaaaagattataaacaatcctcgatcagataggaaatgtattattcatatatttccagattaaatattaaattgttttaacaaaatttaaagatcaattatgctttgaaaactttagacatccataatgtaagatataataaatggacttttttatcattagaattatttatttgaattttaaaattaaatttctttttacctgtttcaaattcaaattctctgagattattaaggtcactttgtgagaaatattattcactatgatgtttgatagctcattttagttttatcctcatttatcttttttttctatcagaatcattcaccacatctcctatatccttttccttcctttcattctttatctctattttaactactcaaaattttcttttcataatatatatacttaagagacacacacacacacacacacatatatatatatatatatatatatatatatatatattaaactgataaacataagttagtgccactggatttgagtgacaccgtacaaagagacagcaacactacgttatacttgcggctcttgttctttggtttcttcaacttcttgagcgaacttagtagcgccaatattctgcatcatatctttgcttttgccccacagtagcatgtacaacccgatcatcaccaacatggatcccaccacactataaaattaacaagcacaagcatatattaaactttggtttttaatttacttcttttttccaagaattaatgtgctatagtcctaggtacaagaattaattcaccttccaagatgaagctgctcgtgtaagaaggggatatcaatcatgccggacattatctgaacaagagggctgaatgcagcggtaaagaccggacccctcttctttacgcaccatgacatgcccacatagcacacacttgacccaactatcccctaaaaacatatataatagtatttcactttgttaacatgctttttttttatatatattattggtagaagtcgaaaacaatagtattagaacgtttatcataattcatatatccaactcaattaattgaattagactctttcaacatatattcttaattatattctatttacaaattgtgaacaataatattgtattttttttataaattcttttgcaatttttgttgttgttgagaaatataatttttttctcctagttaaaaaataagtatataataaaaaatattatcttgaaaatataaaatgtatttaatacatcatatattagtataaaagaaataagagaatattagaggatttggaattattcaataataaaatatcatacttttcaaaatcgaccacatgtgtgaacggttcatggtctaactaaattacctaatgaaaaaaataaagaaattaaaacggtgaaaacctgagaaagaagactagtaaaaatcaaccaataatcaatttacaacatattagtaaaaaaaatctgaatacgtacaacatggttttgtttttcttataaaaaaaaatcaacctaattatttttataagccaaaataatttgaaagagtgtacttactgaataaagaacggtgattatttgtatcttatccttgagaacccacgaggacaagttgctgctgccagtggagaaaccaagaatagctgcttgcatggctccaaagaaggtcatgatggctgtgctagaatactggcaaggatatctcttccctatctttgactgtaaaataaaccaaaaagaccaaaaaagggttcccataatcaaagctattacaccaatagtccatttctgtgttgttctagtagtagaagaagcttggtccattgcagatctcatggctactgcagattgatagtgagagccatcaaacaagggctttcctttgtaaagtgtcaacaacaatgcccctcctatgcacacaaatgtaccaagaatcttcgctttcccacctttgcatttaatgttcacagtttctaatctgtagtggaatcaaaagaaaaagggaaaggatatggtgcatttatatatattctccatttgaatgatgatagtcgctataagaataagaatatgaataaaataagttttgtgtaaatatatattcttttcatacccaaatggtaatgccaaaatgaatgtgatcaccgggaccatattaacaaaggcacaagcaaaggtagctgaggtgtattggatccccagaaggaagaagtattgtgttacggatgccctacaaagaaattaattattcaatattacgtgttttttctactatcatgcatgttaaccatgcataaagaactatatcaggaattggaaacacataaagaaagatcgttatttcatgactaacccaataatggcactgaagaaaaggtagcataaaaattgaaatgtgagccgtggtcttccatttctgcaagaaaatacagttattaagatctttcaaagtttccttctggcataaattaatgagcccatttgagcactcatcctggatagcaatatatgattattagcttaacatatatccttgattctaaagagaattacgttcaagtgggtgatttcatagtcattcattattgcaacttggttatctgcatgctaacaataatataaaaaaataatccaaaaggtaaaatgccatacatgaaggagaaataggctatagtttttaatatcacgttaaatttcatcttaaaatcatcaattaagtaatatatatatatatatatatatatatatataaagatcaccaaaataattgagatagacaatgtagaattttttttcaacaatgtctaaaagagattatagtctctcataattggttggaaatactcttgattcacacaaaatataaagaaaggaattgagggtgcctatatacctttccttaaagtagccgatggggaccaaaaatatagtagcaactgacagacgatatgtgataaaaaccaaatggttcattcctttttgaaggactttcttaagcagaatgttcaccatggttaaagaaaaatctatcgatatcattactaggaaaggtttccattcatcaaaattcttcatttcagcaatgcagttttgtttctgggctgagtggcgcctccctctatctttctatttttcagaaaatgttcaaatgcttgcaatacaacagaaggctacctgtggctttatatatattattccagaataagtggtaagaaagcaacattactgttccaaatcagacactttataaacaactatcccttttgatggtagtttaacgtttgtgtagactatgctcttccacatgtgatctttggactgatatctgatcctgttctacagaaggagatcactatttgggaatcgtttaaaaagattttaggttggttcatgaatcatggtcctgatgtaaacattattggttaattaatttaggccactggtttcatattaacaattcatttagacccgaaacaggtaatgttcttcatgttttgttcccgttcttgtaccctttggcatttgaactttttttcaatgagtgacaagcatcttttaaatggaactgtggcagaagcatggcatctaatgctttttatctatcttccacatcaaaaacattgaaaacttgaataaaatgtcacatctcgtagctatttagtcacttcaaaatcttggtgaaaaagaagcacgcaaagaagagatcacagtgacgcaaaccaccagaaactttaatttgcaaaagaggtagatcagcatatgccctggaacttggagttcgcatacattcggattcaaatgtcatgttggtggtgcgaatcatgggtggctttcagtacttgattttaatatgaaaagccattattagataactttaactccaattacaacgttcaaattcttctctttacaaaaaataattaggattcaattttgatacctcaaaactttttatattagagttaaatggaaaatcaatttaaatctctagtgcattgcaaattatggaactgatcgaatctttgactaattggaagtccccacattcatttttagaagaggggggaaacagatattgaaatgttgttagaagtgtgggataatcaatttgcccttatttattaatgttgcaagaagttacatctaccactattaaatgaaggattttgtgaagagaagaaaaactatcctaacccaaagaacaaatcatgtatccaagaaaaaaagagttaaaatatatctatcacctcaaataattattcaaattttgtgtttattttctaataaattatttttttgtttttgattcccataaaataaaaaattcgtttcttgctcttgacattttttaatctaccataaatagtaaattttatatttattttttgataaaaaaattatttattattagtatctttgaaaaatattaataacaaattaatgaaaaatttatcaaaaatcaaatacaaaatttgttaatttattatgagttaaaaaaagtatcaagtataaaaaataattagttttattaaaactctatgaggaaatatttttataaaaataattaacataaaattcaaatacttattaaagttcacaaatatattttttaaaaaaaatatgtaatttcaaaagatattaaagagtttccctcctccatgcttcttaggcttcaacatccaatctaactacgtacatacattacctctggccccttcaacgagaccacgtattcaatgcccactccatgctcgtcacctccttccactacaatcgcaaccatgccttcatcattgtttatagccatgatgactcttgcaagatttcttcactaggagttctgatggcatccctcggttgcggttgatcttaacatgttaccacctaacaataatgacaacctttcgacaatgaagggtttaatatttgttatcagtttagaaagttttacactgtctattaataagaaattattattaatatgatttttaagattatatttaaagttaacatacttattataaatgaatgtgatttgtgattgaatgttaatataaatgaaagactggaatctaataaagtcatgtaattacaaatacaataatttatagccttcaaaatagtaatagtagattttaaaaaactattaaaaagaaaaatatgtgatactcaaatagtttgtcttcttttatagtgactcactggactttaaaaagaataaaacatttaacgtacatgtgctttcctttgaaggtaaatgatgggatgcaacttggattctcatcacatatctagaatccaacatgcaaaatatgttgtccattagccgaagattatgtggccactgtccttcaaaatgcccacccttcaactatttccgatttcctaccagatcttatcgtatctcaccaatgccagtgaatgaatgaagcttgatccgttaaataactttgaggatttaaattgcatgtgatcattttcaagctaggaggttctcatgagctaaatgacttgtcggacatgaaatttgcgtaaaactaggaatttctgctttggaacatctattaaagcagacatctaggcatctcagtactgaaattccttatttagaccatatcaaatgcaggacatatcatctatatctatcttactatttgagaatgtttgcattttactatatttactctgttcttcattgattttttccacgtttttttggttaatattgtcttgtgctataaatatattaaatagggtcgtattttatttgtttatagatatctttgtaatgtatacataagttttttagtcatcataatattaatattaacgtagagtagtgactaattttactaataattaagaaaaattttattacttatttttagttatatctaaatgtatgctgaaaatagaccgtataacaataggttttaaaaatatatttttatttgtattaataattaaatgttaattaacatgtgcaaattatgttatatattcttttgttcgaacttcgaatgattttttttattgtccctttgtttgttattcattttcgtcactttgttttattaacttttttatggaacatttatttattaattaaaagcattactttagtctttagagtctagatagagatttactttagatgtgatgcgctcaaaaaagattatagcgataagttatagatataaccttattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaattaacagtatatgtacctctaaaatatgtgaaaattagactatttgattacattctaaatgatttcgaatttttgtgaaatttgagacatgtgatttacatgatataagcttttaatctaacggtggattttataaaatacttatccaataaaaaattattaaatagtataaaactatcaattcttacaccgatgtaaaaggatctcatctcatatatatatatatatatatcataggaagggaataaactcaacattttacttccctcgttaaagaaaattgatgaaataattaagtacaccaggactgtctactataaaatcaatttaaaagaacaattggtggactaatagtattaagaattagactaattaaagatttaaagatataagattagttgaatgtttaagagagaagaaaaaaggaaatagatggtgggtttgatctcctctgttaacaaagattaatattctagcaaactaatatttgctgataaaagaaactaattaaaatttatttgattgactcgtttacaccactcaaacaaggtcagaggaaacttagagcagaggatcccaatagagccaaactcaaagcacgcagcattgttgctcaactgcattgcatgtccaccacattgctgggccacttctgatgctagttgatggcatgatctgagtatgtcatatcaataatggactgagtgaccccagaaagtggccatacatgtagaagaaatggctgcacctgtaggggcaaacaagctaatttcatgaacctgatcacaaatctgtgtcgtaggccaggaccatatcatatgcgattatttcattggaccaatttacaattgaagttggtgggagttagcaatgttgttgtgagctcactccaacaaatagtaattattaatgttattgcatgtgagggaaacttcaaattcaatttcatgaaatctctttactcatcaaatagttcggccttgagtgcatcaagaggcaagatgtccatatgcaccagcacctggaccatcttcacacacatcttcaaatgaaaagggcttcatgatacgtggcatgtgattggaaccaccaccacacatgaaaatgttgtggcaattcaaaattgggaccatcattgactgcaacaacgttttcccaatctgcaactcttcccctgctaaatcttttgagcatgccaaaagtgcaatacatacacatcaacacaggatatataagtcttcacaaatttacaattttaacaatatttttttttacaactagtcaattttatcaattcaaatgttaacttatgtgactctatgatgaattgatgatgctcatacgtaataaatttttaaataatttttatatttgtaaatgcataatttaacattaaaaaaattctaatgacttaaataatattattaagccttgaaacagagtaacaaactgaattttaaatagtaacaaatgtccaagtgaaacttgattggtttctaagcatgagtaagaggaaaggctcgattaaaagtgaataaccagatttttttggcagaaattagtcaataatatcaatgacatagttataagaaaagttaaatatgaaatatgctttgaattaaatgaaattttgttaaaattataaaacatacatttagtagtgttgacgaatcaagttcatatacgtttgtgcaaatacaaccaatttacaaaatgaaaaattggcattattacgtcatgtaataatttaatttaaaacatattgtatcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagaatttatttttacattaagatgtcagattcttaaatatcaactttaattactatgaaattttatttatcaaatatgaaatgtttatgctttgaaatttactcttttcaatttttttaaattcttttttctccctaaatttaaaaataattaattacttaatttaatttccactactgaaattaatgaaccagtgaaaaaaataaaaacagcaaaaatattttcagaaaaatataattgactttctctactaatttcaatttttttaatagttttaaaaaatatctacacaatacttgagttacttattaacataaattataggnnnnnnnnnntttatgacatgttatttaataaaatcatccaacacctaaatcaattatatttttaagattagaactcaagattatttatcaatatagataatttcgtatcaattggatttatgtgcttgatgatgcaaattatacatatcaattccttaaaaaaggtgataggcacatgcataaaggatcaaatttggtaaggataaatagtcattttcatttctggatgtgtagaacgttgataaatttgtttctaaaatatgaaaattcaaattttagtcctcaaaagtgaaaaaaaaaatgtgaaaaattcattcactcgttaacttctgtatgctactgttaataaaagaacttacgtgacacatagggacaaaaatgattgttaacatgattgcttggaaataataaacataatattgattaataagcataatctgtctgctactctaaaatttctaatgtaacaatatcttatccacaatataatacttaaacaaaaatgcatagtcattaagttaatccttacaaaaaatgagacttaacttgattttgtcattatctaatactatcacaatagaaatttcaaagcaacacacaaaactctatcattcatacaaaattcagagcttggagggcttatgtaccgtacagtccgaaaaactcgacacgtactcggctcgtggggcccccacatgctcatctcgtggcagtctcaactgtcacctatgaactcgaccgtgttgcatagaggagcaactcaccaacgtggctccgaacatcgcataactatctcgacaacaaagatatatatattcatccagagggaaaatcctgaggtacattttcattgatctcacacataaaaaccttagagcaccattgacttgttcatcggagttccttttacatgtacctacatttgtagttatatgactgacttgatggtaaagagagaaaagaggaggagagatcatgaattcaaatacttcactaacaaaaaattaataattaatattgactaataaaataaaaaaattcaaatcatatttttagaacatcataatattgatgtaaaatatttatcggctagtttcaataatgattaattttagttgaaaaatttaacttatcatctttaatgagatatctctttctaattacattttttttcatttccaatattccaaactttataccttaaaaaaagagaatttttaccactggatccaagacaatagaaatcatcataccacctcacaactgagaaaagcaacatattgaagtcaaaccgggttaagagatcaacttgcttatattatcattaaaaaactaagcaaaggccaaaatttcctcattaattagagacacttgcacctcttctaataatctgcagaaagcgtacaaatggcactaaggaaaaacaaaacattgggaaagaaagattgataaacacttatttgaactgaagttttaaccatgtttaaaaattcatcaagatcttcagctcttttctttagtactcctccactacagaagttgggaactttgtttgccatgttctttgactgtatccagaaggaaccttggcttgatcgatcagtctccttttcaatgtttcctacacattaagcaacgtaccgagtcaaccaaataccttacaatggtcaatgagcaatcaacaacaacctggaactgatcctcacatcaaaccacagcaaccaatactgctgcagcgttgacacgaattccgctctgcataaagcaattaacaattaaagaacaaacattatttcactgtgcaacagcaattacagctagaatacaacacttttaaaagcctcaactacagttcccgcttcaacggctttgctgtacgtcgtttcatcaccgccgctagcgacaatccccgctcctcctgttcatgtggtttcgcttccaccgccaacagcgacagccacctcatacctatcgtaacttgaaggcgttgttgttccaatccaaaaaagtttatctttccttgcttacaaggagatgtagtagctatggcacgtcctagagagtgatgattacttggagcggaagccgaaaaaaagtatcggcagcaatgaaactcctgcttctccagattgagattgccattctcaaactaacctaaatagaaatatatcataagggaagaatgaatgaataagttagtgttgtttacacatataaatgctacgaacaaggccttcccaaaaaaaaagttagattattttggctgttgtggttaagtaatgttcaccaaattatttcaagctaattttttttatcagttaaaaaacttatttgaacatatatcttttagtgtttttaaatattacttgaagtaaagtttttagtatcttttagtttttaattttttatatttttttcaatttttatcttttatatttatctaacttcctagatattttatttaaataaatcatgattttatgattgatctatcattttagacttttaagttattttaaaagttaattttattaaacacttataattaaataaactatttttttttttaattttcaaccattactaacttccaactttctaactttcagttagttttataagtaaccttgtatttacattttacactttatctgtctactaaataaattctcttttcatgtaatttttatttttaccttttttatttcttttaattttaaaaaataatcctaaaattattgaaatgtaatcaaaaatatttttaaatatatctagaaataatattcctaattatccttaaaatatgattcctaagaatatcatatcattctatgaaacaaatgtccttacttccacttttttttttcannnnnnnnnactttattaaaaacatgtttttagtccttcctcacatatgatgttgactatgtttaacaagcacaaaagtttttttatattaaaagagaatcaaaaaacaaagaaacttcactctttctttgttgcttatgcacactgattctatgtgaactctaaagggggctcatctcgatccgaaaactaatttcagtaaataaacaaaatcataagaagacacaagaatagatgtgtaacatcacgaactattgaagaatgaagatggaaaccaagacagagatgaaactattgaaagttaggttcaatgtgtttgaaaaaacatttttataacattttaaaaaaaaaaaaatttccacatcattttaataaaaaaatttaaaaaagaaaaaaaaaacattgtttgtcacattaaacacaagttgatgccatagtaaagatttggtaagaaatgactaaaaatgttcaccaaattattgtcactctcattttcactctctctctttctccaatttctctctcttccatcttcttctcaatggtcatgttgccacgtatttttcatgtattttttattaatatttttaaaaaattttatatacacaaacagtaataggagaggcctcccaagccttctttgtcagcacttggttggcttctcaaagaatgtggttccaattaagtgatatcacctccattgcaatgcacttcataaaattattatccacctgtatagtttctctttctcaatcagtaatgcatttaatagtatattgtttaaagattaaatgtagtaagtgtgattcaaattttcaagattaacgcatatcactactatctgtctgcatatttttcttttaatgcgtttgagcatataagtattatgtaatttaggttcactcatagaataaagtctcagatgttcccttgacctaaggtagtgttgccccatgtgagcctcacttaagcattgtgttgataagtggatcaggtcttggcataattatctcatcacattggttattagtatataaaaaagatgtttttcatgtttatattctacattagttctctagaaattgataaaatatgagacaatgatatttttgaattattgagatgaacatttttgataaattaataaagaattaatttaaaaattactttctacatcgattaaaagagaaatcaatctagattgactttcattttacataatgtggttagtttattctcctattattattattattattattattattattattattattattattattatatgttactgtattctctatttcacattttgttgttagtttgttctttcatgctctgttacatagtactttcattgtcatcataatctgttcaaatgctctttgtgattgttgtgttagacctctatatgtgttctgttatgtaatttagtgtgtgttttcaattatgtgtgttctaaacatacttcacactgtcttgattcttttgctcaggttcacattcaccattaacatgatgtcttccacaaaaatcatacttcaattcatttacctcttgaattgccatatatattatctatctataaaagcttcaactatttggagataatctccaactgctatgaaagtatcatgttttgagctaagataacacttacataaattttgtgaaatcataatatatattcggagttacaaatttggtttaataaaaagggataaacgaggagaagagattgttgattcaaatttctactaataaaaaattaataattaacattgctctataaagaaaaacattcaaatgttattcctagacatgcgagatggattaccaattaatcaaataatatttttggattatcaggacattaatgtaaagttaaataaaataatctaacttcttaaagttatgagtatgttttaattttaataatttataatgagatataataatcaatatttatttttttactctcccgcaaaaaaattgtcttaccagatacatttgctgtatattagtaccttcgttaagtctaaaccatttttgttagtctctcatgtaggattaaacgattaataacatatttaattgccaaggactagtaagagtacgtagacaacagagccggtttcttatcatccagtgtgtgaagctacagcttttacttttaaaaacacagctgtgaatcactctggctcgagtccagcaagatttggttaaaaaatgaaaagagccgttaagaaaaaaaaaaaaaaaaaaaaaacctnnnnnnnnnnnnnnnnnnnnnnnnnnnnnnnnnnnnngaaacaggaacagcactaatagtattaatgacacagctgaaattcatgcatctcacagaagaaaacatttactactacagatgaggcaccaccacagatacggaacagagagaaatacattaattatgtaaccgttatctgttatccctcatagactctcaaacccacccaggaaccaaccgttatcaccgaggccaagtgagaatttttcacaatgcaaatggtgaacaagttaaactagatagctagctaaagctttcaccttacaaagtttttatctgacagtgcaggcaactgcataagcccatgacttgagatgttgtttcattgccacatcattatcaaacggaggcatcttaatttgccgctgaatgttaagcatctgaatctgatattcccatgactccacatcaaacacatcaaaatcaaacctcaaatcaacccctccatgaaccacattggttcatatagccccaatttgtgccacttccttctttttctcgtctctctcttctttgtttccctacttggtaccatggccttcacttcttcaaatttgtgacaccttggactcaaattctccacattctgagattcatgttgcagtggggtaatgggtttatgcaaatctctcttgggacactctttggcatggattaaaggtgcagattgatcaaccaaagaggcttcaggctcatctctgcaggtcaagatgttggtgtggaaccagagagagtctaggctttgtgcaacccgtgacccatccatgaatgattctatgaccagaaatgtgaacagtgaacaggaccaagaccatgtaacatgtgaactagtttatacaacaaacgaggaagcttgtgtagtaaatgcgggaactttatattcttttgcagagtttcaatttggacgtacgctattcgaaaatgccaaaagcatgagaagggcaaaacaaaactctcgctgtgtgtttcttcggagtaccaaaatgccctcgagtctgagctgaatttgggtataattcacggggacagtttagtctcattaggaaaccagcggtaacacagtgtgcaccggggcgttactttaacatgttcaatgaaccattgtaacagcatctgcactttccatatcaaaacagataattatcgaaattgagcttagcccaattaaatatgaatatacgatgcctgtgtgcttctgctgtgtttcaagacctaaatcttccattttttccggtaaattctttaaaagaggtgcaacacaagttcccaatcacgcattgaatacattagtgttgatataaacgcacctcatgtaactcaactttagtattatgtttgtattactctatatattttattctagttattatgatatcaaggttttagtcaattggcttacaggttcgggagagtgaatatgttattgagtcattgttgtacagtgattattcccttcgtatcatattatattttgtttgagtttttttttttttaattattgtttgagtattttagtttgtcttaaactagtattttaactatatacagagaataaatacttctttatataattaaaattcatgatattttatttaagatttacaataaataatttagatagggatatgaagttattttatttattaattatttttcaaaaaaatattgaaatttaatttaaaagtaaaaataaaagatggtagattgaaagtaataagcaatattaagaagataaaatatacaaataaagataaaataaagatactagaaaaacaaatatgcaacaatttgctcataattgatgtatgaactcttcccaattgtcaatatggcttcataagctagcgtaacatggaagtggttgagatggaaaagggctgaatggagattgtgaggtgaattgacctccctcaaatgagtatttatgatagtatctgcttgtgtcatttgatgtttggtgtttactatattaaggtgggaattagatttactagacttccacatacaatgccaatgatgtattttgagataagactgctaattttgattgaacttagcaaaagtgttgattgaagtacacttcaaatggattgaggtcactaaatgatagtataaccctttgccaagactataaacaccattaggggatgaatacttacaaaatacaattcagcatctaacttaacaccgatttcactagagtgataatatgtaataaaaaaatttcatcacaatgatattgactgtatttgtaagggtttgagataagataaattttctaacacatgactcaacacttaaactgagtcatttagtttaatctaaaatagtttagcgttatcatttaattagaaatttatattgattgattaataagttgttagttcgagtgatataaaatttatcttccttaattaatgctttagttttgaatcttatagatgaaaaaatattaaatatggttgaaaatagatgattaattagattttttcagcatacattaatcatcatcaaaattagttgatactcaatactaatgttatggtgattgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaactattttgaaagtaagaaaattaagaaagattttttttttttttgctgactagcggattattttgacccatccctccaaatttgatattctactagaaaaatgaatgtttaaatttaattttggttctcctattttatttaatttgcaaatttaatccttttatttaaaaataaacatatttggttcccataattaaaaaaaaatacaatttaagtctcctatttcaaaataaagacatttgatctcctatattttaaaaattacaattttgatcaaattcttgattttgattacatttttattttattttattccaattaaactttagacataacatatacaaggcnnnnnnnnnnaattaagtacaattttaagaaataaaaggatgacaaaattgaagattatactaaaactacggattctttaaaatataagaataaaaattataaattttctaaaatataagatgaaaaatctctattttgaaatagtggaataaaaattgtgaatttaaaaaagaataagaagataaaatatctttattttaaaataaaaggtaaaattaataaattaaacaaaattggaggtcaaaattatatttaaaaaaataaaaaaatagatacgtgaattgtcctcattttaaagtggtttttaattaatagtaaaagtattacaaatcttgtcacataaattttaaatattaaaaaaaatgatcattagtttaaattttttaaaatatttttaatagtaataaataaatcactgaattagtgatttattttattcgcctcctctgaaactgggacctgagctatacaaatgaatctgcttgtgtgccgacttatctctttttgccacacttccctccatcctcttctcatctccttcactctctgtaagactgtaagtcctctctcgctccttttttttttttttgctaccgttattttcttttaatacaaacttggctacccaacttcattttcattttgtttccatctctatctctgtttaatcacgcgttgcattattctaattaaatattggctttcactgggaatatgctgtttcctttattcattagcatttttcatactgaattgttttcgccttcctttcagaatccagtgcctgttgtcaatgtcaactgcttcacactgtctgaccatactgcatacttttatagtcatagctgctgatttagtcacatttttcaattcataattgccatagaaagaaaaaaattatattgctttttgtaccataactagaattccaaattaaattttgatgctttaggtctacccatcatcattggaaccttaaaaatgtcacttgtaatcccctcatcctgtgcagcccccttgcatttttctcaacgggagattagcaatttgagttcccaccaaaaatttgcctcttattattccatcaccccttttcaacataaagtgcctttgagttgtaaaacgaggcatataaggactcacttgagaaatgaactatatgttcttcataagtatgcagttaggtctaaggggcatgattttgagtcaattaatgatgaatccttgggttgggatgatgatgaagaagtcgaagatatgggatctccttgggaaggtgcagttatatacaaaagaaatgcaacaattttacatctggagtactgcactaccttggagaggttaggtctagcaaagctttcaagtgatgtctcaaaaactagggctgctgcaatgggattacgtgttacgaaagccgtgaaggactttccaaatggcactcctgttcagatatctatagatgtgaccaggaagaagaaaaaattgaggcttgatgggatcataaaaactgtcatcactcttctttgcaataggtattgccttcaattcatgaatttacattgcctacttttaagtgctttttctaaatttctttatcatctcttagttttgcatttttctttctcgattttactctgctttatatttattttgatatggtttaatacttcaggcctcaaaagttaaaaactaaaatctctatggtggaatatattttgcattactgtaattattgtctagatgctcatttatgcattattttcaaatttgttttgcatgtgactccatctaatataccatattaatgataataagctaggagtagataactccttgatgcctgatactagtcttaggataggatggtgttggtttcctctactctcccttcccttctctttagatttgttaagcccaaaactacataggaactttgattaacaggaatgggtatattgcgttgtgtctcaagatagctcactaggtttttaatgatgagaaaaatatttattcatgaattctagctggaagagcctgcttagttataagcagcaatgggaacagaaccctgtctactagcaggaaacacgtttcagaatatgcaattttcttaattgatatctactagttatgcttgatttaagacaagtttgatgataacagcataaactttatgtgagcagtgacattgaatggtaggtgttcctctataaaaataaaacattagcatagactacactgtttctttctatccacattaatagcttctcttaaagtaagtaacaaattgctattacaatggtggcatgaacatctttcattttttattcaatatgaagtttaacctctaagaatttaaaagtgtgaaattgcttgcattattacacaagattatcaacttgtaatttggttattattctctctggttgcttgtgtaccatagtatttattatgtaccatccaatttccatgattgctgaactgttgaaggcgtgagggtttatatgatatgagaacatatttttttcttccaatttcgattgcagtgccaacattctgatcggaactagatcagaaatggaagaaaagcagaattcctttgttgattcagtgtatctctacaaagaatgcctttgatatttaagagacaggtctcttcctagtctcaattgtatttcaccaaatgacaaactcttctttgcaacaccttttcctatttataggagctactagtttgctaacataatcccatcctcaatgggcttaatcagttgcaggcccattccccttctttctaacattacccctttgtatttctttgactaactaaccctactaactaattatgcgaacatagctaaataaatgacctgtaagctctattccaccagggtctcacagcataaaacatgatacaatttacaattcaccaaaataatgaaattatacccaataactctccttttcttttgacattactttgacctcccttaatctaatataactacataagaaatgagggatggtctgtacactgtgttaacaggaaggatgtattgtgttgtttgttatataagttaaggaaggtttgtgtagtgtaaaaaaagggagggttatcaagtgaaactttgttaaatttcagggagtgtgagtgtaatttgcccctattttttttgtgtggactgaggtggaatgaaggtgcatagaccttacagaggcagatgcggaagtttcattgaactaatagatttaaatcactttgataaaaattgatgttacacaatttgctggtgtggatatcagtcatcaactcactcttcaacaaaatgctctgttctaaattgttcttgctcatttctgcattattttaattcggatggccatacattgtacatcatctgcaaactttttagatataattagcaaaagcatggaagctttaaatcctgaaaatgattggtctccaacttccttatcacttccaccttcctaggattaatacaaatgatttcacagaaaattacactccactgaaatataactgcacttggcttagaactccacagaaaattacacttccaccttcctgtgattgaacttggcttagaactttttattctaccttctattctctttattgaactttactattatttacaatgaagttctggcacatctgcctccaggatctggtgtaactagatttatatgcttagtcctgcaccccaaaagtagtaaacttataatagttgttgatattccttgcacttttggttgacctgtgtcacctaattatgaactgatctactatgatcggtttgttttttgaacaacaattgcttgttgcataattgtattacgttattcatctcaatttattaaatttcacaccaatgctccattaggatttaggctttataacatggaagattcttggggtagttgaaataacatgatatcttgtaagtttacaatagctgctaacaggttaattcccttcaggtatctggatgctaagcatcgcaagtaccattgtatacttattcacctgactgagttatcgaatatcttcctggataattgttttaatgtttcatctttttatgaggtagccaatagtgcaaatatagcagtttcagtcaagtacttatattgaagaaaccaaaaggcaggcctgaaaagaatttattatttgttgactccatgtgaaaaaaaaaaaattataggaagtatgcccctgccatattctataatttattatttccacaacatagaataacttgtttcaatgtgattttcttttgaaggtgttgtgccccatctgctgagagcatattctccgagttctcacttttactcactgacaaacccattgaagaaccagagactattgatatgggtgttatttttggggaagacaaacttacaacctctggaaacagtggtgaggatgactatgacgatgatgcacttgttgacatggatgatcaactatattttcctccagaacagagacaaattgacatttcaaagaacataagggacagggtgcatcttgagattaccatgaattcagtatgtggtcctgggtgcaaaggcatgtgcctgaaatgtggtcaaaactttaacactggcaattgcaattgtagcaaggaggaagtacaagagaaaagctttggcccgcttggaaatttgaaagagaagatgcagttgtaacaattatgaagttcatgtgtaggatttgctcagagtgctgtatcgttatgtgtagaagtcctgaccttaatgggtttttgatgttctgacattgtcaagcgcctaccaagagctcttggatccgtgatcatacatggcatggatgatggatgttattgaatatagatccatggagcattgttctagttctagctacgccttaaagtatgccgttggaatgcttctttccaaatgtattagatccatgatcatacattagtactatttaaattaatattacacacactttattagtctaatatttatataaatattagatactattatttattaaatataatatacaattgatattacacacacacactttattaataaagtattcatataaatattaaatattattatttaatatatttatgaaatataatacccccgtagttaaaaaaaaaaaagaaaaaaagaaaaataataccctcttcgttccataacaaatgtagtcttagatttattttattttatttttatacagactcagaggaactaataaataaaagaaagagtaagtgaaactaaccataataagtgttgtccgaatatcatatcttaagatcatatccttattaaatgatattaccaatgttttatttatggtatatgttaattgtataaattatatatagcatcaatatgtctttattaaatttgtggatataatatcattaatattatgtattcacaaagatttgattttataataatttataaaaaattaaatttgtatttttttttctaaacgggatatcattcgggtcttgaaaatattggaaacataatatagagttaattacattgtctcatggcggtttcgagtaatgacacccgctatccgtcctctcctttttacaacgttacttttagccgcctaggatctaactgcgttttggtttcgttagttgtttaaaaaaaaataacaaataagaagttggaaatatagtattccttaattgcccctgcattaagcgagtactgttcattgtttgggaagggtttcttacgttttagaatctgaagttagggtgacggcaactaacggttgcttgggggaaaatcgcgagagagtgactttgtttagggatttggttgcttggacgaagatctcacatgaagtaggttagcggcgcaaaggttccagcgttcgatttgaagggtagcgtgaaaaccaacgaaggtgaagccaagaagcacttcgtggtaacatgaatccagatctgacgccgcaccccactcaattgaagtttgtctcaacttcaatggcataaaatcagcgcccaacacgcccaagatctgtttttttttaaaaaaaaaaaattaaattcttcaatgggttcttaaatttgaagtcctcccaattttaatattcttgaatagttttgttactgggttgttgctgtacctactcggttgtcctcttttattggtttatctatggaatatgaggtatatataaaatcatctagtacatggagaaactactgtcacgttagtttcgtttgttcttgtaatttgactgaagaaatttacattaagcattctttttttatctctttcaagctttgaagaatttgtatggtattgaacttgtcattgagcttagattgggaagcgaatgttggcggaaattttttgttcatgttcttcattgcctatcttgatttgtttttgaaatttattatctaaatttttcgttaatagtcattaagtgaactgcaaatccaatggtttaagaaagcacagagccatttttggatggtggctttcatttcatgtgctagtcacgtttgggcatctattaacggagtcaagaacattttggggtgaggggtagttgctgttacgagaggcaacaaatttttaggaggttttatgttgggtaaaaaaagaggagtgccaaaactgtaattacatggaacctcaggcctatgtaattacctccatattataatgcattaaatattatcattaatatttttttacagataattaatattaagtgttacgattcaattatatattattttctaaagaatcaaatttgtatttttttttatatttatttacatgtttataatgatgatatcttttaattttggttggaaatataagacttaaatatctttttgttttttataatttaatatttttttattttcattgttataaattatgtttttttttgtttttatcacactttaaataatattttttattatttaaagtgttatttaaagtgttttaaaaattaaaaaataaacataagtgatcaaaaattaaaaaaaaaaattacaagagaaaaatttaaaaaaaaaggttaaattatcaaggtcaaaaagtatttaaacccgaaatataattatgtaatgtgaagaacactacacaatgtgttcttgactaaaactctccacaaaatgaattattcagtactatattccttattgctcatcccttgcttgatccccatttgccggtcttcctcgccaacaaattctagagcttatggccatcatgatcatgggctgcttggtgatggtcctgacctgattggccaaatttgcaatgaaatcaaacaagaccagatgatcaactgcacaaacattctcagagcagacccaagaatcctgtttgaaaaaaaaatcgttgaattttcaaaggctgtccttggacaaagcaatagaagggcagaactttcttaagggattggtgaagacaaaaaaaatattctccagccattgatgaatgtgcaaacattctttatggtggggtggttggatagttcagaagtgccctgggtgagttgaaagatgaacctatatatgctaactatgatgccaaaattgctggtgatgattctgatacgtgtgagattgtactggcttctgcacatattttttaccctgcaatttctgctcttaaccgccaaatattgttgcttagctatattgtagtcctagccacaaataagttcactgattatggcagtttatggggataacatgcatgcatgatgtcaacccaaggtatagtagaggtttctatttgttttagcatctcttttgtagaagggggagattaattgataagatcaaatagaagtttactattacttgtttttggagtgttgtctgttaagatgaaactctatgatttaacagagtaaagaagaagaaaaactacctaccttttttatttttgcttaatcagaatgagtgtacaatcttatttatatggctgatacaaaattaattttacaacaataaaatagaaaagccaactaatcataattgacagctgtttattctaacattgaccatagtcttttcctgcctatgaatgacattattcttacattgaattgtctattatgtgacatttgtttgttttgtgagggccggaaattgtctacttgctcgtcttctttaacttgttcaaggtggttcaagacaagaatttcaaacattgttgaatgtttttcatatgcggtgagacttcatcatcaagatctttgttactgacaaaattagagtctgaaacatccatgaattctgtaggttgaggcattgtttacccttcttcaaaaaaaggcttctttccaatggagatatttagcattgtttgtcaaaatatctattgtcaggctctttctaagctagtcccgatctgcaaaatcagaaaaagttgtagtgatttgcatatttaattattgtcatcctttttttattaaactttttttgcattttaatttcaaaacatatttaaaggagtttaatattgttttctgtaattttaatttaaaaatgaaggcttaaagaaactttaacttaaataggtaactgacaaaggtgagtacgcggtcttttaaaagacaaccaaattatgcttatgttctaccccatgtacttggagagatttatcttcagctttcctttatcgctcggttttaaagaggaaatctttagaggcataaaagataattactacggtttatttgcataattctagctacgactttaaagaggatatctttttttataaataaatactatatttgtataattctagctacggttttcagatattgtagttggaaaaaacaaataacaaaagacaagggatgttcacgtgttagatttgttttttttttttttttttnnnnnnnnnnnnnnnnnnnnnncactcttctctatgattaaatataaaaaagggcacgtgataagaaaataaaccagacataccagaatatgataaagtagaccagaggacaggttattataaggggggaaaacagagaaaaccacacaaagctaataatacttgcaaattttgcatctttactgatcactcaacattttccatgtgcatctctcgtactcgtaggtccacacatataaatgtcatgccattggctacgtgagaatttgaaattacacatgcatatattaaattcgttctatattattaaatatatttattattatattaactttttatcacataaatttaatacttattaattttatattaaaattattaatattttattaatctatatcacatttaggataaaatatattttaagtatctcaattattttttgtcaaatttgatatagattcttatattttaagattactagtatgtaattttggatttcgtattttttttttaaattgatgaatttcatcagtctttcaagaactcaggaaaataggataagagaagaaattcatcaattataaaaaatacagagatcaaaatcataatttttaataaataggaattaagatcaagtttgattgaaaataaaaagacttaaaaatatattttacccttaaaattaatgtgatatataatatatatatttgtaaaatattaacaataaagtttgtttgatcacagcctagattgattctgatgttggatcaaaagattgattccgatgtccatgctttgcctactttgctagaatgaatcatccaattcattcatgaaaaaaagaaacaaaagccttagttgataaaagtaatatatataaaaaattaaaatgttttttttagttattctttagattcggtctacgcacgttctctacagtacaactggttttgtgaaaactttttcaccaaacaaatattagttgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttactcttaaaaatattagatttggtgcaaatattataacttaaaaactcgtcgatcctgtgtaggatctgagttcactctagcgtgggttgttttgatgaaattattttaacttaaccaaagatttgaagtcatgagtatgtagtcatgttaaatacttagaaaaagagttataccatccttaatgattttaccaaactcaatcaagcctccagtggaagcacctagaccaaaaaaaaaaagttgccaaatagaaagaaaaaaaaaaacaaatgcttcacactgagcacgcaataagcacgtacataatatatatatatatatatatatatatatatatatatatatatatatatatatatatnnnnnnnnnnnnnnnnnnnnnnnnnnnnnnnnnnnnnnnnnnnntatatttataacataacaatgaaattgatataaccaaatgattagatataaatgattaaaatactgaaattaagattaaatcgttcaatcagtattcaagattgattcttaacaaaaataattttcgatcatattttactcacttctctacttgaactttaaattaatcaaaatcaatttcttcttacaagtcaaagggttaaaaccaaaaactaatgaaagtgatatacattatttgaacgaacatatataatctttatccaaaacaaaacataattcaactattcacgattagtgaaaattacaaagtattttatannnnnnnnnnaaaaaaaacaaagtttgttcaccatcaacctaacatctaagaagcagaagtattcagacctaccatgagcaccatcacaaaatttgtcccaggacctacataagtacacattcagccaataaatctgaaatgcataatgaaatttcctctctttttgtctaaaattacatgtaacaaatttagtggaatgccagattccagaaaaaaatttagaaaagggaataaatacatttctaaattaaaaaaagaacaaggaaaatgtatatatgaaacgaaagaaaaagaagaaaatttttggattatgaaaaagtgcatcatcatctgacagtggaagcaacagtgtgagcccaccatctgagactttctttcatgtcagtttcattgttgatagccggcattttccaattcaccaaagggttctctttttttctcctatcacattcctgaacctcccatgcttcagaaaggtaaggccttggaacacttatctcatcacaatcatcaccttcttctttttcctcttcctttttccctagccgttgcaacccaggaataattgaagccaagcttgagtctttatcctcctctgagaaaacaaaacccagatccatgaacccttttagctcctcaaattcaaggtctgacaaactcttgctctcccttctcttcctagttccattgcttgagatttttttgttcttcttaggacacaacacctcatcaggttctgagtcagtggcttcttttcctgagagaatggtttggagctttggatggagaagaagcactgagtctggtgacagagaatcatggttgaagcttgttgttatcatggataattggtcactcatggatctggtgtgactggttcggatcaagggtagttttggttcttgttcttgttcttcttttatctcataatctaaactttctgtgtaacttataattgatgtgtgaggacttgaatttgtcttcaaaatgttaacctcaaaccagcaagaatcaaagaggttcaagacagcctccggttccatggcggccgaagaggaaaatcagcagaaaagaaaaaacccgtgttttgtgaattgcgtgttagcggaagtgaattacttagtccatgtagataactagaatatatatgcatgtttcatgaccatattgcccttcattttaccctataattacaaaattctaacccaattgtttatttgtttacacgttttgaattaagtaattttgaaacatctttttcaattcatgtgtggtataactttgtgggaatattattttctattttgccgagtgaagattattgactccgtcgaaagggaaatactgtttggaattaggtgggtttatgaataggtaaaaggaagggttaattgattgaggtggaatagtgaattatggatgctactagataaagctagatataaggtaggggattttgttaacaatttgacatcaagttacttatcaaccactaatgtttatcttattatctcttggattctgacattttactggttttcatttcttcgtgtttgtttgatgattacaccaaaccgttttgatgtaaaattaatggctctaactacagcaattattgttggttgcttccaaattacacaaacttgaattgcgcatgtcactgtggttggcatttgcttcttaagattttcaaatataaaactctagaatttaagatctcttgcatgttttagtgtttttcttgtttgtttttctcatactttatttttttattacagtttttaacctttgttgccaaaacatttgactcttgtgatgatagactgatgtttgaaaatgagtttttatatgtaataatgtctattcccacctctggcattcctctttagtgtaattaatgttttgtataattaataggtttagaaggaccacacacgggaatcgcttcaaagtagttaataatttgaattaaattaaggtacacgtggtttttactttttgatacataacctacacgagatcaatataaaaaagctttacattatgataaattaggcatcaaccaaattatattatagctttaactcagatcacgtgtgaacaacaacagcacacttggggactgttagtaaaatcaatgtcatatagagaaagggggaatcagggaataatcgatattatttttagatacaaggggagaacagggaataattaatataaagatatgaattttcctaaaaaaaattcgctacacgcctgcattgctttataacacgtaatggtatgggaatactgatgtcgtgtatggtgtacctacttgtataagatagtactgatttatgttttaatttcttttttatatataaagaagtttaaatgaattgaattttagaaatttgttaaaaccggacaaacctcaatcttaaataaatgtttccagaacaacaaggtgaaaatcaaatgcatctcctaataaaatatgagtctttgttaacaactggatcaatttctctttttatctcccttgttaactctgtgtgaatctgaaaataaataaaatatttatcaggtgttgactattttttgcccagtcacgtgtgcatctatacaaataaaatattcattcagacacgcattattggtagtcaaattcaaaatatttattgtattccaaaactaagttcgaaagggtcctttagtaaatactaaatagtaaaaattaggcagcagaatttcttttaaaacgtcgagacaatctgaaaataaatacatttcacaacaatgtcaaactgattgtacatagtaagggatccctctgaaagtgataaaataagtttattattaataaaatcaataaatactttatatttataacataacaatgaaattgatataaccaaatgattagatataaatgattaaannnnnnnnnnagtattttttttttttataaaaggagattcgaattcatgatctcctttttcttcactaataaatcatccttatatcttccgctatgatagttattatatagggtctacttaatactaaatgtaaaaacacatattgaataaatatgaacattattaactgtccactaataagttgttgctgatattttcttcttgattccttcttccacaagcctagctcaaagaaagaagagataaaagagtcctatagaaaatgtgatcaaaaattcataatagaatcctatcacaacgaattaattatcttcatgcataagaatattagattatcttgtataaaagattcaaaaatcatctcaagcctttctttttttctattttaatttttggattattatataacgatttttcaattttttattttttaaaattttttatttataaaaatagatagactagaaattacatctcttatctcaatgacaccaaaattaggaatattaaacaaatgtaattagtatgtaaatgtaaataatgaaataaagtcactttaagatttcttatgaaatgaggttttactatggttgggacttgagggaaaaaaggatcaagagagtatcagctgcacaaaaattgcgatattcacagaatttacagataaatgcaacggaggagaaacaattaaatgcttctgatatttaaagtgctgctagtctctttaattccccattatgtttcagccaattattagtatgttcttatgaactgaaatcatcatctaattctgtaaaactatattttctgagtttattatctaattacctatgaatttcattgtaaattccttagccaaacaagcaagacaaaaaaaaaaaaaaaaaaaaaannnnnnnnnngtgaaaattacaaagtattttatatgattgtatatcgaatttcacatgattattcattgaattatattctaacagatgacaatatcaactaaaataacgtagtacaatgcaatatcaacttccttttatttataagaactttttaaacttaatttactttataaaaacattcaatttaatagttacattaattaattttgtatatatgcaaaacatatcaactgagaactcttattattattattattattattattattattttgacaaataaaaattataaatataaactattagatcatatttaaattatcaaaataaaagataaatgtatatgatttatttaagtagtcatgtgtttatatgactcaaatttatagtttttatttctcatgatattcaagagttctcacttaatgcatcctctttccctctctctatagtctatattattaatattatttagaatttagatatatttgtgggaaaaaaataataaatatttgatatattatcacaaatattgaaatgaaacaaacggactaggacaacatatataatttcctatgaagaatattcttgtaataaactgtgattggttactcggaattcggattcaagtatccaaagttgaacttgaatgggaaatcaataattaagaaggccaattgtccacgtgctacttgcgtctctgttgcattaaaaaaaatttgtctctactaagacatagctttgtagctagaagcgaaaggcaaatgtttcatgctatccagtatccaatatgttatttaatatttagagagaatgaaataagaaaaataaaataaatatgatagaattcatgatataataaaaaatataacaaatatttttttaataaaagatatacaattttgaataattatgtatcattatttgatataaaatttgtgtgtaaattttacttactgatgaaaaacataaaaagatttgtcaatcattcataaaagttgttgtttgcatgactgaatattttaatgattaaactgagcattataatgtcctttcttaattatgaaaaacaaatatatataatttaatttacttataaaattacttacttaatatattttttttatttttaggaattcaaaacaaataaaaatttacaacaatttatacactttgctacaccaattggtaccctccattctcaatgattgcttggcgcctatcttcgagcgtggacatattatgaatgtataaatagaaaaagtgttttgattctattttttatagagttttgacacaacaataaaggtccgatagatgttgaagaattagagcagtgcattaatgcacgctcaatgtgtgaagacaaattagaagttagctatattgagcatgggcgctaagtgcacgtttggacgcttagcacatggtcacttaaaacaaatgtactttgcatgtgggcttattgcgcacatgcatgctaagaacatagtcatttccgaaaaacatgattgtgcagagttttaaagattataaaaagggtgacactatgcttttggaggggattggttggcaagggcaaaaagagagcaaaacattcacttgggagttcttcttccattttttttccatttcgtttgttttatcttttgtttttgaacctctcatgattatgagagactaaattatccattgttgagggcttggataccaaatactctttgatgtaatgatccttactattcatttaatgttatttcaacattattccttcctttttaagtttattgtcttgtttatggtttgatcactcattaacatgtatgttataggattttaatcatcgggaaatatttttactctaagaacttgaaggagcttctatgtaatccatgtctagggatagaatgatgttatttagtcttatttgcatcgttagtcttaaatcaaattacttagtttaactcttaagggattataagtgaaattagatggtttaagcttttttgcatgaggaatcatggttagagtagttgctaaacggccaacaagcgcaccgatttgtcaagtaataaaatccggtaagtccagatgttgaattccacagggactttgcttatactcaagactaatacacgtttgttttcaagtgatcaatgaataaaattgatttgtaaaatgagttgcattatattaaactgtacttaaatgtaaattgaaagcttaataaatacaaggagagaaacacaaacactcggaaagtgaacgatggaaatatgatgccattggtgttaagagttcattaaccgaaactaactttgatgcgatataaaagatttttctctattcaacgttaaatacgattaccttcatccactagtataatctaaccttgattccccaagtgctagacctaaactacttaatttcacccttgatccctcaagagttatattaaacgatttgcattaagattaggaatgacaatgtaacataggctaaacaagaccattctatccctggacatgatattatttagaagcatttctcagttcttaaagcaataatcattttccaacgtgttaaaacctaaaacaagcatacaaatgggtgatcaaaccacaagcatgaataaagctcagagaaacaacaataatgcgcaaataatattaaatagatagttagaactttacatcaaagtgttcgattggtgaactctcaacaatgggggttttagctcctcatttccatgaggagcttacaacaatggaggttagggcaatggaagataatgggatggaagggaaagagatggagaggtagctccaatggtgcaaaatgatgtctccgtcttgacctagcaaagctccaagcttctctaagtgtgtgtttttcctttttgggtctctacaatacttctttccctcctatttttgccttaaacgctgccctatgtcgtggtacttgctaagtgcgtccttttcacgctcagcgtgcctcaaatagtccagttggattagtgaccacgcgttgaatgagctggtagcgctgggcaagcctggtcgcactgagtgagtcactgctctcgcactgagcgcgcctgttcctcgctaagcgagcagctcgaaacatgaaatccatctttcatgcccttgcaataaattctacaaaaaaaatacaaccaatacttcataaatccactagttaaagcatccactggatagaagctaagaagaagctagttcctacatttaaatcaccaaaaaaagcattaaaagaggaaaaaatagataattgcaaagtaatgtatatgtaactttatgtatacttagcaattatcagtagtttagttgatgaagataataattgaaataattttaaaaggtgaaaaatccttaatattgcatcaaaagtaattttggttggccaaacacccaacacatctaaaagaatatgcaccaaatatcaattttcacctctaagtctttgttttcttgtctcttacatcatactatgcttttctatcctttattatggtggaagtttatatttctacactatcactttgaaaaatatttagttttagtcattcatccacttaaaactcaatgtatacaaattctgagtacaaccaaagtccttatgaggtcttatcattttaatattactttaacaaatttgtatacctgttaaggagttaacaataagatattgaaaataataagatatttatggatcattactcttaaaaatattagatttggtgcaaatattataacttaaaaactcgtcgatcctgtgtaggatctgagttcactctagcgtgggttgttttgatgaaattattttaacttaaccaaagatttgaagtcatgagtatgtagtcatgttaaatacttagaaaaagagttataccatccttaatgattttaccaaactcaatcaagcctccagtggaagcacctagaccaaaaaaaaaaagttgccaaatagaaagaaaaaaaaaaacaaatgcttcacactgagcacgcaataagcacgtacataatatatatatatatatatatatatatatatatatatatatatatatatatatatataaataaatagatagatagacagacaatatatgaaagtgataaatgtgcgcaggatgaattgccgggcaaatcttctttggcggtgaacatagctttttcgcttcattgcctgaatgtcaagcagctgaatgttcaattcaactgccaaagaagtcattgcccagtaatgcatctgcacatgagtttgcttttcgataactaatttctggttatccatgtctatatatagtgtagggggtgataaaactaggacatgcatcgcacaagactaaggatattcccagcacatcctctgctcaacaactggttacaaaaaagaaagtggtccatcctgtgcctttagtctcacagctactgcacttttactgtgagattggtaccacaggtttttcttctaaaattccatgcatttaatttttaatcaacaaacatgtctctacacaaacagaacaagcaatgaaatgggagtccgtgacgaagaaaattccatccatctgaaaggcataattcttctctattccttttctagtgttttctgttcactttaagttaagaatatgctggtagtaaatacctattccagaactatgtccaattctcaatgtcatggttgaaaaatcaaccccccttctttttctcacaagcgatgcattaccaaattctgaaataacaagtctaatgatattgtgatctgctttcaaaaatcaatgcgatctttccattcaagtgactaaatttattattgattgctgatatcatacggcttgtgtagtatactgagtaaccaatgcagccgacactttgaaattccatttggaaacagtttctcaataaaattatacataacataaatatacacatgtatgtatgcatatggatcttcttatgtacctatgtacatatgcatgtagtcatatgaaaatttctaggcaaatttgagctattagagaaaaccagttgatcttgtgttaaattatgctctggcttagcgatttattgccctgattcaagcaatgaaagtgcaacagcctgaggcaatttgtatgttgaatgaccaaggttatctagaggatttgttttgttttccctcacttgtctatctctctttcctcgtttaatcaggatggtcttcgaaacaaagagatatttttagctaaattattatgagaatgaagatattttggtatctttttgctaccggtttattcttatgtacatagtacatactcataccagttgtaaattgagaatcttttcttttcttctgtctatggtgacagtctgacataaaatttcataggagaagtgaacgaatgtcaaagaacctctggaagtaggtagaaattaatcaagttatgtaagcaaatcttcatttaaatttttacaataaattcgtgaatagtaaagcaaattctcttccattgtgtagtcatgcttaagacaggttcaactagcaaaatagcaattcagcgttgaattcttcatagtggacgtggacacctctaagaaatgatttatataccagagtaatgaagtgtggccttgaacatcaacttggtcaaagattagaaaaacttgtaatgccttgtaatccccagagtaatctcattaagctttatcgtcctatccaacagtctataatccaaagtaagtggctgctagactctttacacctttaattttattcacctgaaattttgttttggattgattaacacatcataatatggacttataatcggcatgaaaaggaagtccacttctgcatgcataaactacatatacataagtactgatagttcatttcgtgcatgtatatacataaactgtttatgaccaattcctacataggaaaagcatctgatagtaaatcatgatataaacaaatccttgtttttgaaagggattgatggtgaaagaatttggaccagtaaataacaagaaccttacaatggaattgtaccggcatatgctgtctgctcctaatgcttatcagtggcatatccaagttaggtgctcatagctacctataaatagccttccattttatgatgatggcctcagacacaaatttggtgttggaactgtgatacataaaagtgctgttgaggaatgatagagcaaatctccattggcagagagaagtagagggcttgaacatgcatgcttctggtttgccaaaggagatttgccctgccattttttaacagtttctgactaaatgcaatgtgttggctattttctatcttcttctatgactgtatttaattaatttctttcctgtttactaacggttttcctttcaatatgtggtagatggacatggagaagtttcacttttatgagacatggagatcaaaaggatagaaagatagccaacaatcagagattttccaagacaattgccagcatttccagtttcatctagtgtcatggagcaaatgaagatgcttaagcactatactgtgaagttaacaaaaagagaagtttcagttagcaacttcgtttgctgcattgatatttgatgcacatatcttacttcttattcatctcgagaaatcttcaaatgtcaaaatctatccgtcaccatttcagtttaaataaattccatgtgttatttcacgttcaaatgttttgcatttactacaataacaccccaaatcacactgccaatatgagggtttcgtttgtttaacgtttagttattcattatgataataaaactaaaaggttcgtactctaaaattcaaatgtatattgaaagaataaacagactgatgtcgagtataactttatgagcgattatatctgaaggtatcattgtgataaaactttttgataatgcagaaaatccatcagactgattcagacatgatgcccaagcagcatctaagagcctatttgttttagatttttggtataattgattttacacctttgaaagtgattagtatgtgtgccttaattaaacatgtgcctggtgtgtaaattcatttttgcttgtaatccaaacaagcacttttcaagcattgattggacttagacggcgtttgctgcatgccaactcgttttagtttcttctatactgtctttttttctcatttatcccttttaggtccatctagctcaacattattaatggagcctaagttcatattcccttctcaaggagaagttttgctagtacaaaactacaaactagaattttgcaagtttgagcttgagaacatggaaggcgatgaataattttttcaatgattatttttccttatttatttgatggtaaagatattagaccattatagtagcattcatcaatagttaaacagcacttcccgccaactcacaatgtcttaaatataaccactaaaagaaattcaagctttttaattttttgactatctaataagaaattctgatcgaccttatgcaacttgttaagaggtaaaaaattttgcatatattttacatttgtttctgttaaattatgagtagaagacagaaaaagtctgtctcctatctttggaattatttaattattattcaaaaaaatttcttctattattttctaaaaaaaggctttcatcatctggtatgaagcgttgcatctcttgaacttataacttgctagtatagtgaacatcctcacatgaaaatcatagaagaaaagcattagtacattgggaaagacattctgaagataataagcagagactaattttcttgttggtaaaggataaagaagccatactactggtgtgcacttatactttgtcttcataatattagtgtgatcattgccagagcacattgtcgcaagtattgcatccatgcattatgatttctatccaataaacagagttggggctgagcattggtttgtcatgcgaaattaagagttggattctggaaaactcagttccggaaagaaatctaccaaacttgtactttcaggctaggatacaatcagaaaagtaatgtagattaattagtctcttatgaattacgaacttctccctttatatgattttatgcttaatacttgttaactttagaaggtaagtgagggaatacaccttagatgattaaaattagttatattatagtcatcagtcattgattagaaaatcaactattgagatactagccttattgtttatcatacatgtgcatgtgtatttgatcacaatctcaacagttggtgttctaatcaatggctataactatactttattgtttaaactgaaaattcttatttcagaggagttaaatccaactttttacgccttacttcatctcattgtttctgtaggtatcatgcatatagatgacaacttttttaaataactataacttcagacctgcgagtttgtattgatctaatgcattactatttaatcttgcccttccattaatgcagcccctcacactttaaagggccaatcactagtagcagaataaaactttaaaaactgaccaagagcagaaaattgtatcatatataatataggtatttaacttttcagtactttagaatatcaatcgtgaaaggtgaaagaaaaagagaataagcttgctgaggaggaagatccatatgtttgtgctatgccttactttctctcctctgtcgtgtcagtttgttgacaattaatccttcttttgtggtcagatgaacatgtgaatttttaaatctttaatataattgacaaattattcttgatttccatgaaaatcattctccagaacttttggttgtaaagattacagttcacaagatttaacttagtaggtgctgttgccatttcagtatatccaaaaaaaatccttgttctttgggattttacaatattgcatgactgaagaagtcctttatactttattttccacaattattgtatactagaacatcataatgtggtcgaatggtgacattttccactatcagcaaaggaatcccaggaacacgctaaatttgtaaaccgtaggttgccaattccttttctgtgatccatacgcgaatgatatgcactgtttaaggtaaaatagtggagaaaaaagaaaaaagaaaactttatcaagcagacctttaaaaacaatgaatttgagaaagaggaatctaaaagaatcaattcattacttaggttgttcaacttgtgacttcaaataatatgaaattgaccaattaataagagtcaatttatttgataaatctcgtaagaaacacttttacaagttaaaataaatttatacatctgtttctcgaaaaacttaatttttcttacaactgagttgtgtaggttgattttaacttattaaatcattcattttatcttcttaatttattttagcctcctctccaataatgtttatgaaaaatttatctaaacgagtcttatataatatatttcgtttatctaataaatcaatgagggttgatgatatgctgctagcatataataattttaggttaaaataatcaataattcaatcataatttatcaataaaagttaggataagtttaagtttcatcaattcttggtccattacttattttatacatattttgtttaataggaatcaagaaaagaagaaaagaagtataatcaagaaagatttgtcataaaaatagaacaacataggagtttaattaccctaaatataaatatggatgtgcagaaaacaaaggagtgactttttgacaaaaaacaacacatagaaatgcaaagagaaggtggaggaagaatcaaagctaataggaaaggattgaatcaagattggaagcaattatttctcctattgtcttgagattgtttgtttaggtacatgttattcatgtgtttaaggttagttatgagcatgtctggctaattccctttactatggttagagctaaaaccaatgtgaactcctctgtaattggattcgtgttaatataaattgtgataattgttttattttattttgttcttgaataaattattccttattagacttgatcattctagtgagcttctaaggtttagggtttataataggaatgttggagctctaatttctgaaagcattaaaataacaatttttacattacctaaggatagagatgtatgattacagagcaatacatgtattagcttaatgcttaacttaatagggaattactaagaaattaggatttctaattgaattaaagggttaaattactaaggaattaggatttaactaatttatttaaaaatacatcatctgagcaattagaataattgaaagtagtaactaatttcaatacagaaggtagagatcaaagctaaatatgctctaaccacaattcttcctcatcactgcataactcttaattaatattgcttttgaatttttattaatttttaatttaattattaaattttcttaattccaaaatacaatcatattctctttaaaaacatattatttgtcattccaattttaagataacaagttgcgataaaattagtgtctcaattattgtggagacgatactctatttacactttattatttgtaactataggtgtatttgccaatatacttgccgctacgcaacagttgatatataggatatataatatatgagaccaggggccagcctgcatgccttcaagaaaaatattgtagtggttcaaactacactgtagtccttcagtggtaatcatggaaccaaaatatgtgatacaaaaatgatgcaattaattatggaagatgcattattttctagtcagactggcatttagttgtgcatgtttaatttaaagaaaaataccaaactaactaatgaaaaatcataaaatgcttcaaattaagttccaactgtaacgaccttttattaaggtttgttgaatgaggagctttatcacagcaagggggaccatgacagcaacagcagacacaacacaaaggagttcccgaaggataatccgtagcatataccagtacaatcaaaatggttaattggtatacttcacaggtagagaacaattaataacagtgcaaatatactttaattttggcaattactgccacactcttgcttgagatatgatattttctgccaaacaagaatcgcccggccactcagcatcatacgttgcttcacaactacaagccttcttaattagacagcattggttgttctaaattataatataagttgaaatgtacaacttatgattgagttttcctttaatttttacgggcacttttatcattaatactactaggttttagaggttgaccaactacaacatgaaaggatttggattcctgtcacagtcgagaatatgaaccgttaaatctttatcagacggttcttattatctgactgcgtgaatatatgttttctccgactccagagaatccggatccaacatgaaaagtgttttaaattaaaaattttgatccatcctgtcctatcaatataagtattatttttctaaagttaattttgatgaattcatttttaattaaaatttagacccaacaacatattttgaagaaaactatcaatcaaaatggttctacccagagagttaatggcattaattaatgtggtaacaaaaaaagttacattaattttataattcgatcagttatatataatgttaaaattaatatcttatataaataaattaaattgattcaatcttattttatatattattattggatcgaatttgaatttagtgagatgttattgatttttttgttatcatgttataagtgtaaagtattaattaattttgttgatgaataattttcattgaaaatcatgataagacatcttagtggatctttcttttcaatcacattttttctcacaaaactcaaatttgaaacattgcctaagatgtctaagccattccacttggactaatataaggttggaggattaaattttgatcatatctaagtaaatagtcaaaatttccaattagataaagacaaaaataattttgtgctatttttttggtccaaattatagttaattaaaaatgtataccaacacttacaaaatannnnnnnnnnnnnnnnnnnnnnnnnnnnnnnnnnnnnnnnnnnnnnnnnnnnnnnnnnnnnaagaaaaaatatatatctttagtcgatgtgagatctccaacattaccttacatcaaggtttgaacatcttaagcatgaagttaatttgcaagtcttaatatttgtggatgttccaacaacaattcctacgatcaactttaatatcatcttaaaattttgagtttgtgcatatgattgaattttacaaaactgacttgtaatatgatttttaccccctatttatatactcttctttagatatatctttagttgatatgaaatttgcaacattatgaattcaaaagaacatgcataaatcttgcataatcctctactctaagctaattgtaatccatgaaatatgtataccccaattagatggagttattagaaattagtacatggatatagggttatccatcaaatgagatttgaatgacataattaaaatcgaaaccaatgacaatgaagcattaaaaatacactgatttggattatttctttgactagtatagtttttgtttaacgaactgttgatatagatattataatctattttataataaaaaaaatattaatagcagatacgatacactaagatcggcttaattatagggatttaattagaatgatatgcatgaattcataaatttaatatttactgttgtcattgttaaaaaaaattgtctaatgcataaaacctagtaatgcatgcaaatttaatactaaactagtgcattagtctaaaccttgtcgaacacaaaaaaaaggtgcaagtacctttttctcgtttaagatacttgttcacttttgatagcttaaacagtgacgaagtaaatttaaaaacagtatattaatgtaaagtacacatactttaaatctaaacgactattcaccttactataagcaaaaagcaattatgggaagaaaaaaaaaaaagaggacctcatgcaagtcctaaaaaatgaacgtagcacatgcatcaccttctagtttcaaccactacagtgaatgttttactggataatcagatgaatcccgcacatgaattaattgaaaaagagttgcaggagaattgctgggcaaatctcctttggcaggttgcacacacttatagtattgcatagcttgttggtgcctgccaaagagaacttgtcctgtaatgcacccacaaaacaactagtaaactaaagatggcacacattaaggatggctactgggaagattatttatcgcttgctagaacgggtatatcctatagaacaatgccttccattttgtgtttcatactgttttattcctttgtctaggaaccatatatcccttttggcagtacaaaaggaaaatcaataggttaaaaaaatttagagctagcaattttatttctattttcattttttgttttagcttttaattgacaaaactgtcacgtacctcttatatatatgttaatttgattcctattttcaaatatttgtatagaaattggaaaaaaaaaacccatcatttttttctgtatttcctatataaatattttaaaacagaaaatatataaaaaataaggtgacaattttatatattaaaagtaaaaacagaagtaaataaattgactacgaaaattaaattcatgatggcatggtacatacatgttgcattggcgacctctccaaactcgaaaggctttctcttttttctatctctgaaggttaacacatgcttgccggagaatttatatttgtataggatgttaaaatgttaatatttatttattattgttaaccagaatattttttaaaaattaaaccaaacatattggaagaacttgaaaaaatctaaagtaattactgagtaagtaaaagttatgtttaatttaaattatttaataattaatatgaagttaatattacatatcatttaacgtgtgctaccttcatttttctcgcagctgcagcacctaatcaaatcacaaggaatcaaagaagaatcttgacctcttttttcctttgaaaaagaaagagaaagccatcataagcactttggctcctggaggccggcttaagcaatgtaccttttcacgtttcaagcttagggtgaccaaccagaatatatggttttagattttctgcttatacattcataaaaaggaacttgatttatttttggtttaaagaattaaggaatctgaatattgatggaaaggaaaagaagtgcaaatagaaagagaataagcgatgaattatgctgctgcgagaaaagaagatactataggcgaagttctcaagcacaaggttagccatcggtgctatcaaataaataatggaacataaaagttgtttatgaagaaactagaagcagcatggatttggattcttagcttatgttggaaagaatgaaagagattttaatgagttgtatgtgaaacgtatgctctctattcctaaattgcatgaagctcactttaatttggtactgctcctgctttgatgatccaaatctgtaaatgtcatatacgaaaaaatgaatccattgaagtggaannnnnnnnnnnnnttttttataaaaaaaaaaaaactcagtgatacttataattaacacattaatattgttactatcttcatttttaatctttagttgcttaagatttttatacatgattaaaaatatatttaatttatacaactttatatctaaaatccctcatttattatttttcaaatttctatattattttcaacgacttattttttcaatgcaaattttactacgacataatattaatgcttcatcacagtatctcgtaaaaataaaagttattaatatttcactaaaataatcttaattaatgctccaccatatataagggcatagttagaagaggaaagagtaaattatattaatcaatcttgaagttttatagaattacataaattcttcctgttttttaattcctacaccaactcctttaattatttgaaaaatacattacaaataagaaatattttttgtaaatgttaacaaaatatgagttttgtgtaatttcagagataattagtataatttattctagaagaaaatgtcagttacataatggaattttaaaataattaaagttttgaaacaaatacaaaatactaaaataactaaagattggggatgaagacagtattagttataggtttttaaaggatcaattgaatgtgaaaattcacacccaaaatcattaagtcatcttgtaatgatcatcgcctcaaagttaaccgaatgagtttctaattaactacaataactgtttctaggatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaggattttttttataataagaattaaagatatatattagaaattataataaatcacgcactatgtcaattaatgtaattggactcccattaggaaggattgtttatgttaaaaataattagcttatgttaataaaaacagaaaagattgtttataatatatagatttttataatacattatgtgtgtatatatatatatagtttacattttaaaaatatacaatttttatttaactaatcttttaaaaaaagtagataaattttttttataaaaaaaaactgtttattttaaataaaataatttaaataaatacattagaaaatcataagactatttatttaattttattttaaaaaataagattaaacaaactagtccaataactacttaggagaagataattttatttttttaaaagaataaaacactgcaaaaacatttattaggaaagatactgtaatttatcctaatcttttttttttcttcctttttgtcgtctttgattaggtatttttgtagacgaagttaattatgtgactaatccacgaccaactaggagagttatgtatagttagataaaatctatcacctgatgacaacttcatgattcaaatccttgtaaataaaatttgtctgcattacagttcgttttcgttatgcaaccaatcactaatgggttcgttcatttcattttcaccccggtatactgtactaatatgtgtaggtcctcctaattctgagtgagattgtcatggcgcaaaagcagatatggtccggtattcccttgttccctgtattggttatgttcttcatttctcgtcactaataattgacattcccttacttctgcaccaaatcaaaaattattaaaaactattattaatgattaaaaaaagaaaaacttttcttaatgataacatgtactttaaagaattaattgaactacgtacaagtctacaagagctttactgtaattgaagaaaccatatcctactatgctttcctcagtaatgcagctgcagcctggaagtgtaatttctactgctaattaacgttttttacgactggtaagaatcggcatatcctatgggacaatgccttcataatattcttgtgattgtggcctttcatctttttctttcattttcttttatcttttacatatatattaaagataattttgaattgaagtaattaacaaaaacacagctagcagttcaaataaatgcttattcagcacaaacaatgaactttttgtacttcaacttatagtattgaattcgttgacagcaaaaagaaatatttggcaaagtaacttacaccaattatcacactttttttagtactaattattacaatttgataatgactttatatatggtttgaatccattataactttatcttattttattactgtatcaaattttatcaaaattaaataataaaaattaaattattaatattaaataataaaaattaaattattaatattgtagtattttttgtaataaatatattaattacattaattttaatttatataaataagatattaaataattttatattaataatttgtatataaatatatgatcaatttatagaaatttttaatccaatgacttaggatacatgagcaaccacaaatctaatattacattttataacaaaaatcttaaaattcaagtttacaagtcttctttttacttatataatattcaactttcttattcttatatcatatgaaatttcacttcatacttttactccaacaattattattattataaatctcttggacaaatttttatgatcacaaaactttcacttatgcttttaaactaagttttaacatagatgaatcaatgaatataatttaaataaaaggtttgtagtagcaaaaatgtgaaacaaaagagacaaattaaaaatattaagctaattattaaatcaaccatagacgacaaattttcgcatttgaccaatttaatcgtaggagagaagtttcacatgcatgctcttcattgtaatgtacaaattatattaaacacatttcttcaaaatgagatagtaaacacattacttccaccaaatatcttattaaacaaaatgtgtttcgatatctcattttggtggaaaagccaccaccaaaatatcattaaaatatttttttaaccacttgatgaaaatagtatcattcctgctccacatactttcatcaagtcaaagcagaaattaagtaatgagtaaattaacataaacttcactgaaaaatataagcaaaaattattctcagagaagacacaattgatattagagtcgcaggagaatcgctgggcaaatcttctttggcaggttgcacactatgcaagtatgcatgcataattgcatatataatatagcatagtatagtaaagtgccaaagtagaacttgccctataatgcatctgcaactgggaaggtatacgaagcggaatggcttctgggactgttatttatggcttgctagagtcagcatatcctatggaattattctgggcttttcgtatggttatttaatccatagcgaaccaacttcttaaagtgaaataaaagtaggtttctgtaacgtttgtgattgtatggtacatattgattgcattatgtgttggtaaccatccaagctagctagctgtaaaaagttgaaacccttctttccagctacgaaagtcctaaatcagcttgcacaataatttatcttctttttttttttcgaattcaggttggtaaatatatagatgattaacaattattatattatgaagaaaaaaaatatcttaatttgcttttctatatgtagaatttaacaaattttgtttcattattaaccatagttggttaaacaatatatgtgaatatattgttataatttttttatccttagtttgattcttatagatttttttatatataaattatttgattggaaagagtggtacagagaaggatgagaattttggttcttaatttgtttacatataagctcagaaaaggacttaaataagataattagaaacacatggagactctttattgtataccctttgttgagataagacctatttgttacctattatttaaatttatatatccttttcaacaatgaggttagtttttttcattatattaatatttctctaattaattaagtgtagccttattttaaaaaaataataaaaattcttcaagaattcatgccaataaatagattaatataaataaatatactgatatgaattaacgatcaaatattttaattgtaatatgttttatattaaaaaaaaatcaagcaattttttgcacaatggaaccaattaaattaagggtgttgatagtttataacatcctgcttgtgtgaattttttttctaccacaaatgtttcaattatgcttaattaattctatggtgcacttttaacataaggcaatttttttgccagagtgaaactaaacaccgtctgtaagttgtgtagaatctcaaacaaacaaagannnnnnnnnnnnnnnnnnnnnnnnnnnnnnnnnnnnnnnnnnnnnnnncatatagttgtgaattcattctttaaatggttacattaacgaatgctttaaagatattaattaacgagtatttactatattctattaaataattttaattgtttaaaaataaaaatattgaattattttaatatatttgatatgataaatatttttcaataagaatttctattaaattaattttacaatcaatattcttaggagattaatttgcgttgtcttttttcataagtgcaaagttagatattaattacaaatatgtcttttaaatactattgtaggatacatttaattttttttataaccancatatagttgtgaattcattctttaaatggttacattaacgaatgctttaaagatattaattaacgagtatttactatattctattaaataattttatttgtttaaaaataaaaatattgaattattttaatatatttgatatgataaatatttttcaataagaattttctattaaattaattttacaatcaatattcttaggagattaatttgcattgtcttttttcataagtgcaaagttagatattaataacaaatatgtcttttaaatactattgtaggatacatttaatttttttttataaccattgtaattaccgtttttccttcttagtaaaactctggaatatctttataagttttggtccttaattaaaattgattatgagactaattgttgatttgaagtgtatctcatccctatttaaagatgtgttttgcaaaaattgttatggaacaattttagcattcactctcaacggattatgagtgatattatttcttttgaagtatatattgggtggggcacattgcatatgtacaattgtgttttgaaaatgttatttacagacacctttggaatcaaatgccaattaataatattttttttaccttttaaaaaaaagaattaaatttttccctacaaatttaatatgtattgtcaactgaatcatatcattaaatataatgcatttaattaatacccacaaacaagaaaattcttactaattttgtttgaataaattaaaagtgataaaacaaagaaacaccctgatattatatattgtacaagacatgaactcattttttatttttattatgattatcaacgttccaaacttacaatcttagctaactcgacatatatgtagttattaattagaaagtaatatatgtacatgttgcatgttacattaagaatttggctatgcaaaagtgtgtgtgtgtatatatatattatatatatatatatagggtaaatattagtgtcgccgttattattgttcgagtgcatccttctttggtttttatttctcctctcaaataaacaataaaaatttgacattttcgttctatatatttttctttttgaatttccttcttctctatttccaccaaaacaaacttggaggcaaagaaaaacctaggcacactggaagcatttttaatggacccaacttatagaattatgcccacttgtttacttacatatacaagccgatcgagtcaaatctggtcttacatttcccttgctgtgtaaccctgtaacgtatttaacgatatgtggcgaacatcagatagaatagaataatcaaagaaccaaccaagtatcgcagaaaaatattcatatatacgtccttttatatatgaacatgaacctgttaggtcagaatatagtacctttcaacggagagtgataaataagaatatatgttttcagattttgtgtttatgcattcataaggaatctaattttgttggaaagaaaagacttactgttataggtagaaaaaagaatagcacgattatgctgaaagaagatactacagcacattctctttggcttctacacgcgatatttgatatcggtgactagcaaacactattatatattaattgacccaaaagttgtttatgttgaaactagaagcagctcaaaaatttgattgtatgcttgttatattcgtattggagaaagagagccactttaaccaatttttatattacaaaacttatgctcactaagtgcatgaagctaagcagtactttaaagccctgattaagatactaattaactaagaattccttattacaaaagattgatttgacttaccccatatatttacctaaatcttgattacacacacccaaaaaataataataagtagctttggcaactatcttctcgatcccatcctgacatttgttcattcctaatatataagggaaaattaattttttaaatattgtttgataatgtttaaaagaaattagaaattaaacaggggttcttaaacaatatggttagagcaactctaaccccagaatattcagaagttacttaacttacttttattaataagaaacggtcacacttcctattgcagtgtgggagacttacaacatgtaagcaatgggagtttattcaaggcataaatcaatttttttttgaaaggcaggtcataaatcaaaattgcttgccatttttgggtcccaataaaaattgacgaactgaaacaaaaaataaaatgagaggaggcacatagtagtgaccatgtgaataaaaacatgatcatatttctatttatatgatcatgtgaataatatgatagtgtaaacgtagttttcaaaggagagatacaaagatgcaagataatttgtctggttcaattcataaactttttaattaaatattttagaattacattactaaagggagaaaaaaagttacttaaatgacaaaaaagtaaaaacttatgcaattaatgtgttataagatggattcatacaaattataaacaaaaagcattctaaccattagaggtctcctatatataaattatgcacttactagtcttttttttgtgttatgtgaaagattacatttatcttcccattcactaaattagaaactaatcctgttttcattatgagataatcgctgattcaaaagaattttatacacaaaacaaatcaaatattagttttctcactgaataaattgtttttccacgtttaaatacaatggggcctataccactttactaatcctgtggcttgtgggttattctcctgctggtctatactaaccaaaatgtaaaataaattataaaatcataatatcgacttcaccgaaaaagatgctgggaaaaatggtttttaccaaaatacaaaacaagggaaatatggcatatgcatgaatggttctacatgcaacatttcaaccagtacaagaaatgtttctaatgaatggttgaagaaactaacgaatactgttttcatgaagcagatgttgcaggagaatcgctgggcaaatctcctttggcagattgcacactaagaaagttgcaaatatatatgagatgcatatcatagtggctacctgccaatggagaacttgccctgtaatgcagctgcaactgggaagatccacacacacacatagaggaatgcctttggaaacgttatttatggctcgctaggatcggcatatcctatggaacgatgcctttattttgcgttgcatgtgtccttttataaggttttattcttttgtatgcgaaccacatcctttatggtgaattaatttttacattgaagtgctaaccggcaacaaaagtgaaaagggaaaatgtaactttgtttctccaatttttgtgtgtggtacatatataggttatattatgcgttggtggccattcaaagctgcaaaagtcgaaatcccctttccaaatatgatattcccattacaccaacacaacagtttatctttctatgtttggttgttaaacttgttatatgggattaaaatagaatctttgattaatttattttgaaaaacaaagcacctataaagaactttccttttatagctcttaaacagagtttaaaaaattagtattccattgttgcaatcttttgcctttctaacaaatttataggaagattggaaagagaaaaagcatcagaggcatccttttaaataagaaaatacaaaaagactatagaaactattactttacaactgacatgaaaatattaatgacttctttcatttcatgggatctctttgattttataattgccaaatgatcataagggtaattattttcataatttcaataattaaatttaaaccccatgaccatgatacacagctaggagtgtctgctagatctctttctgttatctgataatttcattcttcatgtttagtcactcagtttcttaattacaattttttgtagttaactaagtggcacactcaaatgaaagagattgagttaattaatattcttcctcaactttttttttttgttggtttaagatgtttacttgtccacgactattgggagtcaaattgtcacaacaattaattattgatagacagtagttgtgattttattttttatctaaaccacggatattttttaccggagtcaatccttacatattgatatcattttaattctccttagcacacattgaattgtgaacaatatggactttaatgctagcatctaaaataatttgtttggaactacatgctgttcaatttgcataataatttgtaggagtgacatcattatattcatctagaaacttgcatgtggaaagtaaaagtggctactgttttcgaatggggaatatgtttcattggattgtgaagtcatacatccaaaattatacatagatacataaatatcttttagtataaaaagacttatttccatggaacaaattcagttggttcaacaggataaaaaaaaaacaaatacgttatgttggagaaataaacttactttccaaaattctctcaaacaaattaatagaattaagtatttaattatttaagatgagttaactcaattacgcacagaatttattacgagcagaagcaacgtactgctccttgtttaagcatctaatgtttacgtaccaaaagattactagtactacttatgtcaaaagcttcacgtgatcgatcaatcacatggtctttggacagtgaatgaaatacgaatttgcatactgagaggaggtgggtggtggaggctagggagtatttattgagcctcacctagaagagtacatacaatttcagtttcagttgcatctctcacatggcctctatttctatagttttaattagatcccttagattttagtatgttgaaggaaatataggtaattgataatggagtgtaggtgttgaacagctttgaccagaagggaaagtttttattctcgtactattcaacatttcaaccctttgttttacttacttggaagttgaaagagatcatacatacactttaattatattaccattattccaaacagaatagacattacatgaaaacaaattctaaaggggagccattatgaaggtattttgtgaggtcttggaccaggttaactttctggttctttcttcgtggaaaagattgtagaagttgccaattaccacaatatgttagagtccggtgtattgaaattgtgggaagttttgatgaactttgaaattgctagaatagtctttcctttgtttcttggcaactgctcgtatagttaaattttgtagtatggataggatataacattttaattaatatggatatataggatatctcttatatagttgaaaactctcataaatactcatccacatttcctttcatctcttgcacattattgtgcaaactcttccttaacaaaccaaataaatgcaaatcctaaagactggccagagaaaaacaattaaaattaaaggtgaaatattgaaattgcattcatggcaaacatatatatatatatatatatatatatatatatatatatatatatatactattttcttgcaactatccccctgaaattaataacggttaaaatgttaaactcagaagatatataggcctgcctgaaaagcatgcccattgccaacaaccctaaaaggatttactattacctagccagagtaacttcatcaaacgtcgttcagagaggatgagagaggaagccctgcaaatggaaatgggaaactttttgtttttgtattaaagactataacattgcaagtagtggatcaattaatattaactcaacgagttatcgtagtcaatatgcaataaaacaatttttgttttgttatgatgatacaagagtggaatggaatgacaatttgtgtcctttgttaccatctagtttgcgaactgaactccatcatccagctcctaatctagttatgtaaataaatagtttctaatcttcttcaggggactatatatatataaacatttcctcaactccaattttatagcaactctaatcttcttcatctctttataaaggtgtttatggttttgctgctcctcctctgggccaaggcgaagaatttctttaatttctcagggataatcaaagagatgaagaaggatgttcatgcactttactggtcatatatccttcttcatttcttgaatatccatgaaaaatgaaagaaaaagatgggagtagcgagagacctcgtttggttactggtgagaaagggttgttgagaattgaattgggattaaattcacgggggagagaaaacgggagtgctatgactgtgagggtgacgtgagattgaatgtgagtgatgaatgcatggaacccctaatcgtgggtatttattattgtggaaaattaatgagagggagagagcgcgcgtggtgaatgtcatgtctacttgtgaaagagtagggcacactcataattttttacatttacatcagcatttaatatctctcattttttttttctttatctctttttagtacatcattttttcatttttctctatggattggatatagcaatattaaggcctatttcttggtgaaagaataataatatttagacatttttaaatatcaaacacctcatcaacacacttaatttattttaatcttttttagaaaaatagttgataaatacttattttactataaaagtatattgattaaacatttaaaataaaaaaaaatgtttatatatatcatcttttttttttttatcatcatacatcattttaacatttcgaggcagctacattaccgggcaattcccgttttgggaggaggctaccccataacatgtaataattgtgatgctctaacttattttttatttaacaaacattattatttgcattctgaaaacaatgattacaggttatggtaaattattttagtttcctctagttaattattttacacagccgtactctactatatgaaaactgtgtaaaatattgacaaatttatctttgaaagatagaaatttaaatttttgtctttaaaagaaaaaaatacaataaattcatcaattcgttagcttttgtctgtcaatgaaagagtttacataatatatttaaggacgaatttgtccgtgctttacacatttaaggatgaatttgtgagcgttttacacaaaatataattcaatcttcatctccctttttttaatcatttcaagcataacattataataaatactaaaaaaatgaaagcaaacaaaagttagaataaacataataataagcataatattgattaatatttataatttttttattgctctaaaatttttattatgacaatattagatagtgacaaaattaagttgagtctcattttgttgtaaggcttaatttaatgattatgtattttaatttgcttgagtctcatattttggataaggtattgtctcatatttttgctttaaaaattttaatgtgacagtactttatccaaaatatgatactcaaacaaaaatgtaaaatcattaagttaatccttaaaaaaaataagacttaatttgattttgtcactacctaatgttgttacaacaaaacaacagacatattatacttatgaatcaatattgaacttattattatatttgttctatcttatatttgttttcctaattttttaagtgtttattgtatttttatacttgcaatgattaaaaagggagaagatgcatattaaatttttgaactgacaaattcgttcttgaatgtgtatagtgcttacaaattcatctttgaatatgtcgcgtatgttctttcaatgacggtaatagacaaaagttaacgaattgatgaatttgttacacttttttaacttttgaaaacaaaaattttaattttcatattttgatgacaaatttatcaacactctacacattagaaataaaaatgactatttaatctatattatattaatgattccgtgtatccgcacatgctgaatcccgatcagctggtttctttgtttgcaggtctgtattattaaatgcatacatagtttattcaacaacaaaaaatgcatacatagttaaagtcaaaatataaaagaaggttcatcattttaatacgagaaccacattttttacttttgtacagtgtgggatacggacgatggacccctttccttgctacgttttctgctaccactgccacatgccctcccaactttgatggatccggctcattgagttggtttatttgtcccgattccatcttattggtgcctttcttgctttatctttttgtttaatctgacatatatatatatatatatatatatatatataataacgcagtccggaggggaaaagataaatgagttgttatttgattttcatttttattttgttcttatttaactttagttattgattcttttgtttgtaaataacaccacaaaaaagttgcatagttaatgttggagtttttgtttaagagtttttgtttaaactctatgagttatgaataagaggcggttaacaattcaaaatagtaactacttataaccgctcttgggaaaggttagaaaaataactactcacaaccgctccgataaccaacggttacgatggtttatcgccaagagtcgcgatggttcatcgccaagagtcgcgatggtttactgacaactcttcaccagggttgtttgttgtctataaatagacacagagacagtcagaaaataggaaggagaaaggaaggagaaaggaaggaaaaaagaaggaagtagaaaactgatagttaacttttctgatagtctcgcttagacactagtgcatttcatatcacataactctgtggttcctcaagcattgtctttgttcgtttgggctgttgatttgaagtgccatcaatcttcagacgtgatccgttctatcctgtgagacaattgttcattaacctttggcatcaattggagggaacaaattgtcttaaggagacaacattgttgggctcggatcctttcatctctttgcatctgtttctgattcatacttatcatacaggttctatttaaattgttttttgtacagttgtagtagattatgttgttcctcttgactactcagattctgacccttgtgcaattggatatattccaattctaaattaactaatagttccaacagttaattaacaagtaaataacaccaacgaaagtaaatttgggcaaacgtaagcccatcagttgttaattgaaaataggctcttgtttgtacctctatttcattccggaatgcaaattacatttcggaaaggaacttttcagaaatcaaaattgcaggaagtacgatccctggaaaatacatacacttttgtcatgatattgggccaatatgagcccatgagttttcctttctaattttgcttctctttttaacattaaaaaaataatttatgcctattaagctcaacctcaatcttatgaagaaaaaacaagtttgggcctgtgtttgagcccaacgtgttcggtcaacaaacaaacagactaaaatagcaatggagattagagaccgcaattagagagtgcaagtggaaaattaaaattttaattcgcgattaggataaccagaaacttaacttgccctataaataacttacacaagaatgcctcagttttggggagtgaagtttttttcatccttttggcttttagtttcagtaactaattttattcaaaaaaaaatcttaagatttcattttatgctagaattttctgtttgttcctaattcctaatttaggttaaattcgtattttagtattgcataggataaatatttattaaaatagattagatattcgaaaggcaagtagaattaattatggaatttgataaattagaatatatgggaacaaacaaactgtggaattttgtattgacacgattgcttaattgaagtaaaaattattctgaagaaaaaagaaatagaacaagaactaattgtagtgtttagattatttttcaaatatttggctagaagagcatattttactccatggataaaaaacatttcatgaagattaagaggcatacggagcatgaggggtttttatcgttatggttggcaaggtttgttttacctacttgatacccagagtgactaaaacatagctctaacacattgttttagcaagtatttatggggatttatgtttactgatagtcaacaaaatcaaaattgccacaaatgtttattactttattcttttcttcacttttatatatagaccatgactatactatttaccttcacgacttttactttcaaaagtgacgtatctataatggtgaacacaaacaaagattccagttggtacggaggatttgagttgtgtggatggtttaaatggtaaaactcacatgatgcaatgatggacatgaaaatgataaagatgtaagaagtcttgaagtacaagatgaagaagctcaactctcttttggccaaggaaggtgggtggtcgcaactagagacccctaaattaaacaccaacatataggacccttgcataattaaacacctcttcgaagagaaacttaaattggggagtagaaaatgttggttgttcacttcaatactttctatttcccaaatgacacgattgaaaagatagaaaccttatgtgtaaaataatgttgcataaggataaatatatcatacgcaatattatcgtggattcgaaagtttgaatataatactctaaagactagttgttttcctaaataattcaaattacaagaacaaaataattttgggcgttttatcttgtgttgaaagtgtttcatcaattgtgtcaaagaaatataaatcaagctaagcaatagtttttaagaaaaatgtatgaataaagataagtccgaattatgaatttgcatgtaataattttttttccttattccaattttaattaaccctaagttaatgatttatcactttaagttaatcaataacctatggtcaagatttgaaaatactcttccccctaaattaattcacaattagtcatttggaatttaatttatgatcagaaatgaattatagaaatatttgaaaaaaagatattcatgccaccagtttgatcatgtaagttttatgaaccttatgattttacaagtcagttaatcatgagtaaatggtcactaacatgtaattaactatgaattagaatgatcaatttcaatgtaaaagagaaacaataaaaaatacgattaactgaattacattagagaactcaattaaatatgaaatcaaagtacatgggtacaagtacatcataattcaagctctaggggtttagccaatcatgttcacaatatagccaaacatcaaacaaaatagcattaagaataaaagagatcgaaaactcttacagattagaactctaattgttcctggtgcagctctagaattcagaaaatccttgttgtttaaaagtaataaaaatataacctaaaaatgtctccctttttttctatttatactattgacaattaaataacagcgccgaggtcgacaagggtcgtgctaagtcaacatgagttgtcctaaggacaacatggttgtggtcaaatgtgtgacattgattttgatttttggttctgaaacatcatgtgtcatgctattagtagtatggtcattcttggatatgtgaagttgattctgattttttgctctggaacatgggtcgtgctcaaatgtggggtgctaatgagaaattttcttggaaaatcaacataatcatgctggaatagcatgatatgtagatacaacacgggtcgtgctctttaaagaagatcataactatttcttttgaatttttttctcaatttatcatctttctttctcaattgttcacacttatctataagttcttataacaaaataaagtcaaaataggataaagtgggaaaaaaatgggattcaaacatagtcaaataacgatttatcaaaatcttggaagttttctcttttctcatcattatcacaccttttgcaagtatactaaattctgcaataattaattagtaagtaaatatatagttacaataagagcatctttagtggtagatctcaaattgggatcttagaccactttttggtagatcccatagtgtcatgtaggattgaagatctctcaagatctctcctattttgttctttaatggtagatcttattttgagatcttagagagagagaaagagaaaaaaaaattattttttttgaacaatatgcagatcttaagggttcttctacaagaactcattctccatattggagatctctctacatcctttattgggagatctagtgaagaccagatcttaagctcaagatccttactcaagatcttgcactaaagttgctctaaggatatgtgcaatatttaacaaatacacaatattcactatctagacgatcgaaaaatgtatttaatatgaacaaagttgaatgttataataatatatgcaaaacatcgatttttcaataaaaggacgattaatcactattttaggacattatgtttcgtaagaagaatgttatatgacctctttatgggagattggtaatatttttttatggaaaatgttggttattcatgtgaaacatgtttattgtctcctttggagagtttttagaagacgcaaggtaagattcaaaaacagtagcatgaagaggatcacatattatgttgtgatgtatattttacacttgcatacttcttattgtaatcaagccaatagggttattagttattagttatgatcgttggtgaattcaacgctaaatagtttaacttttcttcccgttatatataaatgtgtacccgttcaaattaatgaaataatcgaattcctaaaagaatatcttttaaggggtacacaatttactactaaatcctaatatttatataaatcttaccaattaattctatcattcaaaccactctaacgccagctctctgaagtctgatcagtcatttntatatcagcattctaagttttcattacttctatattattgccggttttttttttttttgtgcttttatttccttacctctcgaagcacaaaccaaagacatgagcatgttagcccgtggaaaggtttggtggtatacaaaatattgctcccttattttgagcatgtgagtctagattccatgagggatataagcaaatgaaaagcatagagcttttagctagaagccaatgaataaatacaaatctaacttcctttttcccattcagagagagacaagtcgagcacaaatggacaactgaaaccaatggaaggatgaactttttgtcatcggtacatgagaggatatatgaggagacactaaagtagctagtcctctttcacatactagctcgcagccttcaaaaaagagaaaattagtgcgtacaacaaaacaaggctaataagagcaatttaaggaggcatgcaactactaaaatccaaactttctttttgccttgtagtgctagtgcttgctagtgcaagaatgagatgattcagtagtggacaagttctttccattgccttttatgctggttatgtgctatgtgtttgtcatttctagctctagagaatgaccagccgatcccatggtttattccaaacggtttccttcaacttggattaatattatatagctatagcacacatgcacacatcctgcattttatatatgtgtcggtctattaaataatatttaataattaattactaattccttaaactccttcctttatccattgatcagtgatctatctctggtttagtttagctacatacaggcatggttacagaaaattaaataattatagccgtgcgagtccttaattatatatataggatacccacaaattaattataaatctaaatcaccacaataattattttggtgttacaaactacttgtgatctggctgtcacaaaccaatcatgtcaactacatgacatttatgttgtgaattgtgatataacaagtagctaaccctaattgatttaataaattcaatttaaaataaaaaaaattaaattataatgccaaatacttaattactaagttcctacttggaaaatgattttcttagataagtttgcaccaattaaaaatagaggatgcatttgcgaatgtgataaattatttcttttcacattttttaaagtgcaaaaataattcatagacacctgtatataaatctaaacccagaaatataaaggaatgaaacagaaaaatgtagataaaatataccacaatatgatatgatgagagaaaaaaaattaaaggatatatcaactaggtgtatgtaccgaataaatgtccatatatcattagtccttaaaataataataaaggaagagggaaataataaatataatgataacataataaaaaagagaggagacaaataaagaaaaatacaaggtcagtttaaaagttagtatttgaaacttgaaagagtagaatattgttatctataaaaaaaaaaaaagatttgaataaaaccaagtacaaacatgtatgtagatttttttcattttaaagtgcgtgcttgttaaattcattcaaaagttaaaaatcgatataagtgaaagtcgatcataactactaacttcttactaaacgtaaaaaattacatatataatgtgagattaaacagtaaagacatgatcagtcattaataaaattaatagatattttatagtgatattatgaagatatataaaagatacattaaaacaaagaatataaagttttaatattattattatttggtaggttgaagaacctaatttatactttaggaattaattgaagtggggtactagccagcgaatctggctgtgcagaagtcggaaaagggaacgatataaagaataaaacagaaattgtgtcagtacatgtgatacaactgtggccactagctagtgaaggtttggcatgggaagggatgcaaattgcaatggaagaggtagagtagagagagacaaaggcaaatgaaaatgaaacagaggcccgtgaagggtgtgagtgatatgcatgcatgtatgcctcattggcagtcactgatattatttctgactgagaaagaccatcctctcttattgtccattggttcagttcccacatcccttcccatgcaaattttaacagtctcctaatcaagaatatgacaactatatcatccacctttttatgctcccccttgttcagtttctgtgattcgtaccaatccctttcaccaactgtgctgtgtggtgataagggctttgtatctagcacattgagaaatgagaaataaagtagtgtttacttggcttagcttttttcatttacaatgcaggtacatatatctcgagaagggatgtcacttaaatcatgaaaatctattttactatgccatgaatttggtggttcaaaataaaatgaaacatatactttcaataatcagttaatctcgatcgggagtatgataaaataaaatgagataagcgaaataaagaaattaaaacagaataaaaatactattaacatactcaactccatgtgtttaaagaatttaaggtattagtcacttgtgttatattttatggattttcttttattaaagattatcactcattgcttgtaaatgagaaatttatgactactgattctgtgctaatgaaaatcccatcatttcaaagagtagaagtgtacgtataaaactataaatcattataaaccttgaataatttttatcaaccttaattttttatgttcttggctcttctttttttaatatttttcaataaaaactatacattccaatataaatttataaaaaataatttaagtaggcatttcaattacgtttaataatttaaaaataattttattaaaattgattttactcaacaaaatttagtttttacacctatgttatgtgacttatgtctctttgtctctccactttttttatcattcacagtctcgtcagtggctttctttttcccatgtcactacgtgtaataggtgtggaggtgtcagctagtctttatccaaattttaatttgggttcttatcaaagtagaaatggactatttttatgaattcgaaaatggcaagaatccaagacacatcactccattcaccagctataaataccctgccaaagttaagtactcacaaatcacaatataacattcacattcactagagaggaagataaagttatataaaaaatactgctttacagaggagatggcttgcagggtgcagaaaaggatttcactgcgcagaaaacttcacattgtgcgagtccttacctactcaaactctgtaatgctatctaacaccatctattgcaacctcaatttctttcccatggtctcaaattgataataactatttttcatgcaatgaagtaattgtttctgttttgttttgaaggccaagagaatctcccttgccaagagtaccgttctacgcttatacaagctaaagctcgcactggaaactgtcaaaagacagtatgaaaacctattagccaccagaagagactgcattagcctattgaaccatgtcaaagagaacaaggtatgcttattctcctaacctttcctcaaaggcacacattaaaaacaaggcctatatatagaaatgaaaatatcctatcatgaataacatgttagagattagaggttgactagtgatatgatgaaaatagtacatacaagtgaaagtccaccattagctattttagaatttaggtttgaatctgatttaattttaatagttaacttataaggtgaaaattgtctctattatatgcattattattttgattatatcaccagttaactgaattcgagctattttaaaattttagtttgagcttgatgaattcaattctaaaagttaactaatagagtaagagttgtccttatttatattgcattattttgatcatatcagtagttaacagaacatctttatgcttatgatagctaacatgatattgaatatttcttatatatttaatgttccaattaaatgaaacaggatgtgaaaatagagaatgtaggggcaggaacttttatggtgaggatcacatgcgagaaacgaggtgacaatctggtgtctattttagaggcatttgatgagatgtgtctgaatgttcaacaagcgagagtgtcatgtgaaaatggtttttctctggaagccattgctgtggctgagaaccaaacgctggatgtaagagacattactgaagcgcttctaaaagctattggaaagcagagtggtgaaaaggactcgcagaagtttgacaaaggctgtgatttgtaacttttttaagtactttaatttgttcaacatcttgtgtatctcaaactagttaataccaatgtcaagttcatcttttatataaatcatattggtgacatgggaggggaaaaaggttgagtaaggctttccattatcaagattatatagtgtgtttggggtggcagcacagtggaaaaagaaatcgtggccaattccacggtggagccacagcaacacataattgcttctcaaaattcacggtgacaccatttttttgttcgaaaattgattatgcgccgccgtatctaaacacatgatcattttcctactttaaaatgttgattcctaaccaaatagagtggttgagtatgagagattgacttattgatttacctatcgtgccttttgccaatgcacacaaaatatttcttaacaaacggatcatgaattcgtgttcataattcacatttttcatatactaacttgtaggagaattagatatcaatttgttaacttctgttgtgaatttctgtgtttttatttttttgctgatcttaagctataaatatctagaatttgctttgtaactcgcctaatctgaggtgaagtgagtagagatccatttagaggagataaagctctttctgtgtcaatttttttttcattaaaattcctttgaaaccagattttagactaaaattttccttcatatataaagtgcgagggaattagagaaacaacagtgtttagttaaattgatttttgggatgaacgaaatagagtggagtgatgtaggagagatgttttatagggaaaataacaagacaacagcataaatacaatagcacaacatgcaagtgaaaaataaatccctcccaatttataagaatttggaaataacaacaacaaacaaatagctggagacaaaagaacacaaatatacaagaaaaattaacaatacaaaggtaaaaatcaaaagccattcaaaccaaaaataattctacaatgttcaaataaaaataccaataagtctcaaaaagggttacaaattgtacgtttataatcggctaaatatatgtcaatgcttacaaatgagaaattacccaaaaaacagttattatgcaattcaagctcttgaatatgcaaacatagttacctcaatccccagtccaaattctgaaaaacaagaataacgtgtcttgaatctattgctcaaattttaaccaaattcaatgacaaaagaatcaattttatggtgactattgggtgcttatgagagttttcttttcccttttttccccctcttttattggttgttttttctcttgaaaataagtctctacatccttaacatgaaccatcttctctttttgataaaagtaactgcgtttattattttgacttacaaggtagaattgaaagtgattacgagaaaattgaatctaatccaaatacattctagttcacatttataattgtcctttcattcctcatgttacactcatgttggggtacttaaattaactaattatatattcaactggttatacctaattgtaataaattatatataaaattaattatgattataattataatgagaatttagagcatctttaatgaaaaatagttatatggattttttagaatttcttattatctttttgtgatttttatagtgtcatgtcactcataagatttcttacaaaattttactctaatacaaaaaattataacttcaaaaaatggtggtgtttgaaaaataaaaaacgggataaatgattttttctattaaaaacctaaattttttctaagaaataacttcttatttttagaaatccaccgaacatctctcattatatgcccttataatctaactatttattagttatggttatcgttatttgataatcaatcatgagcatccctacactctagctttcagtcatttctcagttatagacgggtgtggattagctgcagtcggaattaaaaaggaagctcaatctctacacttaatcagttaatcttattattcaacccttacaaagctaatcaaaaagaaaaaattgtaatccttgtatcgtaactgcagagtgaactcactcaactgtgggaaagttaactgcaaggaaaatgtttatgctaagagagataaaaaagaaaaaatggaataaaagtgaaatagaagaaaatttaaacttattatcttctccgcccatttccatttcctatacactgttatctttatttcttatttattttgttaaggtctgtgagcactgctcatacttcgtatgttctcttgttgtactttgggttgggccgagaggtataagtcttgtaggggtgccaactttttttatttaactacccatgcataatgcatgtacatgttgggcatgtacatgttgggacggccaagcttcgacatctttttgtataagtcttttgttccaattttgcctttaatttcccataattatttgtctcaagtcttaacaaaaagagagagagagcgcgcactgagcaagacatcttttacgactgcatatatccgttgatgacgggaatggatgatattataaaattatatactcattattttttgaagagtatatactcattattattacagctgctgataataactatatacttatattataaattttatatcactaaatttacaatataagatataacttcttatgggctaaaatatacaaatgactctttaatttatttttttagttctaaattgatcctttaacgttactttttttttgaaatagttctcttacttatttaatttataataagttaatcatttcaaaaaattgttattttttaatttttgaacacaattttaaacttttttattaatcaatacatgaaatttgttcattatatttatctacataaaaattattatgaaaatcaactaatgtttggacaaaaacagacataaacaaaatgaaaaatacaaatacataaaaattaaatcttatgattaattgaaaatctaaaaatcaaatattatatttttttattatttatgagactaatttgtcacgtgatttttaatatatttatgactttttatattttgaatattagttgattctcataatatttatgtagttgaatataatggaataaatttcatgtattaagtaaataaataaaaagatataaaattatattcaaaaatttaaaatgataaattttatgaaaagactaatttatcattaattaaataattaaaaatttaaaaattttaaaaattaagaaactaatttaaaacaaaaaatagcatgaaaaattgattttatattcctatctaatttatgagtatataacatatatttttaagggacaagaatttaatgatgataaacatataaaatatattatcattaaatgtctgtcacttaaaagacatgtttcttatagtattattgataaatgagtaaaaaattattgtaatttaacattgaagaacatttcaattttaaattttttatttgaattatctttgacagggttgagagcttagattaaaaaaaatagtaatgttcacgttatcgtatttatggaaaaactgaaatcaaacgaatcaataataccggtggaaaaatcttcaaatttaatgcgacttacaggttacacgaatcatgattctacagggcatgtgagttacattcaattggtttggtacaaagtcaatgagcatggggatcatcaaattggcattattctttgaaaactcgaacaatacacacttggaggattgaggatatcatttactattaattaatttatactacatggcttcaataaaaagaaaaaaaggaaataattttcccaaggaagcaaaacaatcaagcaacctttgtcaaagtttagcttaggaaaaggacaaaaatgaaaaatgttcagcgtgtggaagtgagatgttttgatgcctcgtctagttcagccagtaatttatttaaaggtagcaaatacttacccatccatatttaaattattaatttgataaatgaagaaataaaggtgttaatcaaaatgttgtaattgatgcataaaaatgcggtagaattaagtgggaaattatatccagttaattttagaattttcattgtttacatatttataaaagattaccccgtacaaagagagggttaaattcaataaaaaaaatgtagttaaaattttgaatttaatacatttttttgtatacatatatagagattttaattttatgaaatgttagcataaacttttaacatcatctactaattatgataagtgtgattatatttttaagttaattatgataaaaatcaataaacttacttacaagtgcaatcagatgataatgtaacaagtttttatactatcaatagatttactatttattcaagtgagaaatgaaacttataaatctgtcatataattaattaaggggtttgaaaaatgaaacgaataaatggagaaatttctgtttcttggaaggtggcggtgacatcatgatgagccattttacagggcaaaataatatactgtagtagtaatgctaaacgatcacatcaacaacaaaaataaaagttagaaattcacatgaacttaaggataattgttgtataaatataaactactccattaaatgtctatattatgagtcataagtaggccttcgattattttggaaagaagatttagattatctcacgatcttttgtaaaataaacaaaagcgaaaatatataagatatccagagaaggtagtatataataagaaagaaatttatggtggagaataatgtgcatcactaatgccgtaaggaaaggaagtcaaaatttggggaacaagaaacctatcaaatacattattttttcccccgactcatttgtagattgatatagttattatttttctgacaaaatgtagaaaataaaaatggattgaacgagtttcacaatataaaatttgggttgctggagataataaatgatcaataatataaaaccagttgttgcattgcttcacgcttttaggcaccttagaaaattgatttgttttctggtctttgatattttttatgtaacatattggccaataggtacttccattccctttcacattacagagcgacagatccagccataagtgactcggtcaaaactcaaaactaatgggatctgaatattaaatgatacgtcatgacaaaaatgaaaatgttatttaaacttttcgatagctacccattctctagaatttagatacaaaataaatgtgatcatataatcatcaataaataattaaaggtatattaaacaattttgggggtggtgaccgttgtttagctcagttttgttgtttttcttccttttccccctatcctactaattaacaaatgattaattagttatatagttgcaatatgaaaactgaaaagtggatctgaactaagaatatcccttttatgtattttctcataattctttaatataattaaatctaattaatttcattcatatttaatgatattattaatattccttaaacatctttcatttaattataactttattttcaaggactttattttattattgatatcaaattttaataaaggatgttttagaaataatcttatttcctacttaacatttataaaatgaaattatttcaactaatcttcttaatttatataaaaataattatttttatttaaatatataagtccagagagaataatatgtaatcttatatacaacccattcataatagctttagctaatgagctctttatatatagtaattttttctttatgcattttttaacaagatggagagaaagactattaaaatacaccaatagatataaaaaatgtaccaattaatgtggtgaaaattgtgagacttaaggagagatagtagattatcaagtgagtgtccaaaatgatcttctcattgtaccactaagttggaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcaattgttaaagaacattttattttgtttttattgtcgtttattcgcattgatgtaaaactccacacatatgtcagaaaaaaaaaatcattcttgatccccttattctttttcgtttattcgcactgatctaaaagtccacacatatgaaaaaaaatcgtccttgatatctttattcttctttcatgatctattttctctttaagattttatgtatacgtctctaacttattacatatatgctcataatcaattctcatgtgtgagaaatcaatatttttatgttttattgagtcttataataaaattataacctttagtcatttgtgagtatattttaatcaattatttttccctatttatgatttgctcattggcatccaacataatcaattgaggtttttagagagaattttttcattattgagaattgattttccaggttagacaatcaattctaaagtgtggtatgcatacttgattgtttattgttagagctattatcttattatctttgatctcattactctcctcttttttcatagtaaaccaaggacaatgctaccgtagaccatctttataagtggtctaaagtgcacaatttttattcatggctagattcatctaatcctcactaatatagcatgcacctttcacacggaattattctctccctaattagaaactctccaccgctgaagactccattatcgttgtgtatttcttagaaacagaaactcctcctccaccatcagccgcaccgcgcgcctctgccattgtcgcagtccactgcctttgcctcctagaaaacaccgcatgcatagtgtgttaaataaatcattcaaatgttcaaaaaaatccaaaatagaatgcttcacttgaaaacatcatacaaaatctgaggggaacaggaatctccaaaaactatagataatataatttcaccttaacagaatcccacaaagcaagagaaaaaagagaagacaaatcatgaacatgtgtagcacagtgggttggaacatatcgatgtaaagtagtaaacttttaccaaatagattacacagcttttgaatttccggtttctaatttctgattgaagcaaccatcatgaaatggaaatgatagcaaaatttatcaattgggtttcaaatatggtaataaaaaaatatgggttgtttgggtttaagattaaatgaccgaagaggtatatgatattgttgaagaaggccaagtggaggaggtgtccatggagggatgcagggagatggggaggtttctgtgtttgttcgtgaatgtgactatgtgaggatgacgaaggggccgaaagtgaaggatgcgagagaggccaggagttctacgagtaggttgtgcgtttcaatctggtggatttcctgaacaactgaggattccgacttgcggtggttccaaccaagatttgaggttgcaacgtcgttcccgatgctagactattgtgtataataacttgtgttacttaaattaatccaaaggtcgtaaataatgatacataatgaatcacctattaaggtggttcaccctataattctcaaggtgagaagaagttttaatattttctcttcccaattccactcctgtattcctcaactcaaaattcaactttttatttatttatctcttttccattcttctctttcttattttcactaatcttatttttctgtgttgtgccaaacagagttagtgagagtttttttttttttttcatacttaaaatttgaattcaaaactatctttaaaagaaattagacatgtatggtacatgaccaagtactggttaactaatgataatgcaatacataatataattaatttaattattattacatttaccacagaaaaggttctcgttggtttggctaaaggaagcttaacgcgagaacaatttcaaagtaggatatttcattggaaaagaaagccagttttgttcctcccctctgcctctttcctctccagcccttttatgtttggtgaaaagtttggcacctttattaatttctatatagtttaagtataagttttattcataaaacaatgatattacattcgtcccaaaataaatgccacgaatggaaaaaaaattatcttaaaataaaagtctcatggatttttaatataatattaattattctttttcactcatatctaatatatatgttattttagtttttgaatttaaatattaatattattttatttcatctatttaataagattaattttgtaaaataattaatcttaaatgacacttattttagatgaatcgatggaatactttttttaatttaaatctttatataaataattctttatatttaactccctaaaaattgctgataaaaaaatccctaaaaattatataaaaaaatatatgattttaatctccaatgagaaaccagtatttttaacattttgttaaatataatattttaaaacaaatatttcttttggtaatttttttttttaaaaaaaaaacttatttttgatgtatagccttcgcacttggagtatggaacttgtacctttttggtttttcaccctgtttttgacggaaatggattacttgtattcaggcattcatgaatatagaccgtctgatttaatcagacgattagtattttaaaagtgtttttaaaatgaaatttattaaaataatttaagaattgttagatttccatcaaacaattttagtcgtctcactgcgtacgtgaatgtgtgttcttccgacagaaaaaatctggatccgtttttaactagcacgacataaaacgcttcaattatcatcttcgttatatattatataataatatgaagaagatgcaccattccatccataacaacccagttaattaattaaaattgaggagttaatactgcgtacactatatatgtaagcaaaagtagatcgactaagttgtgtttgaaagggtgccccagatatgacaaaaaagggtagacttagttccattaaactaatgaatgggcttatcctcaaggaaatttcacataaaataacgactaaagaaatcatggggttgctttcaaatgacatattcatatataaattagcgtttgttcggatatgatgaagtatttgctctcccgtcccctaataaacaaaagaccaagccaatctgtcaacacacgaagcccccgtttttaaaggggcaccccaccttctctctcctccttccccctttaatttccttttccttcttaattgtcttaatttccttgtattctggtaatctagctaacccttttttttcccattagccatagtcatcaccatcgccaccttctaggtgggatccaggggtcaatatataatatcacactcaacacagttaccagctccaaatctcaagaaatggatagcaagttcagaaaaaacaaccacaacgttaactcatataccagtgaacaagatcaagacactgatatagctcaagaaaacattgccgagtcccctccttcttccactgtgttcaacatcgatggcttagtcccctcccccacttcttcatcaaagagaaggttagtactccttagtctttcttgctatctacatatatacctaattaccttccgtttaaaatcgaaacattacatataaggaaattaattctaggaacgaattcacaaaggaacaacaacgatatgagaaattgcatatactctccaaaatttaagattttggtattgatattgagaaattctctcttcttctttcttttattagtttgtaaacttattcaactattggatcaaaaactcttagatttctctagtgtaaaatgacaattcttgatatgagcaattctatacttctaacaacacctcgctagttagtgtgtatatatagctatggaattttgaaagggtaatattgatgggaattggttatgttgaaataagcaggagggcaatacagaaaagggtggtgcaaatcccaatgaaggagacagaagggtgtaggctaaaaggagagagcaacgccccaccctcggattcatgggcatggagaaagtatggccagaaacccatcaagggttccccttatcccaggtaattatataattccattgcattgcaacaacacgtttggttattttaaggttaatttgtgaacatatataaccgacgacaagaaactatttgctggttcgttaatttgattagtgaaagtggttgttgtttatgactcagagggtactacaggtgtagcagttcgaaggggtgtccggcacggaaacaggtggaaaggagcggcgtggaccccacaatgctagtcgtcacttactcctccgaccacaaccatccctggccaccttctagaaaccacgccaggcccaccaaaaaacctgaaccgggacccgaaccggtttcggatccggtcgaaccggacgagaagttcgcggacgagtccatggtaacaaccgcggaggaattggggtggctgggggagatggaagcgacgtcgtccacggttctagaaagcccgattatggccacgacgtaccatgctgacgtggcgctgattccgatgagggaggaggacgagtcgctcttcgccgacctcggagagctgcctgagtgctcggtagtgttccggcaggggctgctggcggagcggcggcggtacacggcgccgtggtgtgggaccacaagttgagggcaaaaaagtcaacacgaaaagaaaaaaattacaaaaactagaggtgcctgtttgacacgttcttcgtgcgccacaagagaaaaagataccagcatttttttttctagtattgagatatttttaatttttttttacttatcagtgttttcaagacattaattaaaaattataaaatatttaaaataaaattataaaaatattttaaaaaatatgaataatattatttgatgtatttgaataaaaataatttttcttttaatttttaactaatatcctaaatagcggtagcctttacctatatttgacttaattgagagtagaaaaaaaggaaaatagaagaagtagggttggggaggagtgagagtggtagtaaagttgtaattagcgtaactttgggcgtccatttcaagagcttgcattccacaatgtttgagaaagaaacaagaaatttgactggacccctatccccatctcttcttcttcatagaacaacatattagtaatgcgccgatactattaaatgccaaccaatggccataatcaacaaaatgttcgtttaaattgataacgatattaacaacacaaattctagtacgtaacaaactttttcttttttactactaaaactgatacaatggaatatccgacctcaaattaaagtgatagagaatgggttcgtttaaatttaaatggtcagaatgttatttattcgatcaatcccaaccaactcaattaaggttgagttgaaatggtttcgattgcttagaaaaaagagagtaaaattaacccaatttaattatatttaattgaattaagttataaaataatttaaacttgattcaattcaataaatgtgattggaagagaagaattatactaaaaatgattaatcattttttttcatttgaaattatcattgataaatattttgtaacaatgctaaaaactttattcaaatattcaaattatttacacctttattttttatgagtttttattattaataatattttaaaatttatcatcactctttgaaccccccaccccaccccacacacatataagagacaatcgtactgtcacatttggcaaaaaaatatacctaaatgttactcgcacagtaaattttaccaaattgtcacacggcataatttgcttgtcagtccaacgaactaggtgatagacacgtgtcagataggtagcaattcgctgggaagcctagcgaattaggtggacacgtggcagacaggtagtaattcgctggggaacccagcgaattacgtggcaatggaaaaaaaatgtcaaaaacttcgaacggttataacttttgataagaatgtccgatttaagtgtaggatatgtcaaaacgctcaaaatttagaggggaagccttgggcaactacccaaaagggagttggtctaccattttttttccaaaaaatacctctaagtgccttaaaattaagatttaagattaggatgtgtcctttaaatggtctaacttttgatagaaatgtccgattgatgcgtacgatatgtcaaaatgctcgcctctgaattttgagtattttgacatatcgtacgcctcaatcggacatttctatcaaaagttagaccatttaaaggacacatcgtaatcttaaatcttaattttgaggcacttagaggagtttttttggaaaaaatggcggaccaaccccagggcttcccctctgaatttcgaactttttgacatatcgtacacctcaatcggacattttctatcaaaagttagaccatttaaaggatacattgtaatcttaaatcataattttgaggcacttagagaagtttttttggaaaaaatggcagaccaactcccctttggatagttgcccagggcttccgctctgaatttcgagcgttttgacatatcatacgcctcaatcggacattcttatcaaaagttatgaccgttcgaaatttttgacatttttttttccattgccacgtaattcgctgggctccctagcgaattactacctatctgccacgtgtccacctaattcgctgggctccccaataattacccagcgaattactacctatttgacacatgtccatctaattcgctgggctgcccagcgaattactacctgtctgtcacgtgtccacctaatttgttggactccccagttcagcgaattaccccctaactgccacatgcccatcacttagttcgctggactgacaagcgaattatgttgtgtgacagtctgataaaatttactttgcgcatggtatttaggtatattttattgtcaaacgtagcagtacgatcgttgtctccacatataaagcgtgaaattaagctgattttttttttaaaaaaaatctaatatgaagagattttaagatagatttgtcttctttaaatgagttatctttaaaaaaattccttataatggtttccctctctatgagttatttgagtttctctttattttagtaactatggaaatggtaatttattccaattgactaaaaaaaatatcatttccatggttactgtttttttagtggtttaattaaaacttagaacaagaagacgttataaatttaattttttgtttgtaaatgtaatatatgattttttatttattagttttgttgataattaatctttgttataactcaaatccaatatcttacttaaagaaaagaaatatagtttcattaaaatcaaggatatatatgttagttaatatttgattttaccaagtaggactcagttaataatccaattatctaaggtttagttatcagtgtaaaaaagagggaggcaaaaaagatggaatattatataaaaaaggaaaagtaaagagattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagacaaaaaagattaacgatttaaaatctgaactgtaaaatttgcatgaatatatgtgagtggtatagtataatcattggataaatcgtaatattgcatacattaaaaataaattgagtttaactcaactaactctaaaaattagtttaaaaaggaaagtttgtccaagtcttagaaaaactactttgatttttttatttgatgacgtatgatcttaacattttaatttcagttcaaagttgtgccaaagactttgataattattatatctatctttttctaccttttcattgataattattctaaactctcgtaatactcaaatcgttattaagtgtctatttatatttactgccaaactttgttgttattttttaggtaaagagtttaatgcagatgtagaagttaaaaaacacaaagtgttagcaaattcgaatatcaatattttgttttgattattgtttcaaataatcaataagtatgaaactatcagctttatttaagaaaaaaatgaaaaatgaaaatataaaataataaaaaaattatttttattatttgctttatatgcgagtgaaattaaagaatagcatgaaataaaaaaaaaattataaaatattttctctagctaaccaaattatagaatctcttgtctttttcctttttcctttccctcatgcctcgagatagagccacgagggcctatcatctggcctcatatataacaagctgggggttattgatttgcattaaaaagtattaattaaggaatatatatatatatatatatatatatatatatatatatataaagaatgactttcagcatttttaactgaaaaagtgtttttttcgtttggatgaacatttttttttcagttaaaaatgctgcttttgcaaagtattctttaatatttaattgcacttggaagactttaataagaataaaaaaaaaaaaacaaattaggtgccttttcgcctacagttccgtgtttataaaatattttttctttacagcacgcattaaaattcccttaaaatatataatcactttataaatttacattcaaaattgtggttttcttttttaaattgctaactcaaaccagccaatttgagacgtgtgtgtgcgcgtgtgtctttttttaaaagcattttatttatattttaatatgtttttattatacaagcatattttttgaattctcgttgttctaaaaatttaaagagtacccctttttttataacagtaaaactgttgaaccattaaaatattacatcgttttactatttcatttaacatcatcacatggtatacaataatataaggggacaagtttgtcacgttgttaagagaaatctttacaacctcccaatgtaagaacatataacagttggtataaaatttatttattcttagatggataactcataacttcacttcacatgcatggattaaaaactttgaattttgaacactatcagattcaggagatgcccccaatattactacagattttttggttaaaagaggtgcatgtttttattattattattattattattattattattattattattattattattattacccagtttgacctcccacacttctactttatttgttatcttgtttttttaagctctcctcccccttttattattattattattattattattattattattattattattattattagggtatgaaatatatttttatatgaaccaataaggataaggatagcattttctaaaagtggatagcgtcctttattttggttaaaaatagaattattttcgtgtaggaagtgcgggaggtcaaaagtggagagcatttattagcattaaaaanattattattattattattattattattattattattattattattattattattattattcgtgaacgttttctaggacaggcttagttcattcaatcaaagaaaaatcaaatttgcatggaacttgactagaaatagaaaatgataagaccattaccattaacaatgattaattaaaaaatataagtatattctatttttgattaataattaagatttgataaaaatatatgtattaatgtaataaatttaaaattattaaacattaaccgtttaatttaattaataattataatttcactttattatgcagtcctcgctgtcatctatttttcctttcctgacaggcccatgtgattatagcccgttctatgaatagagatagggagttactatttgcacaagcacaactgctaatggaactacccacatggatatcttttcactttatttcaaaattacccttttgacaaaaacacaatggaaatgtgattgcctttttattatgattcaattacgttattttttattcaaatacgaacgaaattccattgagaagttcaaaatttttaaaataatagaattacaatttcattggctaaaaatcttaaaatgttcttactaagtctataaatgagagaagaaaagagaaggattggggatataggaaactcagaaggataggatgatcattcctacattcttggtactgccataaaaaattgtagtagtgacaatagcaacgcccattgaaatatgaccttagtttcgaaggcccaacattatccttatccttagtaggatggtagcccattttctaaaagtggatagcatattatgattggcattgcaatagtgtttaatgatcatactctctgaaaatatacaatatttcataccctaataatataaaacattttaattataatttaattacaaattattggtaatataatttttagaattattatcataaaaaattaataaatgtactataaatgataaattataattaaatgatagtgtaaaactttttataagtatataattgtttttctcttgcaatattagctatcttttttatgatactttttatatttctttcgcacagtgattgacaatcatcagtccatcacattaagaatttttataaaaaaaaattcctaaatttccattcaaaattttaattcaattttattttttaaaattaaaaaaaaaattgcataggaaatcatattaaatccgacataaggtcatttcatcattcctttcaacctttctctttatgtttcgtcattgaaatttttggcgacgaagggagggaaatcctaaacccaaattgccaaacagaaccaattcagaggcatcattcttaaccatcattattgacacccgggaagttagtgaaatgatgataaaattttctgcgtgtaaggtttctacttctaggatgctgatacttcatgttcatttcctcattttttacctaaaagatgaaaacagaatctgacattttaaccctgatagaataaataaagagcagagttagctccccatattacgcacataaacataagtacaaagggaagaaaaccaaaggaaaaacgaattaaacttttcccatgcgattttacatcttccaccaagggaaaacagtgtgtataaagttaaatatttcatataataaagaaaagctgaaaacataaatacggattagttactggcttgagttgtcagcatttttggtcaaattttcaaccccatgtgcattctttaaaatcattcaataaataaacacgtcgtcttcattccatcttaattccatgtttataaattactcaaacaattcagccgaacatgcacaaaatttcaaatattattttaacataatacctaacatgtatgcatatgaaatataggtatgcgcaaacgggtgtcccagaaatgattagcctcatagtcacatctacacatgcttctgttctcactagcaagtaccaaccgatatggaaaagctttaggataacccacttagtagggccaggccaaattgagtttttgttcattcattacttctaggaacttcttctcagacaaaacttagatacaattctgcatgaaattttagtattgtttttcaataaagagaaatgctaccgaaattttaccatagtaactaatgtaaatttgaacattaattctaattggagaacaacattaaaaacatctaacgaagtatatataggttttttttttatcttatatttaaatgcaagttctaataccaaacaaactgaacacttggcattgaaacaccaaagaatctcaatatctcatattatggtgatcacgacctatctatgattgcatagagccatacacgtccttgtcacacttcccaacttctgcatcattagcccctcataagatttgtctccatttcaaatgctacatcactcccaccctgtattctcactatctcacatacaccacattggcgtgttatcaacaacaatatcattcaaatttttcttttaccatcatcactcataatatatgtcagagtgaaatgctagctaaaaccaacgtgccccatgagaccttatctccacagaagattaaagtccaacatgttccaaagtgtgtgtccgataggttgctagagaagttctatgacgagtcagagttcgattttgattatgagcaaagtcggttgtggtctcctccagttccacgcacggtgttcttgagctcaccgggaagaatattcactgagcaagaaatgcttgaaagactcagaagcaaaaatgcaccaagacgtggcaaaagattccgagtttgtttcagtgtacaatgataatacttcttgcttctctttccctgttccattggttcctctgcttctttcatattttgcactgaaaaattctatacctttattccttttgcaggtgttctgttgtgcctgacactgaatgtaaacaaaagtgggtaggtttttcagcaatgtttcttgttttagaatacaaagggaattaatccaaaaatttcctatgattgttttatcatattcacaggaatttacatgtatttcttttctttttctctagccaaaagtcacgtatatctgtgaatttatatatatatatatatatatatatatatatatataccaattatccatagactcctttagaaacaagttatttttaaattcgaattcattattaacaaattatcaagacacaactttatcattatattaagatactacaacttaaaatgtttttaatttgttaaaatccattttctttttcactttcgaaagatactaagatgaaagatgactagaaaacacttttgtttgggtcttttccccagcttcgggaaatcatgtttttctcaagacaacttggatattggaatagctagtggagcatcgaattttgtgcctacgtcataaaatgtttacaacctagactagcgtaaattatcggagaaaaaatattaaaaaaaatgagggaaatgtagctttgcatttgctaatgttaatgttcttctattctttctctaattaaatttttatatacacaaccttttttctttaataacataaagatatttaacaaattctaatagaagattatagagattattcataaatgataaaattaagggtgtaaatgatttggattgagttgagtagaatataatttaagactcaatctaataaaatataattaggatggattgagtttgttatttttttattaagtaaccaaaacccaatcaaccttattttaattgcaaattgggttaactaattaaaatatattttttatccttatacaattgacaatgtttgaattttgtctttataaaaaatttcatttgttttcatcttcatgaaatcatgtttcattttttaacccaaagtaaaattcaattatatttgaatatatgatgataattttttacatcaattatgcatataatcaatataaatgtaacattttttatattgattatatgcataattgatgtaaaaaattatcatcatatattcaaatataattgaattttacaatgtaacattttttatattgattattcatataacctatttaaatataacatttattacatttattatacatgtaatcaatataaaaaagttatacacatagatatgggtatcataaataaaaaataacattataatttataaaaacaaaaacggatgaaaaactttactgagacgaagtcctaactttatcaattttgtaaggaaagaaaacattttaatgataaaaacatatcgaacatgaaaagatatgttttattaacaaaaacacatcccaagtgaaagagaccggtaaacaacccaaaatacgaggagctagagatgttataaattaatttggaatgatccaatttccactccaatctggagtcataaaatccttacagatattaaggaaaaggagattatcagagtaattaagaaggaacagcaacacattattgaataatttcaaacaatttgtataagcgctgtcctcggtccggtaaccaatccacgtgcctgtattctgtagcactggatgctcaccaacctctccacatggcatgctctcaacacattttttctgataacatacaaaacagatctgtatttaaaagaaactagttgtgatactaaaaaaacaatattcaatgcaaatcagtgtgtgatagtaaaaaaactagttgtctaatattatttgagatgtgataccaaaaacatctaaagaactgtatattctcaataatatacatacgtcagtgtcaaaacaaagtactttcaaaacagtgtctcctttcctaggatgcagttttgttgtttttctgaatgattaaaaaaaaaaaagttactttcaaaagtgtgttgtgtggattttgattttgattttgaccacgatgaccataataataataataatatacagttaggcttgtctaactccatgtcttcctgtaattctcattcctctcatcagctgagagatgtaaaccaaaaactgttacatgaaaaagaaaacgatagttctatcttcttacggtctgaatataaaaattgtttgcatccctatttgatagaaggaaaaggactcatgtttggagacaggatatacatgcagattgtaagatatagttcatatctaactcatagatttgtcaagtttagttctctttagatcaaagactgtacaggtctcaaggtaactctcacatcctcaacattcatagttgaactaaacagaaacagggttttgttggagagcttccttcccagtaatgccttcttttaaatttttaaaatatacgtcatagtccttttctggaggagggtttgctggatccacagtgaatggctcactaaatggaatgacacttttgacctgcaatacatattagagattgtgtaactagcttgcaaaatagaatgagactatccgcaatcaaattactagatccatgaacacggataaacaatttatctcaatcttaaaccattacatgcagttaacccgtataaaatccgatgtgcactataattgtggtgtttcataaatagaagcagaaacagcatattcaataaaaggctaatatcactattcgagccaaagccaggaaggagcaggcttctcctctccacaaaggaggtcaccggttcaagagaaattcacattacatttagaaaacgtaaaaatactaaacaaattctgaaaaaaatatgaaatagtaagagaaaaggctgacctcaaatgttttgtcacatgcataagggctatcaagcgcagctacacacataagagcaatctcttcccttgatattttaccctgttaagctttgtattagattggcatttggaaaaatgagaaaaatgctactatatagttaccatgaattgccataagaaatcaagaagtggaaatatatcatgagataggtagtttagtaagagcacttgaaccgggaaaagcatccatcttttgttttcacaataccgtaatattatctccttgatcaaaaataagatcggcaccagcaggctcctcagttaatgcacaaggcctcacgattacatagggaatgccactttctctaagtaaatcctcgccctgttacaacataaaccacttttagcaaatgaacaagtatgtgacagggaaatataaattgcataactaaataggctatggcaagcaataaggaggttcctttagacactcttaatagagaatgaatacttcttttttataaacttgaatgacaagggaaaaaatttcatagtcaacagccactctaaaactatagcaaaactccaatcgttgagtgttgacataataactataggcacgggtggaaatgggatgagtaaactagaaggcttaagtcggaccaatttacttaatataagtctttttattaaagcctagcttggtctttataaagcttggcctgacctgaagcctaatttatatagtctatttttgcagtaaagtcttaaccaagaaaaatagttttgcagaccaaaatgaccgtgatagacatcaattttctgcaaactggagaccttaaaatctagtaatacatccatgttaaataaggatccatcatcagattttacctttagtttaaatgtgaggatataatccagttccttgtttaatcgaacggcaggaggctgtttacttagatctagtccaggcctttcgggtcttgtaactcctgctgagctcacatgtacaaacctaaatgtgacacaaaggtgtataacaaaagatttagtatatcagggtaaacaatggaggggaaagaagcacaaagataaggctatacctgggggttattgaatcctttattatatatgcatgtatgctagacactggaagctcaaatggaccttccacaaaagtttcatttaatttaccatcatactcaaacttgctgaacatgagctgcagagagttttgcttcatcattaagaaataagaacaagtgtgaaatttctaataagccaaaagacatacagagtcatgcctgtaatgatacaacaatgcttggatcaaatggtggagcatcagacacagttcttgctcgaaatacaggcctcaaggaagaaaatggcacttgaatctatgaaagacaaaagaaaaaaacacatgagagttggtattattagataatatagacagcaactattgcaatagatgatacctaccgattgccattttcctttctcagtgtcaaaaccagcagtgtaaccaagagcgtcccaatcacggcttgtgcgaacaatgattttatatctacgcccatcaccttttaggcgaaactccaaaccatcatatgcagaaagattttcaggttctgagaaattctgaaaaccaattgtgaaaactctctttttaaaattggaacttagttcactacgtaaatagtcaaagtgaaatcaaatatatgttaatcactgcaataacagctagtcataggcaggtagcaacacccgaaactgagcaataattagaatcatacaattaaacgttaataattcaactaactggaaaaaatatagttcttgaaaaaataataaatgcaaaatattttaaatgttgatatgttctgttcctccatttcatacttccagttaaatgttttcaaggggaaaagtgtattcacttcttactgccctaataaataaatgctttccttgctttaaaaaaatggttctttattatataaatttcacaagcactgaactattaaattactaaaaaaaaatagctaaagggtgatttagagtttaaaaccacattagaaggcagtatcagaacacttatctaaagctataattgaaccagcaccgcaattcaatgtttatgtccatccatcagaatttagaagagatttgggaataaagacataggaatagaatttttttttttattaaacagaatgaactaagcattgtggtcactttcaagatttagaaaaaaagattatgtcagaattggttcaaacaatattaatcaagtatgtcattcccatttgcctggccttattgaaacgttaatataaaaattgcatattaccttagttctaatacttgtaaagccaccattgtttgctgtagaaacaacacctgaactagacacacatttgtattatttcgagcagtaaaacacaggctacaaattaccccaaagtgcagtcacatgcatttgcaagaatttgacacatacctttaaaaatcccagttggtccaccattttcacccccacgtgggtcaatttgaaatgtactttcactaactccacccattaccacatcatctaaagcaccccaaggaagctgcctgtaattattgcctgcaaggaaaatagaaaacaaattatattcacaggacacatagtagtaaaactaaaaacacttgttctctcaatacaaagtacaaaccaacagtaattatattcactatagcatgttgcaagcacaatccatgcaacggagattgtcttcttctaattcagaaggctgctgcaatcagtcgtgcaacttaatgttctaagttcaaagctcaatctagtatggattagcctagtggaacatgtcttcaaaagccaccagctagctaatacacttatttatgcatgaactgtgcctcacaaccacccaacccccaagaaagaaaataaaaatcaattcagcttctacaagtttcctttttattgtcatgcacctaagttgaatttggtggtcactggtcatgcatatgtcaaaaagttagatcgggcaattaagttgaatcaatcaatcaattgctttgtcaactagtaatctaccttcaaatccaaataatagcttttctctttgaagtccaagattgtccttcacggccttgatcaaatttctcattcctatgtactccaccttttctggcgagtcaccttttatctgttttcaacaaccaataactaagaaaaaaaagcttcaagaatttcccaaatgagcttgcagaccaactggacttccaaattaaattgacaagaacaaatctgactccgaagataatgtcaacaaaagaagaatcagtaagctacctctggctcaaagaacttaattccctgcacataaataatttcattctgttagagaaaaataaatatgaagccttcagcaaacaatcatgtaacaaaaacaattaagacaagtaacaggttgatataagtcaacgttaacacatccatttctcagtgatagataaccatggattactgcataagcaaaatccaaattctactgtcttaatagagctaatggacatacttggctgtattttgctctgtctggagtgtctccttccttggggccaacaatgacagaagcagcattaatcaccttcttcacacctttaaagtattcagggatcaaagtgctatcttttgtaatgtctccaacgaccttatttaaacataaaggtaagttcgcagcagagtaagtaaaggaaaaagaaactatcactttacgtagtacactatatgcaatcactcaatccaaaaatacatataccaggaaagtctgcactgatgaacatcattttcttcctccaaatcttgaaactttaacaaatcttatacgtaaaaactggcaaagaacttcaaatgacctgaagtcaattgtttatctcttcttatgcaaacacataacttccaaactaacatctattttccatcgttgaattttaggttcaataacacctcattctcaacagaatgataactagaaatctaagctgtcaacttttgcaaaattcagagcccaattgtaacaaactaagaaactacatatttattttatcatttgcaaagtctttcagtacattaaattaaagtgactcaccaaatcaacatctgagcctaacatccttctagctttctcttcatttctaacctgataaaaattgatacagaaatgtaatgtttgttatgcgctgaataaaataattaacagaacgaaaatttctaagcttcttttctctatattttctcttgtcagcaaggtaagttaacaacaataccaatactcggactggaattcctttcttccgtaatatgtcaaccacccttcgaccaacgccaccagtggctccagctaccaggacaatatcagaagttcccattgtgttaaccacttcactaggggaaggatcagatagtttctcaactagaaaatcaaagaacttcacaattcagaaacagaataatcattagttgatccatattccataccaacctctctcttttcttcctattactctcaatttatactaactgaaaattgaataaagtgttaccttagcaggagatgggaacccattgaagaagaacagtgtttttacaaatcttccaaaatcccaattttgtctgccagcttcagctgatattgttgctctatgtgctccagaagagagtctggttgacctaagcaacgtctgaggtctaccataaatctgaagaaatggtttaggcagagttggtgatgccaaaatagtgtgtgaagatttcttacaaagctttcttctaggcaattcagagccctgcagtatgaattaaaagaagggcggcaacatgaagtaaaaatgacataaatgactaagaagtatcaaactttcactagatatgatgaagtgggtagtttcattttcagcaacaacagcaattagaatcagctagcatgaataagggatacaaatgcttccagtccacatattagttacaattcaacttcaaaaatctattttgaaattcaaccaaattgagaaaagacattcaatgaacttcccagataagtaccagtgaacaataagaataaaagtaaaatatcatattatcagatatcaatacaaatgcttccagtccagatatcagttgcaattcaattttaaaaatttaatttgaaattcaaccaaattgagaaaagacattcaacgaacttcccagataaccactgaacaataagaataaaaggataaaatcagataacttctttaatcttggcttagcaaattcatgcaagttgagtgtaaaagtgatcaaacaataaataacgagctttgaatttcttccaaagacataagagtggtacctgaaaattgagaatagatgtggaagcaggggaggagagagttgtgtaaaacgcttccatctgaaaagtgatcgtaggaatatgttgtcaagttaaggttcaatgatatgatatttacagtgcaggattcatatgaaccacaaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaaaacagttcctatatcgataaaactaaaatatataaataagagataattttaaatttttaagcaaatttttgggattgaattaaagagaaattcacattttaagaaagattttctttcttttccctctaatctattctcttgttaattattaactcgttttcttcttaatgggactattaactatctatatataaaagtaaaataaaatatttgtattaattgttatcatttttatgtagtatctaattttattcatttattattctggttaatttttcaattggtatccttaattttatttgattaatttttaatttaaaaatttcttacatcaataattattaatctattttttgtttacatgaaacaactatttaagtcatcaaattttgaaattttttttattaattttataaaataataatgaaattattttaaataaaaattcataaaataattagaaaataaattaaactgagaaaataaattacaaaatactccattaaaataaaaatgatcacaaagttatatgtattgtaatatttcaaatcaattttcaattgatatttcatttattaatttaaaaaaattactttaaattcaaaaattaatatctaaaacatggcaaaaaataaaaattatactaaataattcaatacgaattttgtacaaattcaattgcatgtttttaaattaaaaaaaatataagattaggtgacttcggggagctaaacatactctcaaaatcttggtgactcctttaaaacacattaaagctgatatggttttcttaaagcaacaatgaattgtttgaagctctccgtaatactaaaaataccattttggttcatcttaccgtcacctcaaacatgctataagtcaatccaatatgataaaattctataagtcaacccaattaataaataaataaaatatatacaagattattacatgttctataacacataaagaaagatcaattgagttagatgtgtgtacctgggatgaaggactcatgaaagaataagagtcaatagagaatagagatgaaagaagagtcccctctactcaattgattattttttgtctatgttaaccatttgatgtgtgaatgattaaataacttaatagatgaggacatagatctcttatcagacatcaattgaataatccaacccatcacgatccatttataaaaaaaagcccaacactattcatcatattgataaagtgctattaaccataattaaaatgttaaatataaactctaataattacttagtgttaatccataacttcaactaattagaattaatataacatcctactcatcttcaataacattaagcattatttcttatattgaaaacagatgaataattctaatagattaaattatatatgttatgtgtaaaaatatatatagtcaactaattaaaagttaaatatataacttttaaaataattattatcaaatttaataaacttatcatacataaaaaaatataattaagtgatatcataaaaaaaaaactctttgaaattgcttgactaatattcctctttaagatgccgaagtctactttttttgggtgggttcacttttgttccaataaagttcttagtcagtacctagtgtgtttaaataccattggttttttgtgaactttatggtttactttgttatttataacttataagtaagttcatacttttgtgtgcattttttttttttatatttgatatcatatcatccttcgatcatctttcgatcgagaagattgtgtttgaatcatatggtgttgtttttaggaatgatgttacgaacaagttagaattgggtactgaactgaaatgattttatatatgtaaatgaaacttgaggaaattatatttggatttctatttttatatttaagtagagtatctgtaaaaaaaaaattaagtagagcaaaatacatttttataatatttatttttatctctttggatttacctaacatattttttgatcattgagaaataaaaaggactacaaacgcaagaaaacaattcctatggcatcagtcaaaaggttcaaaagtaaaacatcagggcaagagccaagaacattgaaggatgaatcccatctttgcaaggatatcagcacaagaattagcctcgcggtaaacgtgttaaacttaacattccaatggttgaatattgaaggggatctgatctgagcctagattgaagcataaggatgatagcttgatgatccttgctgaatcaattgaataaaggtaagagaatctatttccactaatacgtgagtaaagttttggttccaagcatgctgaaatccacggaggatacctaacatatacatacatgctcacgttaaaaaatttattacacacataagtttagaaattttattacttttactctcaatcttaaaaactgatttgatttttttaatttttttttataaaaaaaagctatctcttcttatcctatcatttatcttattgcattgacgatttgcatttcttttttaatgtcatataagataaagagcacaagaatcattttcggaaaatatttgtactttatacgttttgtttgagcttcttcaataattggtctgtaagcttactagctagctcatcttacacattcgatagtatctttctttttcgtttgttatatgaaaatcacttgaaatttttaataaacatgagttagataaactcaaataagagatcttgaatctttgtctattttttttatttgccaaactcaaatgttaaaacttaagggagaaaaaacacaaatccagtgtcacttgaacaagagctatgattaatgatcaataattctctgtagtcatttttgggtcgctacagtttgtcataatgctcttattggtatcatattgttgtcatgataatgtagttctgccattgtttatcgtgtttcaactttatggtgacatcaacccagacaaagccagagtactttcggtaattaggtaaatcatgtcccaagggaaacacctgaactgtgacatgtgtgaataattaaggcttctcggtgtccattcttcccagcaccttttccttcttttagaacttttctaaagaagaaaaaaagtatttggcatacatgtaatcggtaatcgtatccaactacaaattttgacttccctcctactctttccttcaacgtgatatcaattagcacaagtcagccatattgtcattgttattcttttatgctaaaaatggttggttgtatcagtatgagctcctcctcctggtccaattacgcacaacaatcacaagtatatttattttacatatttatttaatcgatgtaattcattttcacttgaaaatgttagaaaggtaagcccattttgaatttttttaattatcattttagatctccaatcaaatttaaattcagctcgattttcacccatgtgaatatagggattgctaattttgtagtgatcattagcatcctttatactagtagtattttgtttaagacaaaaactcaacacaaatttcatttgaaaaatgaaaataacttaatttttttttattttatagtcttttcctttataccaaacaatgatcatttttttaaatgtcagataaatcttaatacatgcatcaatcttttctttttattggaaaatctataaataaataaataacaaatttaaaaacttaataaatgtgttttcaatcaatacttttgtaaacatatgtataactacagtcacaatttactttaaatatatatgtacaactaaactaaatccaacgttaataattaccgtcactataaatatataaacttttaatgatgattttttttcttctaaatcacatatattttttattaaaaacaattttatttgagtagaataaaattattataaactataagattcttcattcaaatatttaacatataactatatgttcaagactcaaatatgagataattaattaagctaaaataagcaactccaactgcatcaacaatctatacctaaaactaatgataagtgacttataaaagtaaacatgtaaagtaacaagtatatagatcataaaataatatattattgaatggcataagagtgaattacacacatatatatatacctcacttgagttctcagttttgaaaaccatgtcagcacttaattaattacaatgataggttggggataacaaaattatccatgtattatgtgtaccatagtagctaggttcacacacacaaaaaaaaatattgtgtaccatacttactagcgaatatttgagaggaaattttttcttacaagctagtagaactgtagaagtgagttttattttccttatttattaaatatgtggcttaatagatatatctaattaaccttcgtttccatttatatctgtttttttttccttcagtttttgttcatttttttaattattctgctatggtttaatagatatcatacatactcattaacacattaaatccatgaaatttatgaaataacttaaagctagtatttatccggcaggaccgaaacttctgaccgccccccgctaaacttaaaatgctgttgcagttgcacacggaccacgcccacaattatagtcttgcctacttattttaattggtaaagtgatttcaacctttttgaagaatgatgatcacataattaattaacgaaaataaatatatgacacaattatctttaatgtaaggaatacacatcattttatacctttaatcgactctttcttcattataaagcccatcacatgttttggctccttacttgtttattctatatttaaacgtacacataaaacacgtacaaaagattaccttgcatattatagatagtatagctagttttgatcgagacacacgaaaaaatggtatttcaagttttgaatacccgtaatccaatttagtatgttttcaacccaaaccatacttttgaaaaattaagttaaaccttacgaaaaagtctcttgctgactacgtacgatcataaagacatgattaaagagttaataaaaaattaattaaaaatacaatgacaatattgcactagaaacatttttctaattcctaaatttagatatttcaacttttagttgccataaaattattttagttcccgcttatttttgtgtgtttttttaaaaaatttattattagaaaagtttagttaaaaatgaagtgataaatggagagccatcacctcaccgtgtcattacttcatggagacataatgactacatatttttggaactaaataatagttttaaaagtactgaaatacctaaattctaaaacgaaaaacatgcttaaatctttttaattttttattcagacaattaactgtaagcaaaaaatgagttttttcaacgaaagaacaagagcgactcaaaaaaacaaaagaacaagagacaacctgccggctgccctaacctaacttagatcttccacagtctgtactataaatcaatatggcttttttatgtatatttttttaaactacaaatcactatttaaaagtcgaatcagggaaaattaaaattaatggtnnnnnnnnnnnnnnnnnnnnnnnnnttttttttgaatcaattggagttagattgaatatcgtaatacagaatgttagaattttctttttggtaatataaagttaagccatttatcactccaagtcctactctcgctaaaatctaaaagattacaagaataacaataatttaaattcatgtattaaaattaatataggtgtaattaaatttagttattattattattattattattaatagtattttcaaattattttacaaaataaaagtagatcaatataaagaatatttattacattagacataccaaaattatttatctaatggactactctttagaaaaagagtccaatttgacaaataaactaatatgttggtgtccaatgactgagacccatcatttgaggtttgagcaatacaccattgagtttgagaaccttcaaacaccagacaaaactataatacatatgtgaagcatagaatcatagctatcattctattagaaataacaattctgttatgatttattaaaaatacatttttcatgctatgctatctcatgtagagaatgttatgataaaataaataaagaaattatataatagagtcatgagtatactttctttaacttttatcatccattcatttattttacatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaacagataaaatatgtagaaaatcgtaataattctacatctattttttattttcttttttaaaaccagtagaatacgaaaaaaaaaagttcatcaaaccattcaagtcaaatattttgatagtttaaaattgtcagaaatcatttttcaaaataaataaataaataaataaattttgacttaaaaattgtgaaatcatgaacactttgataaaagagggactaaaaataattttccaaaaatttgagagactaaaaataacaaattatatttttaaggattacaaaaataatcatccaaatttaaagcactaaaaatatactgatcaaataattcacctctaaagattagtattaaaattttaatattaatatttttaaattactaaaaccaaaaaagaaaatatactatagaaaaatgtcatatattgtttatataaaattttttacaaaatatctaattataatatatgataaatttattaatttttaaaataattattttaaattaattcaaatataatttataattgaaagaaaatgtaatattttagtgcctaaaaattaaattcaatatactatctaatacatattcattaagataaattcttaagagatattaacaaattcctttactttatatgccgagtgtggggcttgtaacatttttaatatatgatcaatatcttaatttactatagacccacctacattcaatcccaacaatcccattccacatcctgtctgaatcacaatttggattttcaaaccccacgcccactttctcttgactttagccatcccttattccttaaagctagcttgatctccaagttctctctctctctctcgacccacttctccatttccttatataatacaataactccctcataaagccattccctcactctttcacaatatggcacgacctagcacgttgctgctcctgttgatgcttctcttggcttcattttgctcgtgtttagaagccagaaaacttgttctagagaagcagcagaagaaggaaaacccatcttcaagaagggacagtttgtttctgagtgcacttcctaagggcaccgtgccaccttcttcaccaagcaaaaaaggacactctatggaggttgatgagaagctcatagcacgacacttcatagccatcgatcgagttcttctaagatctgtccctagcccaggtgttggccactaataaattaagtttgtgtgtttatttatttcttctttaacttctttcttgagatatgacaccacattttttttattggttcagttttgttattatgtggcaagattctttatatggtggtaaagaggattttgaaagtgtgatataaataaacctacggaatagtttaattgtgtaaaagtggaatgaaagaatatatgtgcttatgctttcctctgctttgggactatcggctttccttttacgattatactcattcacaaacataaataaatgaatacattttgaactttacgtcacttcttttttcggcgtacttgtaagctttgcagtttgcatcaacgttttctcaattggaatataatattatgtgccatttggaattggaacagagagaaattgttgatctgctactgggaatccagggataaccccatttggcgtcatacaaagaaattagaatacaagaaaaaaagaaaaaagaaagaaagaaaattcattccagacaattctttgtaagcttccacttactttttttcaccaagagttggtgcgtcaagattcgagggtatctgtttgacaatcgatgtttaattattatcaaggcatagcttttcttaaagtgtggtttgtcttttgtattaaagtgttattcatacgcacaagtaaaagttaaatcttgtagtcaatgtgttttaaggcgtctaactatatatatgtgttggtacttacttgtgagttgtgacttggtgatgatctcgttaaatggttagagattgaaattgcctatatatacttttctccccctttccagtctctctaattaaaaagcgacacatgattaaaaagtagagtttttctcctaaattaactgtaacttatttttgttgatatgtcactttcaacgcaacgtcaagaggctattttttttaaaggaagttaagaggctatttcattgacataaccttttgatatttatttcaaagcaaatgtctttactaaaaaaaatttatatgcaaggcttttatgacacaatttatgggctaaaaaaacacttatattaattttgatcatttaagataaaatttaatgaataatgtttatttttactactaagtcgttaatttaagtagtattggagtcaatttctttaaacaatgtttaagatttgaatcttataaacgaaaaaaatataattgaaaggcaaaaatttcactaaagatgtccaatcaaattttttatgaaaattaatcatcaataaatttagtgaatattacgtaccaataacatgataaacaaaaaaaattacattcatttctcgcacacataaaaaaaatgttctctctcacattttcttaattcaaatgactaaatatcccaattcatgacactcaaatattattattttgactacaatgataataataatgaggatcaaacataattgttcatgcatttaccccaacccttcctattaaactaaccttagtgagtaacacctaaatattattattaacttcatttttgtttgtaacaacaatatctcaatagtttaatagtagttattacttgtttggtaggataccttttctaggtcagtacctgtgttaactttattatttagattaaattactcaatacatacctcaattatttgtgaatttttaagcaagttcttgtacttttttttttgttaaattggattcctaaactaaaatactagggtcttggatttatttgttagtagtttaaaattgtcacaaaatatgacaattgatgatagtttagaaactaaagggactaaaaaaaatgggggacctatttaaaattttgcatataaattagagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactttatataacgtttataattgagcactacggcagcatttggttaagtaatcaaggctatgcttattaaagtaaaaacttaacatacactccagtcaaaacatcccaatgattatgctttgaatcattactccttactcctatacttggaaattaaaccaaatgataatgaactgaaagagacttatccttcatttattacactatattacaataacacaagataatttacagttgacatcgctgataacagaagaaaaacacagaaattgagaaggtgtatataccaaatgttatagtactataaattctatgaagagagtctaacagagcacctgaagcatccctactcttgagactaaatgtacaataacaacttcaaaaaatgcctaattacacaggaattatgaattaatactttggtatcctcccctccccccccccccccccnnnnnnnnnntatatatatatatatatatatatatatatatatatatatatatatatatatatataatataactaacagtccagaaccatagcgaaatgagtatctcccataatgaacacaatagttatgctgcatcaatttttttacttcaagaagagtaggacacaaggaactttaattcgacccggattgtcctagcccttacgcatcgcaattgaggtataattgtgggagaattccagtaccaatcccatcatatagcacataatgctgatcaatctcttactatggtactttgaaaaaaaattcttataccagctgtaacacttagacaaaaaatttcatggtacaagtgttataagtaaaaagtcctttggattaaatgccagatatactcaatttcagaaaacatggtaggtgagatcttaaattttaaagtacaaaaggaggaagaaaaaaatagtcttggatatggtccatgtacacaactactggtctgccacttaagttgcacattttggccaaaaaaacaatagcatcagaaaagactaaaaacgcgtccaaagaaccaagatatagcatatcctcaaccagcacccagctgtttttttttttagaaggggatcaccgtcagtggcctgtgttttgccatttgcacatcttctgacccaacactcttttcttgttggagtaattgcattatcattttagcctggcacatcttctgaaattattactaaaagattaaaaattacaatcgatcaattaaacctattacattccaaaggtaattttataatagcatccaagtaaaatcaattattctaaattaaattttaaaatattgttctgaaataggaatcaatcttttaatattacttttatattaatcattttaaaatattaaactgaactaaagaagcattttatgaagataaggggaaaaaataatgaaaatgagaatataaaataatgtgtgcgtctcacttgaactatacgtttaatttatttgcatccatatgtattggatgacggcagaggattgaatcttctacctaccataacagacacctcacacaccggaaacattattaaaaaatcagaaactacatgattcattagaagctcgacgtatgtcacacgtacttgtgttccaattagggatggcaaaacgggtctggcccggcgggccagcccgtttaacccacgaaaaaatgtgggctgggttgagactttgagcccacattcattaaacggggcgggccaacccggcccacaaaaatgtgggccaaatgtgggccaggggtgggccagcccaccgggccagcagcccaccaataaaaaataataaaatatttaataggtaattaaatgagtgacttagagggagagtgactaaaaagaagttaatgattttgaatccttaaccctaatacatttttatttggaacctaataatgagctatactacatgtacaattatgttttgatagtctgcatcattgtgaagcaaatttctaagaatttgttaagacttaggagctaattgaaaaccattgttaaacatgtatttcgtgcttgcttttacttctattaggcatgtattatatattaaaaatcattgttataggattaagttagtacattattaatttttagtataaataattacatttgaatttttttaataatttattttacctttttaaaaaaaatatttttttttatttttaagtgggctggcccgctggcccactaacccactttaaagtggggcgggctagtattttcagcccactttacaaaagtgggccagcccggcccgatccacttttttagtgggttgggccagcccggcccgtttttgggtgggctggcccactttgccatccctagttccaatcctacttcaacagtcagcgttctcaatcacacgcaacaaatcacttcacacactgcgtggataggtccatccttataattatagttatctccactaaatttctctctttcagtctaataatttccaaggttcatttttattattattaagatgtcctatgtcatttgcaatatagtccaaatattctttataagacatggatccatttttaatatgatattggcgctaaccaagctgagtctccaaaagttgtcaaggcccactcagaattgggtctctagaattggttcagctgcgtcttcaggacaacgaggattgaggaggaagaatgtaaaggatacatgagagactaaaacatcttgcacttttattattgttttcagttgtgtctcattgcattccaaaaagtcttacattttggattggacttttcaaaatacaatggaacctaacagaaagcaatagtgaaaatgcaagaagcaacatcctatgtacatgagaggtacttcaatgctaaagttaatgtgtaaaatgtgttcatcgacaacgatgaaaaatgcaaagagttgaggtgaaatgtgttcactattaactatcaatgcaaagagtatagagaactcacataatgttgaaccatgcatacctatgaaaaatgagagtagatagaactcacggaatgttgacgcataagaatgatgggaataaagaaagctcaaaaaacattaaagcataaaaacaatgagagtagagagaactcgtagaatgttgccattgctatttgctaaccttgagctcacagaatgttacacttaccagccttgtttgtattcaagcttaaaaaaatatttactaggtaaaaataattaaatactaaaaaggtaattaagaagaaaatagtaagatttattattaaaaatgttaaaaaaatataaatcagatgaataagtattatgtattgttagaaatgttacaatatataacaaaaaaaacgttagaaatttgtaacatttgcaacatactacaagtctacaatatagcacatacaattaatacattctattatgtatattttattcctttaattcaataatataaacaaaggatgcttgctaaccttgttttcattagcgaattgtcaaaaagcacgagcataatccatcggttcaatttaataacgtaaatgctctaatataacaaaatagatacatatatactattgaagcaatatttcatnatataacaaaaaaaaaaaaaacgttagaaatttgtaacatttgcaacatactacaagtctacaatatagcatatacaattaatacattctattatgtatattttattcctttaattcaatagtataaaacaaaggatgtttgctaaccttgttttcattagcgaattgtcaaaaagcacgagtaaatgctctaatataacaaaatagtaatagatatattactattgaagtaatatgccaagtggcccattagctcagttggttagagcgtggtgctaataacgccaaggtcgcaggttcgagacctgcatgggccaaaatgattcttttttcgtttttctgtttgtgaattgttaagcgaggcatacacacacctttagccttcacggggttctttcatattttttcttcttccagtaaatcaaacttataccagtaaacatgaataatcttaaacatgagtgcataaaaacaaatgatcttttctcaatataaatttttatttattaaataaaaatttacttttaaatattgaaaaatattttttttctttgaataatattttcaaaatgttaagttatgttggattggtggtagaaaattaaatgagattgattgaaaaataatgggatgagatggattgaaataaaaacatcattttattgtttgattttttataatgaaacaaaacaaaaaaattattctattatttgaaaaaatgataaaatggaatgaattataacttttaaattcatattattattcttatactaaagatacttataattaaataattttataatctagaaatattgttctatcaagtgcaccccgaattgggggcgggaggtgggaggattacggttaagcagtgtaatagatcatgatttatcttcttctattatgttttattcctatttttacaaaccaaacattgtttgatttgaaaaaataaaattttattttttaattataaaaatataattttattggttatatttttgtaattaaaagtgataataaaataaaatcttaaatcaaaccacaccctaaacttgtctcatttaccaatcccaactcccacatttatgtctgccaatgtgtttgttttagcagtccaccagtacttctacaatgcactcgatcggctttgtatttgctaaacccaaagacgtcccatgccatcaagaaattaaaaacacacggattttgtgtttcctcatgaaatgtattgtcaaagaggtttccttttgtcatcatggtgtcaaaaatttgaacttttcttaaaggtatgcgaaggcattgattgatgagctctttagtatttattagccgggtctgcccccaaagtgtttggtattaggagtgcagatcaagctacgaataaaataaaatatccaaattggccgggaaacattcttacccaattgcttgagaattcctacttactctatgttaaatgttcaatgcatgctcaacttttacattaaaattaatttgaagatacggatgattatttatatgatatattataccgagaataaagtttctctgttgcccccttggatcaatgatgcgatcacatatcttggctatcagatgcttaggatgcatagagattatggggcagttatttttttttcatcttcaaggacacagattacggtcggaagtaattttttttgtatgatgcaaaaaaaataaagatgtttagattgatctcattaattccatggtattatgatacaccttttacaccttaccaacacctcttttcttcccaattatactttaccgtcgcttcattttatttctcgtcgacccttcatttatagtctccaaccacccctcctaacaccacccccatcattgtcattattttcaatatcaaaactggtgacaattgatagtagtagctacggtggtggagaatcaacgatgtcttgatggtaacgatgtttgttgatttatagatttgagctcgaatcgtctgttgatagtgcatggtgttcaacggtggtgtatcgacaaggaagagcatgatggtaaaactaacgtgcttgagcaagattgcctcccatcaaaacccatcacgaaagcaacaaattcgccatatctacggtgctccacgccgaccaatgccacacaccaccacaaaacccaaactcgaggcaccaccacgaaagccaaatgtggtgtaccaccacaaaatactgtttgacaagatcttttagagatttgccgccaatagacacgaagtggtaatgacataacggtagtttacatgacaaagtgaattgacacaacccagatcatagagctctattttttcttcttcttaaatatggatttgatttttctttctcttcatgttgtaatagttctaaaatttctatttgtacaccatacacaagaatatttacttttccatcataacctgcgccatcttcaagttgttttttgcattgtaatcttaaaagagaaaaaaatcctaaaatattataaacaaatttataacaattttaaatttaaataatatctcaaagataaaataagatttgaaacaaataataagttcttaaaaaataaattaaattctttttctaaactaaaaatacaacactatagacatccacgatcagattcctttatatatctactaaatttgaaaagaaaaaaaaagtttattccccaattacaatagaaaaaaatgtttattgggattgtgccgtggtgaaagtgagtgggtatggaaacgacagaaaatattatttgctacacgtaatatctaaccctgacatgttgcccatctatctcgtgaaccagagtaaaaaaaaatccaagtactttctacgatcgagttacccgaaagaaataagaattttccaagtttcaaacggatacttataaatggtagtcgtgttttaccctaatcacgtgagatatatctgtcagacattgcatgaacaatttaaatattttttgttgcattttaattatttaaattcttttaaaaaattacattgattgcatgaacaagtctgtatcatataatatttgtgtcctgatgtatcgtatccatattttcttggactgttgttcgtctataaaatgaacaactctactcgttatatctaactatctattacctcgagcgggacagctgaaatattttaagatttcagctgtgtttttttttttaagaacttaatctttatatattattctatattatcatttaattataaattattatttgaattattttaagataattaatttaaaaattaataaatttattagaaatgatgagtagttgtgatgtgtaaaatttttataatattaatattttttctttttttaaagaaacatgttgtttgagaaatcatcatgtaggctaattaggctgtgtttaaaggttaattaaccgcatattttaatgggtcaggttttgctttttactataaaaaaaaaggctttaatgggtcagattactagcaaattaagcagcatataccctaattatctgctatcagatatgaattgttgcaaagtttgaaccgatcactgttccaacagccagtaagtttatctttgacaaaaatgtatcgcaagaagaaacaaatctgacactcaaagcttctcttttgtggggcccttaaaatctaattatctcctaccccaccacgctgattctctattcctagatcagattaatcaagatcataatattgctagttgctaccctgttggccaattgacatgtgggtccaaaatggctatgggtctgtgctctttctgctctcacatttacttaatgtacccatcctttgtggctcccctccacagacttatcccacgcgcctccctgttgtcattgatagtgaagtacttgattggctcgtctctcccattgcatccctggcccatcatcaatcatgcacacaaggcaggcttaccttagactcaattttctatcaaatggaaggttttgaattcaaaatcaatcattaaataggtgggaactagtagtaacactttcctttgggagtgactaacgaatatgactaattaagtgcgtgttacgtttttttttttttttgaaaaatatctaacaagtttaagtataattttgttttttctgtaaacatatactataataagtatgaaatatttaaatatttactaattttattaataattattttgtttgaatatttaaccgatcatttttaataaaatcatctttcacaatcatattttttcattcatcaaatttgaacataaagtcttacttaaagattttaaaattctaattgaaaaccaaacatgttatcataaagcatggctgagtttgaatacctaatgaggcaaagtttagttttaaaaggaaaacgtttcctcaaatgaaaccacttcctaagcaagtaacggtgtaggtatacattctcatttattcatttcaaaggaaacatatccatattgaaatatagacaaaatttagataaatctcttcattgcttatagtattattctcttatgaacatcataatgtgtactcatttttatacttacaaagacatgataaggtagttaaaaaataggacacacattatgtttttattacagaataataccataaacactcggcggaaccttatcatcaaaataaccacaaactttaatctttactttatataacgtttataattgagcactacggcnnnnnnnnnnnnnnnnnnnnnnnnntctcaatagtttaatagtagttattacttgtttggtaggataccttttctaggtcagtacctgtgttaactttattatttagattaaattactcaatacatacctcaattatttgtgaatttttaagcaagttcttgtacttttttttttgttaaattggattcctaaactaaaatactagggtcttggatttatttgttagtagtttaaaattgtcacaaaatatgacaattgatgatagtttagaaactaaagggactaaaaaaaatgggggacctatttaaaattttgcatataaattagagatttnnnnnnnnnnnnnnnnnnnnnnnnnnncccccccccccccccccccccaagtaataatacagaaaatgagttgtcaagtattcatttaatcctccttattatacattatatatttcataaatttttctaaacatttattgtatatacttgacaactcattatgagtattatactcataatattaccatgacatgggatacactaatacagtaattaatactaataatactacgtattaggaagtagccggagaacccaccagagagaggtaaacctgactctgtatcactgtcttagcgattttgaaacccggcaccaccgtgaaacccaccctaagctcgccggagctggaatcagaggattccccggaaggcgaaacgggttcttcggtgacactctccatgtacacctcagagaacctcgtgttcttcttgatttgaaagacggtgacataattatcctgaaacgacaatgccaaacaatgcagggtccaaacgcgctttgccatctctgcaaacgcgacgaagaaagaagaatctgggtaccctccagagttcaccaccttcctctggttcaagttgccgaagaaggaacactccattttggcgtgcaccacttgaaggtacttggatttcaggaacttggagaaggaagagtttgggttgtgggttaagtactgttttggattcaacgatttgagctttttgaatttgtcaaagtagaggctttgtgctccttggttatgtaggattttgtcttcttggacgttgaagtttgggttgttgaagccttcaaacattgttatgcaaacaaatgattcaaacgcgaagatttggtgagttggtttggtgaaaaccgcgttaggatggatgaacttaaccgctgcttcgagatcccaatgagcagattccatttccgccatcataatcttggagaagcttctgactgatctcaaagtgtggtgaagaaaatgaacaaaatgtgttggactcaacgatgaaagtgtgaggttatcaaacaacgacaatgagccactcgagttgagtttcttttcaagcgatttgttgaagttaacacagtcgtcgaggtgtttcttgagcgatgagatgttattgtccttgaactcaacctcggcttcgagcctcttgatggtgatttcataggttttcatgagactttgttgttcctgaatctccgcgagcataatagtaacttgaggtgagagatcaagctccttcttcaagaacctgcgcttcaactccgagatggctcgaagttcatccaccacggcttgatccgcagcttgaatggagtcgttgttgtaagggtgctgagccatttggagttctgcatatgctgctttgatggttgtgacgccagcgaagagtctcgcgattagagcctccataactgctctattcttgttgtttccttggtggggtttgttgttctgatcggtgaagcgatcctccttgactttgaggtgggagttgagcatgcaaatgccattgtttgatgcgagtttcgttgcacttcggaggcttatcaccttctggaacgtctttgccagtttcttgctcctaacgttgagtgctgatttgggcttcatggtttccatctcaagacaaatattttcttgtctgaagaagcataagagttttgtgtgttttcacagcaaaaattgatgaaatccaataacaatgggagagaaaatgtttgcagtagcaaaaggagattttggttggaaaagcaggtgcaaatctttgactacaacactttcaaatcagagtctttgagcggaggatagagattggtagtgtggtgatattaatatataaacatagattttatgaaaataatgggagggagattaagtaaataggagtgtgtttaaagcgcgggaaaaggaaaaggacgaatgctttagctttctcatgaaagatgttaaatactccaaggtaggcttgtagtacaagaactttgacatacaagccactgattatctattttttcttttctttgcctacttgtttttggaataatatatctgtatagctacccagagagatgatagtgtggggcatattgccttaattacgtgattgatgggtatgatctaattgtggaccctattagaattcaaaatattgataaaatcataatatatcgtatgctaggaaaaaattataaataatgatatatgtttttattaaagagaaaatagaaaacacacaggcgaattcaaaaaatgtgtgattatttgttaaacatgttttatataaaattaagtgactgaacgtaaataattaatgtgttgaagttaagttgaatcatttgaatattatttgagttaatttttgataaaaataattgttgatcaaattttatttaatttttgatcaaattttagattaataatattttttttcatgatgaattagaatattaaaaaaaacatattttatataacaaattcatcaattaataataaaagtctattaattaaaaaaattataccgttgcaaacttgcaataactgtgaatctgtcatgcttgtgactgatggaggacattatgaaacatgtgagggataggaatccgggagctgttgttttctaatgttcgtaaactagaaggtagatgcatgttaaatatctttttatttgatttggaaaagcaaatgatggttaagcgcgcactctgcaataattaattatttttgcttatgaaacaatggtaatcaaagttttgaaccgttttcgtttttcattattccatatggcaccgcaacaaaagtttcaattaattattggaactggttcattgtaggtatgtgaacatgaacggctacatttgtgtagctaagtagctagcctgaataaagtttaccattatccaggctttatgttaaaaatataaaatgcgtactacagatatagcttttatttgtgggggacactatagtcagaaacattattgtggtttccaaaaagctttttcgacggtaataaaaactcacaagggatgaaggaatattacgtaagcagcactgcggccagcagcagaaacagaagcatggaaaatgctctgcatacattttcttattcaatgaattcaatatcacaactttttaaaagtaaaaaaatgaacaacttatgtaaaaactaaaatattattgagttacatttcttttggtacatatgatcaatgttgtctatcttaattttacgagagaaattttaaatataattattataagtaatatttttaaaaaacatttaatataactttatatattgataggaattctcttcaattaaaaaaacatcatattcatattataagtacgatgattcaaaaaaatattaaatcgaagtacaaaaattctctaaataagaattgttggatcatcacttgttcaatgaatagatataataaaaaaaaattcaaagaaacgtttatccttgatcaaaacaaagataaactctggaaacttgaaagaatgaaaattatttcatttatttttagacttacacttgtaactatttattaagttgaaataacattgtgttaattgattgtgcatttactagtattaagttacattttcatttttgcaagcaatatgatgacaagtttggtaatttaaaaaaatgttttttattgtttaaattattttagtttaattaatgattttaaattcaaattcgaaatttgtaaattaaatattaaagaaaaacattatcatctataatacttttatctaagtaaaagttacatgtaacatatggtccaagtcaaaatgggcaagtaccaagcagaaaatgttgacatgtcataagtacttcgaattcttttcacactaagatatacaataaactttttcgtacaataatttgggttataaatttaaacttcaaaatcattgaaattaatgaataaataaaaattaatttgatagtttctattacttattttcatatgttttattaaaaaattgattaaaataagccaatattttgttataatttaaaataaatttcagtaaacccttccaaatatcactgtttgattttcttttcgtggattattatacttgtttggagttttgctactattaagtattcagagtcattgtctttgctggaaaatactgtgtccaatgcccatgttccgctcaaagcgcgaaactctttgccatagggttcattgtccaatgtccattgtaggcatgtgatcaaagaagctgagcacgagagaagcagaaaataaattgattgtgatgaaaacttttttttttgtttaaatatatatagttgatttttgaaaatattttcagtcaccataattttcccatgaccccttaattaacactgttaatattccaagaaattgaaatccgtagtttatacatagaaagagtcacgttttcttttcagttgtttgagaggagctgtctcttgtgtgtcttcgaatgcgtcaaatgaagaagagttagactttttcttcatgttttcttaataattgcaaaattgttgacagagcaagaaaagaaactaaacgatgtgcttccctttttacgtgaaagaactttggcttttctttgatcgcgatcattgaattaaaatgatacaagattgcaaatattatatacactagtggaatcttgtcttgtattggaattgcaattaatttcaatttgatatgatattatatttttctttagttagttctacttagctgtagttcatgaatcccactgaagttgacaatatgggaccaaggttgcacattggtgggaaaacatcacaaaagagacacagccgaaagaatgatggtgactgaaatatagcctcaggtcttaattaaacttacaggagatggggtacaacatagtcaacttgggacagtaattgtaacatcccaactaattaattaattatttatttgttttattttaaattttattattttatcctttagtcttttaagaaaaaaaaatataaattgagataagaacaagaaaaactaaaattttacaagatcatgtattagtaaaaaaattcgtcgtcataaaatttacaaaatataaaagagtggtacattagtacatgtctctagtataaatatacaagtacaaatttcttttccaaaattctcaactataatttatatattataggacttcaaacattgttatttatacacaagagtcacagcctagtatttacacatagtcttcggtactgtctctgtcactgaaaactattatggggtctgtgactgggtttggatacattggtacaaactgagagaacggatctgcagggttaaaatattcactaaacaccgatactgaaaaatgggtgccaaaataaatatgagcacgcaacacaggttgcatggtaactacatagcagttgcggacttcatccatataccaggcgatatccagagcatcaataaagattatgattgcagccatctaaaacattaaataaaatctaatgagaaataaatttctcagtaggctaatctaaaccaccaaacacgttagaaagttagtaaataaagcaaatttaattcaacatacattttagcagattagtaaataactcaatatatttgaatgaatgcatgattatatgaatgtatggaaatgaatgtaattgtcacaggtgcacatggtctctacatatcgtactgtatgtagctacatctcgtactggatgtagacgctgcgatcgtcttatgcaaacatgcatgaattcccatgtagtagcaccagataagtagcatatgcccagtttcccacatttgaaactcgggtcattctcataacttcataagatatttctctttcataacataagatagatatcattttatgcatcgttcatgtaatagtgtatcccagaataaatttaagagctgctaatgttatgatatatatatatatatgtatatatatatatatatatatatatatatatatatctacttatttttatatatatacgggaataaaaccggaaggatctgcatggcataatttatacgtagaagttatcttaaaatcggagtggtagtattcttatgacgcaaggttccgagataccgatttttgtttagtttatgcatggctcgtagagttgagtgccgaggtgcgtgtaggggtccggggtacatgtatggtgagtggccgaggtccgaggttcatgcttggtgagttgccgaggtctgaggtacaggcatggtgagttgccgaggtctgaggtacaggcatggtgagttgccgaggtccatggtgagttgccgaggtctgaggtacaggcatggtgagttgccgaggtccatggtgagttgccgaggtccgaggtacaggcatggtgagttgccaaggtccatggtgagttgccgaggtccgaggtacaggcatggtgagttgccgaggtatatatatgagatcggcagggccatgtggccgggctacataggtgaccgagatgcatggtggctgaagtgcataggtgggtaagtataatccggcatggctgaggatcgagatgttggcatgggttaagggtatgaccggtcttggtgctgcagccatatatattcgaacgggtatggccgggcttgaagagatgctatccgagttacaagagtgcataaatagttgggatgagtgaatccggaaatgccgagatggattgctcggctcggacgtgcatatactggtgagtgtattttttccggtagtgccaagatgtgtgcatatatatatgtaaagaagtgggtgtttgacaagtgagtggatccggtggtgcagaggtgtagagtaatggtgtagctgagagtgtagtttgccaaggtaatggtgtaataagaaggaaaagccgagatatccgatatatccgaggtgctgtagtgtaaaggttccaaggtctctactaatatttaagcctcgaatttacgtatgtatactattcacctttacttggaaaagctaggccgagataaacaaaagttggactttgcttttggtttgtcattatataaatatatatatattacttagctattacctttggtgccgtgtttaaaatttatggcccggtagtactatttctttaatttaaaacgttagatgcttaatataatattattatcttatagacccaaattactaataatttaagctctacgttattgctagcttttaaaaaaaatcactgcatcctatattacatttctaagcataattttctaagttaattctggttaaataatcatctaaatgaaataactgttaaattaaagattgaagcctagcctaccttggataaatttgatgaatgacttagagaactgccaggataattttgagagagaaggattttacttaagagaagatggtagagaaagtttgggaagactggaagttgttagtgttctatgtatagaatttgatggatgcaggagtatttatactaatttatttggttgaatgacaaccggtaagatttagtttagttaatatgtaactaatttttttggaagatttttatcaaagttaatcattacattcttctcctcattaatgcatggctttacgtggaagcttgatggataaaatttggttctactgatgacacttggactcttaaaagattgtattaaggataggtttcagctgaatttcttcacgtggctggagttgaatactcaagtttggttcttattctaaaaattatctttgatattattatctattctgttattatatttttaaatcacatatatatacatttatatatatttgagggtattacagtaatggtttataataatatcattgctttgtctttaaaatgatctgaacatataactaacaaatttgagttgtacaaaaaaaagtatgatcatttatcacttacatttgactttaagctgaactgtggcgaattaatcttgaatataaagttagggattatctaagacatataactatattcttttacttggattttggagaccagaagatgatagaaattaaaattttccttttatttgatatttaatgtacataactattttgaagaaagactatgaggcccaaatacaccctaaatttatcaagtgtttgatccatctttaatcttaaaatttcctgttcatattaggcacactccttgcaaaaataatgagtcatcataaggtaatgttaacgagtgcctatatcagtttaacatgttaattatttcatttttattcttttttctggagattattgtttttattccttaatatattaaaggtactgttcattaaatttttaataacaataactaaaaatcatagcataaaaaacagtgtgtccaaaatgtttcgctatctaaatgtttactctatgtaactattagattgtataacaaattggaatgttggtgaacacggaggtagtttaatgattcagcaatgaagccatgaaggcatggctttaggtctaagaaaaagatgtaatgcctcaaaatgaatgatattcgtatgtttgtctttaacatctctcaactcattcatagtaattttatggtcttcgtcacgtccgacattcaagttataatattgcaggaatattattagtctaacagtgtccaaagttaaaattatcgcatcttattaagaatagacgaagaagtttcctaatactaattattttatcttttaagatccgtttccacattatattatctgaagtttaatatcattggttactggttagattgttgtattgcagaaaagtgatcgaggtccaggattcagtcaaaggcaccttgatctaattgattcgcatatatatagtacatatttttttttttgggtaagtggcatgaagttgtaaatatcaaaatatgtttgttcatatctcacatagtcacattcatttagggctaaatcaagctttggattagtattattagatttgaataatgcataattatatcattgtttgcttcttgggcgtagcaattgtaatggccgggaagaaaaatcatttgtcctcctagattcaaactttgattgtatggcatgcagctatattatttgcattttgtcgttaatgatgaattctacgtcaagacttctactgttatacttttgtagccttgtagacgtatttagaacctacctggataagttttatatatatatatatatatatatatatatataaaatatttgaataagttgatttaaaaggacttttaaaagaaaaaaaaatgaaattctctattaagtcaaattaacttatgtacatatgatgctagctaaacaaagagcgtttcaacaaataaacaataacaacttatacaaacaggcttaaagcttaattaaaaactaatcaaatgattgaatataagtaagtaatgtactaaaattaaaattaaatagttaaggtaatagttgagttagatttttaatgaaaataatttttgatcaaattttagttacctcttcactcgaatgagacataatctttttctcctaataaacatgaaaacgttaaaaaagctttattaaaagctactcatattagcaattctaagactaggtaaaacacaaaaacattgcctattacaggggacttttttcaagctggacttttttcacttttattctgtggacaatcgatgggttgttccttcctacacctcaaagttgtttcttacattctttttagaatgtctgtttttaccttttaaattgatcattccagaaataaaaatctataatcaattcacaatttaattttacattctaaatggatcattttgggaggaaaaaaaggagtgctgaattttaaagatacaggaaacaacagtccaaccggtgatatggaagaagaataacattagctcaaattttaagttgttcttttcgcctccaactctttaaacccactaagcccaaattcattgtggaagattttactttttttttaacttttttttttatttttattgtattttacttttcttcttgaagcttcctaattctgcaaaacatgctatcacattttttctaaatttctcgcgcataaactaagactggtagaatgggtctacttgttctaggttgttccaccgttgattaggtagggtgagttgccttaggttagtaatgtaggtcaaaaatcctaatacgtccagacatcctatttaacgacattttggcaggttgatgaattcatttgccaaaaacaaataaattgaattggcaaatgggtggattaattaacctaaaaaataataaaaaggatgaaagattataaaaaaataaaaatatagatatacaaatattatctaaaacattttgaataactgactacataaaaaatcataaaatattagatcatcaatatttaaaaacatatcatcaccatacaaacagtaataccgtgttcacaaaaaaataaaaacccagtaatcccttgtctaaaaaatctacaaaataataaaattccgaacaatagtaaataataacatagacacctcatagtacgtttattaccttttccgtctaaaaagaaaaataaagcatgaaaaattcaataagaatactgttatatatattttataatatcttcttaatgctagttagtcaaaattgtcgtcttagagaatgacgtacgaaaaccaacgcataacctaggaataatagaagaaaataaacatgtaacaaaagaagacgaaacatagagatgatgggaagccagaatgatgtgaaactattgagctttgagttgagtccagttggtcatagagttgaatgggctctgaagctaaagggtgttgattacgagtatgtagaagaagatatcttcaacaagaccaatctccttctggaactgaacccggttcacaaaaaggttccggttcttgttcatcaccaaaaaccaatcgctgagtcactcatcatcgttgaatacatcgatcaaacatggaagcagcagtatccgctaatgcctcaacatccttatcaaagagctcttactcggttttggggtaccgtggctgataaggtaatttgtcacaccctctttctattgtaattttttaaatgttttcggttcattttttacgttgtaaatttctgaaagaaaggaaataattgcgaactcaccttcactccttcataatggattaagaataaattcaaatcaaagaaaaatttccttgtttatttatgaattatatttatttaaagaatatatatttttgtatagtttgcttttttatttccttcatatgcaccttactcctcgttgagtgcagagacagtaaaattcccttttccctcttaatacgtataagaatttcttcgcaatgaatgcaaaataacagaccaccggaaaaaaaaaaaaagaagcaaataattaaaatgttttggcctttaaaatgactctttcgaaacccacattgaccaacatagaaattgggcccaagtactcaacaacgaagaattttttcttattattaggtccatgacaatgattttactgtcaatcaaatttggccatgtgcattttatgtagatttacacaactaccattaatcgaaccaaaaaaaaaaaaagtaacttacaatgacttaaaaacaaaactagctgccattaaccaacaaaatcaggtaatggtttaatagtaattagatatttagattttatattctaccgtacgtgcaatatgaagtaagccaaaagaaagaaagaaaaccactccctctagcttttacggtggtatatatacacatacacaagctctattaatttgataactcattttcaacacctgttttatgaatatatatgtaacagcttgcgaagacatcatatgttgcaatgtgtagcagcggggatgaacaggaaaagagtgtgaaggaagccatagaagtaatggataaaatagaagaagagattaagggcaagaaattctttggagggtacaatattgggtatcttgaccttgcatttggatggatcccttattggcttcctgtttgggagaaagttgggtcaatgcaaatagttgacccattaaaacattgcgccatctctgcatggaacaccaattttctcagccaccctgtcatcaagaactgcttacccccaagagacaagatgcttgcttattcccgccgtcgcaaacacgagttttcttttactcttcgtcgttgagtcatgctttttcctcaatatctaattcaataggaaaatgtttggtagatacccaatgtattaactaatatctagagagagtaaaaaaaaaacttatatgtatgattagagcttacaatatgatacgaagaaaaatatacaaagaaaaataagaagtgttattaaaatgtgtaaaataaaagatgatttctgaataattatccaattcaatatgatttaggcagagggaaaaacctataagagtcaattcagagataaaatcgaatagaaaaaataaaatctttcttttcactaacctccagtaaaagaaattaataggcacgctagggattgactcaattgtactgtacgtttaatcttgggttgtgaatcatctgctgttaaataaattatataagccatgaaagacctacttacattttgggttcgtcattcctgcccctgcatatctctcggtattcaacatttaaatacatataaacaaatattcaacatttaaattaataatttgatgaaaaaaatgaacggaaagaaaagttgcctaagttaatgtcaatcaaagatacaaaattgagtactatgtttattagtaaaaacaattttttcaattaagaaatcatattaaagtaactatttttttcatgtgttgaagtaagatagcgtttccttccaaaaaaaaattaaggtggcgttatggactagccaatatttaaattaaatgtaattattcatttaaagaaaaaattgaatgctaatttttaatttcttaagtcaatgtcaaatacagataaaaaaaaggtaaaggtctgattattgaaaactatatgttacagtaacttcttttttttaaaaaataaaaatgcaaatatattacaataggcacaaacatcaacaaggtggtactcctactctcatctatcatttagagcacacttaaaatttactgaataaaagagaacaaaacaaacacggggagcaaaaatcaaactcattgcccaaaaagctaacatctaaaccactatagttaggcaaagctaacctattacattaaatacgttcaacattcaacattcaaaagttctaaatgtattaaatatttatagaattatacaagtcataaaatagttttcataaagcaatggatacatattacaagataaaaacggcatattaataaaagagaaccaggtcaaggtgacaagttaataatttgataattaattttcataaattacaaaaataaccaaccaacacattaaataattaacagcaaaagaagaaacacaaggagaagaatagaaggaggtgaagctctgaattctaaaacaagatgtgtagtgaagatagtgtgaagctggcgaacttttgggcgagtccatttggcaaaagggttgttaaatgggccttgaaactgaagggtttaacgaacggatacaaattatcgaatccgtaagatttttgtaagtttttttttaaagttaaaatatatattttcaaataatttaaaacaatgacacatgtaggactcaaatatatgaccttagatattccaaccaattaagttaataagtcaattatgttaaaaaataattaatgttgatatatataatactaaattttttaatgtatatttaatacacatataagtttacataataaattatgttgaaaatattaaagtaatagcatgagaaataactcaataatcaaaataaaattcaaattaaattaattatatatgactcattaattgataaaactaaaataaaagagaatcctatttaataggatcataactaacaattatcctaattaataaaatgaaactaatatccctaattaataaaataagaatctaaaataagaaaaaataaaaaaattagataaactaaacaattaaagatttagatgtgtattaaatatacctcaaaaaatttagtgttatatatatcaatattaattgttttttagtataattgatgtattaggtcagttggtttgaacatcgtgttaataacttgaagatcacgtgttcgagtcctacatgcatcattattttaaattatttgaaaaaatatatttggttatggagttgaacccgattcacaagaaggtttcagattcttgttcatgcccagaaaccaatcgctaagtcattcaccattcttgaatacattgatgaaacatggaagcagtatccattattacctcaagatccttatcaaagagcactcgcttgcttttgggccaatttcggttagcaaaaggtattttttattccaaattctctatttttttttttgaaggtttgttaaaccaatttggagattccatttgacgagataattcttgtaaaagcattttacatccatttttttacagttctaaattttcttagagagatactaagaatgaggatatatgttttattcgtttctgaatttttagaaacaatttacatatcattaacgaataatcggtggatgacatcaaaaagcactagggcaaatttgggtaatataatgttcatatttcatgcatattacaatgtgatgtttgattaaaaaataggtttattttgtaccattttttcttttttgagatttacaatgccacgtacactttcaacaaattaattatttttcagtgcctcctaatttgtatatatttttatatactagcttatgagtgcagcacgaaaagcaatggcaaccagccgggatgaacgcgaaaaggctagctcttaaggaaacgagagaactaatggagaaaatagaagaagcgattaagggaaagaaatattttggaggggacaacattgggtaccttgacattgcacttggatggatcacttactggcttcctgttgtggaggaatttggatcgatgcacataatagacccattgaaatttccagccatcacttcatggatgaccaattttctcagccaccctgtgatcaaggacaatttgcctccaagagacaagatgcttgtttactaccgcaacttggttaattaaggtttagatggatgtatttgacaaattatgaatttaataaaactactagctcttgtaaaatgtttttcataaattatgatgaatttattaaaaattgctcgtgtaatgtttttcatcaacaattaagactttgttgttaatttctttatagagtgaatttcccgttttaaagagttaattaaatattaatcttttataaagaataatatctttattagttgaataaaagttatataaactatgggagtaggtaatagggaataataaataatttgggtttgtaatatgtagtcgtcatccgattacaaaccctagcctcttcttggttgtattggcgtgtgtaatgcttattttcattaacggtatatacaagatcgagccttataatattggatacaactctatctagctagttagttatgagtgaagttcgtgagtttgatggtcaaattatcttactcgaatacaactaacgatgatggtaacagatcataataaacttatcttcatccatgcaatctagggatggaaataggtcaagttgtctatgaggggcctttgccctggcctggtctagtttgtttattataaatgtcaagtttggactttttgaaaagtctatttaaataaaaaaatcgggctcaagctttacaaaaagcctgttaggcctgccaggctaccctatatatatatatatagatagatattaaaattaaaaagatataaatcaatctttttaaaaaagagataaaataagataagataaaatctaaatagcttatcttactatttaataaaacttacgatattttactttgcttattttgtttacaatattttgttgaatactgtgttatgattataattcttaattgagtttgttgtaattagtgaattttaatctcatattagagtgctctaattaattttaatttttttcacatacaaattaaaagggaagtatgtcaatatgtgtatttctttatattaaattaaaaaaaatattatgcaaattctcgaagtttcactaatatataatatttattgtaaaataggctttttaataggttcataggccaagtcagacttttaaatagtctaagccaagcctaaaaaaataggtaaataggttaggccaggcttgatgtttttaaataagggcaagatcaaaattaggcctaaccaaacctgacctgacctatttccatccctaatacagcctttctaactagcagcaaataaaattataataagttccatctaattaatgtcagaacccatctctaatgtaacattgactattgaatatgctaaatatataaatagttttaaaactaagacaaataactaacgactgaaaacgacccttatagtgcagtccaagcatgatgattacaaaagatagtagtaaaacatttcggacaatgttattatggcagggnnnnnnnnnnnnnnnnnnnnnnnnnnnnnnnnnnatatatatatatatatatatatttttttttttttttcaaaacatgtacctaacatatgtcagtccgtatacatgtttatgtacttaattaacataaacaattaataatacataattgtttgaataattttatttatactattaattatgaagaatataagtaagaacagtttagctaggaaattagaaaaaatcacgttaattgttggatagtgagatgaaggtgccaagtgcaatccaatccaacgccaatattggtcaaatttgtctgccgtaaccaaccaacaaaagataaataactaatttgtgtatgcatattgttgacgagaaacagtgaaacacacatattaaagagacacgtaaactataccaaattaaaaagagaggcgtgtaaactataccaaattaaaaagagagacacatacaactacaaatgtattagagatatagaagaaacaaattaaaggaattgaaattatattttgaaagaagatgggaagcgaagaagtgaagctgttgagcatttgggtgagtccatttggtaaaagggttgagtgggctttgaaactgaagggaatagagtatgagtatattgaagaagatatctcaacaaaagcaatctccttctccagttgaacccggttcacaagaaggttccggttcttgttcatgcccacaaaccgattgcagagtcatttatcatccttgaatacattgatgaaacatggaagcagtatccattgttaccttacnnnnnnnnnnnnnnnnnnnnnnnnnnnnnnnnnnnnnnnnnnnnnttttttttttttttctctttcaaattcccttaatttttcttattgaggttgaaccaacttggagattccatttaacgagataaatcttttaaaagcatattgcatcctttttcgtaatttgtatttgcttagagaacgaggatgctttttttttcctttctgaatttttaaaaccataagaccatgtgtctgtctgtcattaacgaataaaaatttatgactccaaaaaacaccaaagaaattcgactgaagttcagatttcatgcatatgcaatcacaatgtgatgtttgattaaaaaatagcattattttgtacgatgttttttacacaaaaccacactttcaacaacttattattttccaattagtgcttgctctgtatatatttatatataatacaatagcttgggaaggctggatgggtagcaatgtctaccagcggagaagaacaggaaaaggctgtgaaggaagccatagaaatgatggagaaaatagagacgactgagtgaaaaatgtgcatattcgtaggtaagcaaactggattgagatctgatattccaatccaaacccatgtcagtaatctgtgtacattattgatcgagaaaactattttatgtggtcaaagtttatatacttttatatccatgaattttgtccttaaactttaaaaaaataatacgtagatttagtctattctctttaagaatttatcatgctttttaacatattttcttttaagtttaagaatcaaattcatcttgtggtgatttaatatgttctttaccttgttggtgttggttccgtttaatgctgttggcccaaatccctaggtgtgaaagggaattgtgattgggcccaaatcccaaggtgttgaccttggcccatttccatttagggtaaatccctaaatgctgtgcttctctataaatacccccattatagatggaggcaggtgacgcaacagaagattccagagctgacgctaggttgcggcagtgtgaggctgagcgaaaacagagagtgagtatttctccggcattgttggccgtcgagggtgtatctccgagagcttgtgagaggttcttgttgaggggtttcacttctgttgtaggcgaggctgggtggctccggtgagtgaccgttgagcatttgtattcattatttctgaatagtggatcgttttctggacttggtcccgtgggtttttcctcttgaaggttttctcccacgttaagctataatgtgtgttgattctctccctgctcttccctttgttttatgattctgtgtttccgctgcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttgattttaattgttaattcaagaaaaagattaaaaattacatatttattttttatataaaaatatcgtatgatgcaaatttattctttacatttctaacatagtaaagcgttgaatgtttttttaggataatgaaaaaataaacatataacattatattttattatgaaaaatcataatcaaaaccatcaatttttgtgagttttttaaaagtcacataatctctacatgtgaccccatgactttaaaactttatcacctatgaatggttataagtctcatatttatcattttnnnnnnnnnnctcttccctttgttttatgattctgtgtttccgctgcatattgtgcattctttcgtgttttttgggctgttctgggttgagacattgctccccagtgttatggtttggtagaggaagctcccagtcgaccagaggaacgtggtaccgggcacgttgtatccgggtacgtgtggtgccgagtacgtgaggtgtccgggtagaaattccacgttggttgtggtgccgagccgacttcgtggcatcggattgcaaattccacaacaccttttcataggtgatttacagagcacggttctttcgaccagggattgtgcatgtgaggttagtgtagtttagcactgcttttgttcgggttttaagaattcatattgctctaatgaagaatcaacataactcacagagttggcttggctccacaccctccatttgcacccttcaaaatatttccagtacttcacaagggtttgagctctgagataagcctgaaatcattgcattccaagaagtaatatctctgagataagtctaagtgacccatctcacagtacatgtcaacaagtcctcgttaccatgttttgtgtgctaaataattgaaaaagttacgcatagagagaggtgaaaacaaataccacaaaaggtacctaaaacccccgcatcccatcagactgtctgactgttacataagcctagaataaatccaagtaacttctgtggatatcaaaacataattagaaggatatacttgtgatcatcgacagatattaattagcagttaagttagtagaaaaaagacaagaaacagtacatcgatgcaacaatggttctaattaagtgaaattaacgtgctaacttgaaaatcaaaaggccttaacttcctttcctataatgtgaagtgaatcatctgcacaagagtatgaaaatgacacgttgttggatattcattttgagtcagaggtggaagtgaattttgaaacgaagtccatttggtcaaacttgtccccacatgagaaaaccaaatgaattacaccgataatttgcataaattacgagaataacccagcagacacactattaaaagagaggcacaaagaaggaagtggtgaaacacggaaggaagatgggaagcgaagaagtgaagctgttgagcttttttgcgagtccatttggcaaaagggtagaatgggccttgaaactgaagggtgtggagtatgagtacatagaacaagacatcttcaacaagagtagtctccttctcgagttgaacccggttcacaagaaggttccggttcttcttcatgcccacaaacccatcgctgagtcattcgtcatcgttgaatacgttgatgaaacatggaagcagtatccactgttgcctcaagatccttatcaaagagcacttgctcgattttgggctaatttcgctgagcaaaaggtcatttctaaacccccttttagcttttgttttccgccagtgggtttggcagatggcattttttttcttcataaatattaaagtgagaaactataatttttatttttaatatgtaattaataaataaataaataaaattcataaaaaacttactatgattctttgaaaattaattttaattcattttttcgtaaaacatttttaaggagaaaaaaagaatctaattttatcgagtaaaaaaaaagttttagttatatattttacataaatctttaattctcatgattcatattaaaattaactaaacatatttaagatattgtcaagaattatgattcttaaaatttatatttcctgagtataaaaagtttcttaactaccaaacacctcataaaaacaaacctatagattccaattgaggacccaaatacattcagcttattgcatagtttattttatagaccattttatgaatcaaatttagactacaaagactagataatgtagcaaattctcgaagtctggtttggttttttaatacaattgaaatattgtgacagcatagagtttttgtctttaacaaattatcatattattaaactaattaacttttataaacctaatttaaaagtcatgcatacaatattatctaagggcgtacttagtatgaactttttatacttttgatattttatttcatttgctttttggaatgaaaatgaacatgttattgtttttctatgttactctgtcatttattatctatatatcaagtgagttattcacatcttgttcgaaaatttgaacttaaaacaatataaatcaaagtgaagtgtggtaggccgaaaactcacgggtttcagaatggctcagacagctttagagaagcttcctttgcttcaatgaaagcattgatttgtaagccgtgattttaattcataatatagtagcacaaaattattttttgacttcttttgggatatatatatatatatatatatatatatacacacgttaaactctattcaattaacttgtttttcaatgacatccatgtatgtaagtaataacttatttttcaatgcttgccttgtgtgtgtataacagcttttagatgaagcatggattagtatgtatagcagcggggatgaccagcaaaaagctgtgaaagtagccagagaagcaatagagaagatagaagaagagattaaggggaagaaatattttggaggggagaatataggataccttgacattgcacttggatggatctcttactggcttcctatttgggaggaacttggatcgatacagataattgacccattgaaatttccagccaccactgcatggatgaccaattttcttagccatcctgtgatcaaggacaacttgcccccaagagacaagatgcttgtttactaccaaagtcgcagagatgggctttcttcaacttttcagggctgattcaaggtttaatttagatctattcctattcctctatatgtttcttatggtccatgttataggccatgatattggattgccttagtatcataagaatatgagggaatcatactagctaagtttgtgtgttggggttttttgtgctattattttctgcggatgccaatagcaagattgtggattagtttgatgtcttaagttaaaacttgtggaataattttgtgaattttatttagactttttcttgttatgtagagaagtttctttggttaaattttcaatattaaattatgtctttcttgttatcttttcgttgacgttatttcaataaatttaataaattataaatgagttgatgaaataattagccaccattcactaggatgtaaagcatgggaaatggaataactaaaatcaattgatttgcgttcttgattttaattgttaattcaagaaaaagattaaaaattacatatttattttttatataaaaatatcgtatgatgcaaatttattctttacatttctaacatagtaaagcgttgaatgtttttttaggataatgaaaaaataaacatataacattatattttattatgaaaaatcataatcaaaaccatcaatttttgtgagttttttaaaagtcacataatctctacatgtgaccccatgactttaaaactttatcacctatgaatggttataagtctcatatttatcatttttaatcattataagtctcaaatgtatcattcatataacttcttataagctcacattttttgtgtgagaattcttacttttgtgtaaatataagacttataatgatcattttaatataattctatctcattctttttttttaagactctttatgattgattaaaatttattaaaatcattatatttaataggttttacttcttatataatgatcatttttcttaatttatattaaacgaaaaacaaaatatactaaaattgatgatttatgataaattttgatcaattataaaatgaatctttaaaaaagtgttaagaaaaataccactaacattcctcaatgcattctattgtaaattataatcctcatgcaaacttgtaaaatcgattccaactcatcatccttgggttagtaatttttttttgtcatatccatgtggttcgtatggctaagctgctacgtatatgattcttacaagcttcaatgcttcatagttaagtggttcaatcctaaagcttatttatatataagaattcacttgagcttgtgggaaagctcatgggaaagctcaattagcacgcatgtggagtttgtgataatacatattggattctcataaaatacactcttaaaaagaaataaaaaatattaagtataattaaatcccaaactaaaggattacaattgttattataattacccatataaaaagttcacaaatttaaatttattgactgataaattatacataaccttataatcaatagtcaacaatatttttgtcttttattataatattttatttcatctctattatgcattaattattttttttactaaaatatccttatttatttcaatttataattaaacgctactttaaaatgtcaattttccttattgaagaagataagtaaactctcattaatgttaatgacaaattttaaaatattacaattaaagaaggatttaatatcaatacctatattaactaattttcttaattatgtgttataaataagatgagagagagtatccttttaagtaacatctagtagttgaaacaatcagttttctttcgtccaatttgtcattttatttaaatttttcacaaattaaatcattaaattattttaaacctctttctcttaaaagctactaaccaaaatacaaaattttattttttataataaaacattttttttaaaaaaagtcgaaattttcattcttcaaaccccaatcttatcttttacaatttttgtcttcaaattttatcaaaatttcattaaatttctaacaaataaatttctaaaactcttatcacaaatttattataaactccccccaaatatttgaataaaaagtgaaaatataatgattttcgattaagatcactatttactgcaaccaattacggcctacctaagaatttctcatcgaaggtcaaaagatattatgtccaattaacataatttacaattataatttataaatagaaatagcaatcaagttacggtagtcacctctgccaaaagaagaaatggtataattttacagtgtaatcatacctaagctagggatcattcgtattataaccaaaatcagctaccttacactacaaactatacaataatatgcaatggagacgtgaatatataaaacatcatcacataacatttgcattttaacctactcttaaattaccacgagacggttatattcatcagaagctaaaacctgtttacacttgaaccttaaaaacaaaacttacttaccccactcatgaacagggagaggagttagccttgtctcgttactctcaaaactaatatcatccaaaccacgacgctctgtaaaatttagcggtgactgatcacacaggtctaaattccaaaacaacttgagataattcaggcaggcaacttcagtttcgaattgttcttccagctgaaaaacaaagctccttaaattacctatttgttatatgagtatagtaaaaacaagatggaccttaacagacaataaaattacctgacgaagtaatagtaaaagaaatctgcatacaaagctgtctgaacaacacctgagacacaagctgtaatagtaaaacaatatagaagttagaatattgctaaggttgacataatgtcaaagtaggttttattttcaccctttattacctatccatctagtaaaatgtggctcagtcagatagcggtatatccagttcaggatgtaaaatgcacgatatgcactgcattttaaaaataatcagcacatctttgatcataataatcagtacattctataagagtttactcttatacattctgagacaagttcaaattgaaatgtatgtacaacttactaaatcctcaagtaattgtgcaaacatcaagacaggagacaaattaggaaatacataagcagaagagtccaattcaacccaataaacatcaagatttccaaatcaggtaccacaaaaaagttcgggcaaacatatacctatggagctaatttataatacatcactttcgaggagtttaatttcttagctatttcaagatagaaaatattagtataccattgtcactagaagatatctcaataacttagaaaggactatctgctaatgatcagcataaaggagtgtaagcaagtaagcaaccaaaacataaaggcagatctttaaaagagaactcaacagaagtgtgcatacccaagaaagaatacatattgcccagtcaaattgtccacatttccacttctttgcaacaaaaccaactggggtaatattgcaactgcctccaagtatattgaaaatgcccagaaaacctgtaacagattgacataacatcaactatttatgatgttacaatgtgtaacagaattatcataaaggtaacatgtaatgcaaaaaacaattttcagattggcaatcaataaggaatcaaggataagcaatgtatgtttggacaggaagaacacatgaaaccatgtgatgtatttgctttaacttttgcaatattaacctgaaaaataatgggaaaggccagttacacattttgcagattccataaggaaatagatattcccagaagttttataacacaataagcagcagcctatcgtaccattttatgacttttagcctttcccagttaactatgtatcagagccataagacatgtatgcattgcatttttcaaactatcaagtattaacgacgtatctttttctccaagagttggcatcaatattgtaccaaacttggtcatcctttcaagcatgataccacatgggtccctaacataatgttttttatatttccacctaaaatctgaagagcattcagaaaccaattacattttttggccaatcaggaagagaagcagcgccaaacaatagatttagcactaggcggatttctagataacataacaactagttgttaataaacttacaaaatcatcaggccataatataatttacttcagcttcttatcttggttaaaaaaattggaagtattcattccaataatgtatgacaaattgacaattgacagagtactgaactattggtaaattttcaactactgaaatttatcttagaaagcagcataaatgatccagtttccaggattaaaatacaacaggctcccaaaatttgagacttaaaaaatagagttatgaggtgatttatcatttatagaggctctatatgacatgagtcaaatggtaagacataacataaaaatagagttatgtaagggaagaactacattccttagctgttagcacttagcatcactctgaaacaaaaggcaacatgagtcacatgacacagatcccctcaaagaatcaattgatatactcactaagaaaaacatgttattatcaataacacaattagaagaatatgttcacacagctagcattggttcattagcttaagagctatgccacatcatatggaccatataaatcttactcaaaagtaattgttcaatgaaactcatatatactaaactgtaacccaccaatcaatctcacggagattccaaatgaagaaacacttgagaactttgatcttaaagttttatttttcctcctgttttgtgtaagaacagcatttgaacacataaacatggttttcacgccagaaaacttaaatggatacactactgttcagagaattttggcaataccatcagattcaataatttgacaaaattaaacactcttcaatgaaatattgaaaccttgagttgaatacaatctattgaagctttcttttaaagaagtaaaaattcgaagaaatgcacaatgattaaccatcagaaatcagaaactcaatacaaatgaaaaacaataaaaccccacagctcaaatacagaagaagacaacatgcaaatgcataaccaaaaaatcaatctatgccagtacaacactacttacataacacattcacaatgcaaaactctaaaaaaaaaaaaaagaagaagatatcattcaacacatgaatcattagaaactaaaaccaagctaactagaaagcagagaataataagtgcaaaaaggggagtgagttgaaaaagcaagggacctcttgaacagtgaacttttcatgcaagatgagtgccatagcaaagcttgccccaacaaggaaataatggcgaaaagtgtcgagttccctatcgtaacttctcctgaccatggggtgaaaacgcatacaccaaacaatggctaaggagctggcaatgaacaccaccttcatgaaggtgttgtaaacggagatgaagtccgtgaacagatccaaatagcgtgccacgaacacaatcgcgtagagctcttgagtcttgcgagaaatccctgaaaataaacagttccaatcaatcgatgaaatgatggaaaataaacatagggaattttgtttggcggaggaatgtgagtgacggaatgacactcgagaatgaaaatttggaaaatagagtaaaaaaatagccccaattttgggggaaccacgagaaaagagagagagagagagagaatggagtgaagagacctgagcatgatttggtggcgtagattttgaggaggaggacgagaatgctgagaagatgtgtcatatcaccggcgagcctgaagatgttcatggtttttgccctagcgagacacacagagagaaaacgttacaaagggaacggagaaagaaacgaaatggaaaggaatcgaaaatggagtgtgtggattttattttttttgtttctcttatttatttttttggtcgttttggtaaaagcagaacagtataagcgtgtgttcgtgtgccttccgtgaaaaggaagaagctgacggctgaggtgccactcgccctcgtctcaccgcttccttctttttttcttcttaaaattaatgaaactttaatgatttaatctcgcaataaaattaaaaataaatattaactcaattcattgtattttacaaatcatagtttaacaatttctttaatgtttaaatatgtcgtaactaagattggatagtttagatgttatttaaatttgaacatttgaaaataatttttttgttaaactttccttatttattgatcgtattctaattaaaattcattttcatttataaatcagaagattaagaaaaaaaaaaccatagtttaataatcaaaatttcaatagataaattacactttatctaaaaaataattattaaatattttttcatgagtcaactacagagtcattcagatatttcatggcaatttccctctttcctttattgcttttgccccttttctttgtttctttcactctcggcacttcaaccttcatttcgacaccaaatcaagaaggggagaaacaagcacttctattctggaactgatgctgccagaaaaacataagattccttcgatctgtgcacaaaaggtaatcatagtcaaatgatgcattgataatgtcctgctagttgaaactcaggaagaaaaaaaataatcatagtcaaatgatacattgatactgtcatgctagttgaaacttaggaagaaaaagagaagacaaaaaaaatgtgtagatatgattagatgatatgatgtaataagaaaagagataacagagaattaataagtgttgatagaaaatcttaaaacttcaatttactgttccgttttcctaatggattagtttctgataccgtgtttgttttcagtttcacaagaagactaaggaatatcatagagaaaaaaatgagcgctattgtttccattaccagaaagaaagtttgaggaatacccaattacccgacaactatgtctcatgtttcgcagcaattgcagaatggacgagtgccacaaaaggcgagatggggcaaaggacgaatgtgaagagcctcaggagttactacttggtgcaaaaagtgttagtctgcctatccacataaagcaagcacgctctttgaatggttgtgaggtctctgaatccatgagctcaattttgaatcaaattatgatggctctggcgcaaccacatatcatcattctaggggtgtatggatcaagtaatgcgagaaagcgaacgtggtggagaaaatcaccaggagaattcggagggacaatctgtttgatgtggttgtgatggcaagtttgatgaaaaagccagacttcagaagaattcaagatgagcttgagaacatgctgggtctgcaactccatgagaagactctggagggaagagctacgcgtttgcgtgaaaggataaagatggaggagaagatccttatcatccttgatgatctttgggtggaatcaacttgggtaggataggaattccgtttggaaatgatcacaaaggttgtaagattttgttagtagctgagagtcaagaagggttgtccaaccaaatgaatactcagatagaaatatccgtgtgagtcttcagaaatagaatggaaactagatttgaaaggtcagagttatcaataaaaattttcaatggcaaggattaccatcccctttcttttaaattcccaagttgaaaatctttctataatggtttatgcatcttatcttgaacacactcccttcttaattctgccttttcacatctttgactcaatctaatgtgttattatgatataaataaaatttgatggtgaacataacttattaaatataaaaaatgaacatagaggagataccgagaaattgtgcacggcaccccttataggattaaacacacttcgtacgctgggtggcacacgcatctcctattttgcaatttattttccttagaaatgaagctacataacatttcgtgcatcctgataagtcttctcacgcggcggtggcatacatagcaaatgaagtttgtggcataaattaatcagtattattctctcaaatgtgaaatggtatatgccaccgcctgcagcttgtatataactcgtatttcctttaggccattggggtatatcagcttctgctattggtttcagacctttaattcttcaagcccttctataaacacaacttaatttgattcaatatagcctccccttaacttttaggacagttagtccttcacagcacacccaattaaggaagtagatattattattcaatgggggctgctcttgcaactgctaagaaattaaagaaacaaccttgtcatctcagtgacatgcacaactttgagtcccaagtagaggaactaagaaagagcaaaatgtcaattgcacctcttgcttgtttcttacagccacatcaagcaataatttccaattgttccaaggtctctggattgataaacacagctctggaagagaccatggaagctctagcaaatccaaatattaacatggttggggtgtatggatcaagcactttgcatacgaacaatttaattgaaaaaatttcaagaagagtaaagagagataacttgtttgatgtaactgtaatggcaagtgtcacaaaaaagccagacctgaagaggattcaaggagagctcgggaacaagttaggtttgcaatttggtgaggagactgtggttggaagagttaaacttctgtgtggaaggataaagaaagagcagagaatccttgtcatcctagatgatctttgtgctggaattgacttggataaagtaggaatcccatttggaattgacaataagggatgcaaaatactcttgttatcagggtctccagaggtattgttcaaccaaatgaacactgcgatgaattatttctcgtgagtctttcttctaagaataacacaactttttgcagagagatcagaagacaagagatattagtaaagtaatttaaacaactcagagaaaacaatatctcttttaattgaaagcagttttttttatctattcaagggtatctgaagctcagaaaccatagtgttgtgaagatgaattgtgaagactgaagaaactgtataagccataatagaatattataattaaagaacatggcttctatctggtttgtttatctcacagacagcaacaataaattgacttatgttttattgttccacagggagaagtgaggcatttattagttttcacattttggataattaattgaaacaaatgataaaaaacaaggctttaatagtttatacagcttgcttaattgtgattgatttgatttcaaatctgcttacttgagtgataatagagtgtgtttcctttttctacactagtgtgcatcttttatcagctcacaaccaattgagatctcacttctctatcaactttatctgccttgatataccaccttaatcttcctaactgattgataaaagatatccccacaaaatacaaccgtaagttattttacaactaaaccttgtacctaattaccacccacttgacatctatataagcaccctctccataccaccttctacgcgccaaaacattctttgcaataacgacttccaattcatttgcaatttagcaacaaagcaagccttcaataaccaacaagaagatgaatcagtctcttgttctcactccttctacttgccccatttttctctttcactactttagctcagtcaccagctgcagctcctaaagcccctgcaaaacctgcccccgccacaccggctccagcacccacgaaaccattggtcccggcattacctcagtcaccctcttcagttgttgattcttctagaagccaagaaattgtaaagatcctaaggaaggccaagtcattcaacacactatccggttgctgaaaacaacccaaatcatcaaccaagttaacgcgcagcttgtgacctcgaaaaacggaggcttaaccattcttgcgccagatgatggtgccttttcagaactgaaaacagggtactgttgcgttcacaaagagcgattgcgtaactcacggcaagtatactgatcgttcaagtaataaatttagtaagtagagtatcgtcttcacgaggattgaggcactaaaataattgtaactcttatcttaaaattagaaagaataaaaataaaaggaattgaatttggtaataatgttgtgatttgaatttagataataagacagaatttaaataaaagaaaattataagaattaattatgagaatttatacagtaataaagaataattgtgatgaaaacctaatcacctttgatccctccttatgtaaattgaattgatacttaattacaattgttataattactcaaagatataccttcgtatattggttaaacccagatttcgcggtctttttaaccctttaattctattcaagtgtcctaatgtcttagtaacccctttcagattaagcattaagctattaaactggaatataaaaactttgcaatccttcaatcctatgtctaggtaatgtcaaactgtctctttattgctttcagaaactaaaacctcaatatgtctattgcgaattaaaatcctaagttcttctaacagattgatcagatctattaatggaaattataaattcaagaacaagataaagggaagaaatcataacaatattcattaatcatcaatccaagaaacataagagttcacattggcttttggccttcaccacaatcaaggagtaattagctagacataattatgtctagctcaatacaaagatgagaaattagatgagacagaatacaagatagaaaagtaatcaaacccctcaatcttgacttcttccaattttcaatgctttattgatttcctttaatgtctccgtgtgtgtatctgtgtatttcttcctctgaaagtattttgtggcttccttatttatagttaggtttgttaaccctaaaagctcattgatcttatcttatctttaatctttaatttgaaattcccgtaacgtgcgcccgactggcactaatttcttcctttattgttcctaaaatgcataaaaataacaataattaataatattcaaaaaatactgaacttttggcctaattctattatttatttaacattttctacttaatttttactaaaattatcctaaatttcactatatattagcaatccatcaggtacttcaactcccagggagataagcaacaaaaagcattgatacagtatcatgttcttcctgtttatgtgtccagctccaagtttgatgctctgagcaaccctgtgttcacattggccagtgacagccccacagggtatcagttaaacgtgacagcatatggtaacagtgaaacatttcaactggggtggtgaatgccacattcacaggcattgtgtacactgataaaacacttgccatatatcatgtggacaaggtgctcattcctttggatttctctaagccaaagcctatagctccagtaccagctgtggccaaggctcctaaagctgataaggacaactcttcagcagaagatgatgaccaggctcaggcaaccaaggacagctctgtatccgtcggtttgactagtactcatgagacaaccttggtgtcctttggagttgccaactctttcttttaaatccaaagaaatgtaagagtgaagattaattattgattgatacaaaaataataataggaaaagatcgatgagaagatgtgaactcattataaggggattttttttttttttctctctaaacgccgaccctttgtttgattgatgttgtctttctcttttatcatcatcatcacctaataaaagtaaagttttcgatgataaattcagttattaaaaatattattttatcctttttcctaagtagggtaaaaaggaatcaaattgatcagtgtgtccaaaccaaaacagctaaacaataacaatattatttaacagtcttttagtctttattactattttatcgataatgtgacaaccatctattaaaatacaaacttgtatttcttaaatgataaagattaaaataaagattttttttttcatataaaaacaacgtactatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaagtcataaaaactaaaaaaataacattaaggattaaaattataaaataattaagattgcataaggatttttttttagacagtacaaggactaaattagaaaaaaaattacaataactaaaagcataaaacggatgtattaatttataactacatttcaactttgtttaataaaggtagtttgacaaaaagagctttgttttagtttatttactcatttaattcttataattataaaaaaatttcttttattgtccttatgcttaaaaacatcatctttaattccttctaatcctctcagtaaaagtaaaaatatataggccggccagttatttgaaaggagtctactatctaacctacctgagacatatgattgaacagaactttttaaaaaataaattagataaagacttttattaagaaaacagattcgcatacatatataagctagaatcgtacacttcacgtccatctgcataagtggttagttacgtgtatatttaatacattttaatcaaccatagaatatgtttaaaagaacatattagggcgttcctaccttttctcttccacttttaatccttgcctggcagtttcacgagtcaacaacacagtaatattttaacacttcctagcaatgttgcatagccagaggagcatttcccagaaacttggttcttttctttatttttgcttctataagctaggctttttctttgcatcttccactctcgtacttattaatccttcttttccactccactccgctccaaaccgaatagggagagaagcaagcacttcatatctataaaatcccggaactgatgaaatagcagcaagaaaaacataaggcatgtttgagtaaacattcatagaagaaactcactattttcttgtacgttaataatgcatgagactgaacgcgaacaagcaaccatcacaagcatagcagtccgtcgccgtcggggcaaagtgtaagaaacttttctttactgttctatttcactattagaaactaaatgggagctatatattgagagaaattaagtttcagaaacacccaattgcctgacagctatgactcatatttttcaggaaagtgaggatggatgatagtaatgaggtacaaatagcaataagggccaaattaggacgaataccctccaactgcgcgccctgcaattattttccaacttcggaggatccctatgaggaatcacttaacgcaggcgattgcaattctcctcgttgtgagtactcatttagtgcaggcaaatgcaatcagatttttccgtccgctaaatgcaccttaattgttgatgaaataataactgctctgaggcaaccaaatattaccatagttggactgtatggatcaagttatgcgagaaagcaccaagtggtgaagataatgaccaggagagttgagagggacgggctgtttgatgaggttgtgatggcaagcatgacgaaaaagccagacattaaaagaattcaaggagaatttgagaacaaactaggtctgtgcctccaagaaaaaactctcaagggaagagctacccgtttatgtgaaagtataaagacgaaggagaagatccttattgtcttggatgacctttggggcggaatcaactttggtgagataggaataccgtttggaaatgatcacaaaggttgtaaaattctgttagtagctgagaatcaacaagtgttgtccgacaaaatgaaaacccagaaagaatattctctggacgtgcccgtcaacgttggcctaataacgaggagtttaagttgaaactttctggatttattttatttagactttctcaccgaatttctctcataaggaaaaaaaaaatggacactttggaatgtcattagacacctgatgatagaaaaaaataaaaatattataagatttataatatgataaaaaaataaaaaaaaatattgataaagtgtttaatattgtagaatcctcatgtattactattattgtaaaaaagtttgtttttattaggattcagcgcagagtgcagttttctgcctgatatgtatttccgttgtgtgattaagtattgttagcttattttattaaatttatttcaacaaatttaataaattttaaatgtttttgcattaaatttttattaaataagttgttcatgtaggagaataccaaaaagagagggtggagcgttttagttcgaagccaaacatgtaatcatgaattttggtgagtcatgtaactcatttcctatttatacatgatgtctttgacaatatctttaacgtgttgaaatcttattagatacttttcgccacaccattgtggagcactggagcctatataagtctacgtagtatgtggtgcaagattgtgtgcgtctcacatgtcagtcaaaccctgtcaccacgtctttagggtattatttcgtattgtacctccaatcgcttcatcttctcggtcatggagtgagttaagcgtcattctgatgacccggtgtcattgaggcgagtcggttgttcgagaattcgttttgaatgatatcttgtggcatagatatacataaaaacaagtcatccctcctactagagtcagcatttctgggatattcatcctggatgatgatgtacataagtatttaatgaaaatatttaatcatatttgaacacaacaaaaatcatatttaatgaagatatttactcatcaataactttggaaaaaagaaaaagaaaactaaaacatcaataattttggttcaaaaagagcagaagagttatgtaaaaattagccaccacccgtgaggtatctaaaacatgggaaagggaatatctagtattccgaccaatgaacttgcccttcggtttcggttttcaaaatctggaatattcaattgcagaagcttaaatgcaggtaatgtagtattaattttaaatccttgcctggcagtgacagcttcacgagttaacaactgaggcatctagatacttcctagcaatgctgtttaattagccaatgggtcatttcctggcaacttcttcactcttttgtttattggttttattgttttaagccttttttttatttgttcctctctagtgtcatcatatgtaaagcttcactcttttgtttattggttttattgttttaagccttttttatttgttactctctagtgccataatatgtaaagctgtccatttggatatttaatgtaatgtaagaattgattttgaaatcattacttaaactaaaataatcttgtatcaattgatataggtgttcaataatttcatttttaattattcttcttagtatgattgactcgatcaatgtgttattatgatatagttaagttttatagcaatcataatatgttaaatataaaaagagaaatgttactaaaacattttttgacatactcttttgaacatattatcttttattgattgaaatttcttaaaaattacataagttagtgggtcttatatcatatttaataactctcttttatgattttgtaattttcaataaatttcaactaatgataaatgtatgtttaaaggaatgtgttaaaaagtatcttcctagccctcgtcttatataagaatgaacacaggagagaaaatgtgcccggtactcccatcatatacacacttcatatgtacagtggcgtgtgctctccaatttatatttgcatatattagagtgtgttagaatgttctatttcgccaacatttttctttttttaagtgcttcctaagcaatgaagccacctaacatttggcacttcctggcaagtcctcttacgcggatgtaacatacatagctcatgaagtttgtgaaaataattacccattatttttctctcaacctgcagcttcagcttgtataaaaatcattgggttatatctattggtttcagactttaattcttcaagcccttcgatctataaactaaacttaatttgtttcaatataacctccacttaacttatatgatagttggtgccggaggtaagggatttgatagaaaaagatttagtgttggatgtttgaagtcctataccaagagctatcaaatgtgagcataaagagaatcttagtaatataacaagttattggactccggtctatatagacccatataatcatgcatttaacttattagacttgtatgtgaatatattatttaaatatatattaaatatattcaaaagttggttcttcacagcataccaaattagggaagcagatattaatattcaatgggggctgctcttgcaattgctaaaacttttaagaagcaaacatgtcctctcagtgacaagcacaacttggaatcccaattagaggaaccactcagcaatagcaaaatttggattgttttgtacctcttgcatgtttcttacctctaaagcaagcaataatttccaattgttatgatgtctccggattgataaactgggctctggaagacactatggaagctcttacaaatccaaaataacatggttggggtcatgggtttatggatcaaccagttcgtgcacaaacaatcgaattgaggtctagagtaatgagagataacttgcttgatcttactgtgatggcaattgttacagaaaagccagacctgaagcagatacagggagtgctagcttgggaacaagttaggtttaaatttggtgaggagattgtgaatggaagagctaaacttctgtgtgaaaggataaagaaacagaagacgatccttttcttcctagatgatctttcttctggaatttgatttggacagagtaggaatcccatttggaattgatcataagggtttcaaaatagttttgttctcggggtgtccaggggtattgttcaaccaaattaacactgcaatgaattatttcacgtgagtctttcttctaagcataactcaacttgtttgtatagagatcacaagacgagaaattagtaaaccaatttaagataacaaatagaaaacaatctctcttttaacatctctagatctttccctatgaatagcagcattttttgcttatgttctatttagttgaaacttgaaagcaaaataatctttttttcgcttgtatttatttcataagtacttgaagcttagaaaccacagtgttgtgttgatgaattgttaagaaggaagagagtatataaaccataatagaatattatgattaaggaacctggctttgatatggtttacttatctccctgactgctacaataaattgacttctgttatgattaattattcgacagagggaagtgaggcttttattagtttttccaacctggcttttttatgattgattaaacaaatgataaaaaaaaaaaataagggtttaacagttactacagcttgcttaactgtgattgatttgatttcacatctgcttacccgaatgataatagagggcgcttcctttttctgcactactgtgcatctttcatcagctcagcacaagcacaaccaattgagatctcttttctcattcaattttccctgcatttcaagcaaaaggacaaacaacacagcagccaaatccacttctcaatcaactttatctgcatcgatataccaccttaatattcctaacagatggagaaatggtatccccacaaaatacaaccatatgttattttacaactaaacctttgtacctaatcaccattcacttggcgactatataagcaccctcctccattccagcttccacacatcaaaacattctttgcaatagcaacttccaattcattttcaatttagcggcagccttcaattaccaacaagaatatgaagcaaactctcttcttctcactccttctactctccactattttctcaatcaccactttagctcagtcaccagctgcagcccctaaagccccagcaaaacctgcccctgccactctggctccagcgccggcaaaacctttagtgccttcattaccccagtctccatcttcaggagttgactcttctggaagccaagacattgtgaagatcctaaggaaggccaagtcattcaacactctaatccggttgctgaaaacaacccaaatcatcaaccaagtgaatgcacagcttgtgacctcgaaaaacggaggcttaaccatccttgcaccagatgatggagcattttcagaactgaaagcagggtacttcaactccctgggagaccggcaacaaaaggcactgattcagtatcatgttcttcccgtttatgtgtccagctccaactttgatgctctgagcaaccctgtgctcacattggccagtgacagcccgacagggtatcagttaaacgtgacagcatatggtaacagtgtaaacatttcaactggggtggtgaatgccacgctcacaggcattgtgtacactgataagacacttgccatatatcatgtggacaaggtgctcattcctttggacttctctaagcctaagcctatagctccagcaccagctgtggctaaagctcctaaagctgataaggacaacgcttcagcagaagatgatgaccaggctcaggcagccaaggacagttctggtgccatgagtttggttagtactcatgggacaaccttggtgtcctttggagttgcacttcttgcagcagcagctacaatgtcgtgttgaagaacatccatttctccagagtttctaatatgttttgaggacaagcacgcaactgttgtggagttctgtttttgttgttttcttcttgacctgtgtattgagtagcaaaagtggtgtttgtgagttatgtgaacctttgttctgttcttgttttgtcatcaagcgaaaaaatatgtgattgttttattgtcaaagataaaaggaatatctgcttgtttttgcttagttttgtgctgttcagttatatgcaccgctcggaatcatcttccactccctcgtctatgagttgcatagatcaatattcttacactaggaaatatgtataactatctaataataatcataaagatgtataagtacattttacaagacaaaatccgttgacactaaacgtaaaagctttaaaaacttgtgtctttactaagttttaataaatgtgatatataagaaccatcaaagaattatgccacaaaaactagtcgctagagtctgagagagtttaagtacttgtgaattttatgttagaattccacactttaaatacgagactaatatttttcagtacagcagaatatagtttactcaaaaaaattattaaatgtgtaaatttgctaagtcttaaacgtggttaataaattatcacttacaatttagataaagttcatgagattatttatgttttgacaataataaaaattattttttaaaataaactaaaataaggtataaccgcaaacttaaagaaattaatacttaaaataattatcatgataactcaccaaagaaaaaccattagcaaacatttcaaaatgtttttatcatttaatactattggatctttaaaaaaatttaaaatgttagttacgcatcacttttcttttacatttattaaagatgtctccattatctttatttatctattatgtgatttgtcattttaaggcttttcacttgatggctcagaaaaagttgacaataaaccttttcttatagtaagttggcaataaactaaacttcctgaatcgctttagttgtctataatgttggacgcgtagcattcatttttttatataaaaataaactatgttaaataatcaatacaagtaatgtagcattaaatagtattaggaaaattgcttctcccaattaaaagcaccattgctatatatgtgaagaaggatagacccaaatttgttaagggaaaaaaattatctttataagtaattgaaggtgcacttatacagttatacacatcctcaaaaactttaattcattataagtctttagatcttaggtgcacttattcagttatacacatactcaaaaatatgtgataataaacttactatcctcggaaattattaataaaatttgttttatgaataatatattctccaaactaaccatttatattgttttgggatgatataatcaaatggagagatataggtagtatgacataattcaggtatatgattaggccctccatccttacctaaatctctctcagacaacgccacttaagatttctaccatattgggtttttgttccccctagcggctagctacttgatggaacttctaaacctattatacagactcatcgtcccctttccacctatattttatctcatgcatccaactgattgcaacaatgatgtgaaagcaaaattaatagttcccttgcatgtacactttaacataccatgggttcaaaaatatcccctccccctcaccagttataaatcacactatatatgatgcaccacctttccgtgacaagcaaaggagatttgttctttacaactaggtatacctttccaactaaaccattgcaccttccaatcattgatatcacattcaattcccttccaccctccaaaatatataaaaggcaactccttctcccacttctctcacactccagcactccaaaataagcagtatagtagtcttaaaaaaaaacatcccacacactatcattcaccctagccaaaaccctagaaatgaggatcatgcaagagtctcaatctttcattattcccaccacaattctactactagcactatgctacaccacttcagcccaactttcaccaattcaaccccccacaacatcaccatcacccccatcaccaccactatcccaaccctccccgccgtctccggcactccaatcccctccggcaaccgcgccggcgccagggatcaacactgttcctcttgtcccagtaaccccaagtggggcccccgcacccaccaccatcatccctaagggccccaccattgacatagtccaaatcctaagaaaagccaaaaggttctcagtcctcactcgccttctcaaaaccacacaactcataaaccaactcaactcacagctcgtaacttcaagctcaggagggttaaccctatttgcacccgaagacagtgccttctccaaactcaaagcagggttcctcaactctctcactgatagacagaaggtggagctcttacagttccacactctctcttccgtcatttccatctcaaactttgataccctcaccaacccggttcagacgcaggccggtgatgaccctcagaggctgcaacttaacgtcaccacttacggcggcagccaggtcagcatggccaccggcgccgtcaacgcctccgtcaccggaaccgtttactccgacaataagttggccatataccaggtggacaaggtgcttctccctcttgacctagtgcttcccagcaaggcgccggcaccggcaccggcgttggcgaaaaagggtttgccgaaggctgataaagggaattccacggcggcagacgatggcactgttggcggcgacgatgacagcgacgggaaggccttgccggtgggtgtttctgcagggtgtacgatgaagtcggtgaataacgttgttgttgttggagtggtgggtttggtgggtggagttttgatataaggtgagtgggcatgaataaagggattccataatttttgttgtgattttgtgagtaatatatgtattgattccatcgtgcttaattggggttctggtttgtggtagagggtagggtgaaaatgtatgcatgcatgcatgacaagctgggtttcttttactatgtttcttcttcttttgttttgataagtggtgatttgtgttaatggatttctggctttgtaaccggatttataaaagaaaaagttctgtgtatatatatttttgcttttcaaaatgagtattaattaattgacgatgatttattaatttgctgctgaagagtaattaacgacatgttcgtagttatgattgtctgatatgatgtaataactaattggatgcatggtgcatgaatttcttctttagaggaggtcgaggatcacaaattttatacttctaccaattatataacagatatgattaatgatttacaaagtacataggatttcattgcagtttataattgactcagtgatcacatattatttaacactagctaaggttaactctaaaattaatagaatgaaataaaaaagaaacatgatatgcaagaaatgaaagagttacattttcatagagtactgaatgattatttgttctgtttttttattcatcttctttttttagaaacaggttaatttgaatcttaactaattcaaaactaataaggttatttaaagaaatataaaaaatatatgataattaatagaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaatatttaataaaaataataaaaatattattgtttcattgataataaaaataaatttcaatagagaatacatggtatatatagtaagtttttggaattttttttatttttaagaaaagcttaataattaatttgattaataaatatgtttttagttgtcatttataaatttcttgttatattaatgttaatgaaagaaatttgagtgtcaattttaaaatagtaaaaactcacaaggttcataagacacgttacaaagaaagaaatacatgcatgtataactatataaactaaaattgaaaatacatacatggttttacgataattttaaaattaaaaacgaattctatgtggaaatcgatatttttaatttttttgaattatatatataaaatgataaaaacttgaaacggacaagcaaaatttatgaactttgggctttcggcctacgagctagtccaaaatatatcttgacttgatcaatttattgtttggtagctcaattacatttaatgttttattttgtccacaaaacacatgtcctcaacttcattacttgctaatacgattttttcctttacttattataacattattacagaggatttagcaattttgctggtgaataatatctataaaaaaactaactatttttagtgaaatatctcttctctttttttatttattacataattttacttggaaagaaaattaaaactgtagagtgtgcaatcatagggtattcataacaattgaagcgtaatatgtttaaaatatgtgtaaactaaaaattaatgttatctttatatattattataaattataattttttatcgtcttttacatacgcatttcaaaaatattataaaaaaactagttgtaatttttttcgattatttttttttattgtgggagcagttttagtaaaaattaaagagtacttttgaagtaagtacttttgtcggggggagtaattaaagagtacttttttaaaaaatactactacataaattcatttttaaaaaaaaatacttactgtgattgcacttagtcgctttcttacttacatattattagtagtactgtagaagatcatgcagcaagctatatagatttaattatataaaagattttttagttgccacatttcaatttcttacatctacatatctgtcaaaaacacatttgaaatcttaaactcagccacaccacacaccactgttctgttaagagaacaaaaggctttggtccaaaagtcatctgcatttttcagtcacggaagaggcaattaatgcatgtgctacctagctttaaacaactccttccatcttaattcttagcggtcaaataatagaaacacattaatggagaggataggttactggttagagattattatttgaaaaaaaaaaaaaaacatgtaaaagtagtactactgtgttttaaaagcccgtttgaaaattaaagtgccttagccctgggtgcgtatttgaaagggtgactttatgtggctcttcatcaattcattctgaggagcaacaaatgttatattgttgactggccctacttaattaattactacgtaagaaacaaattaagcagaggaaaagtctaagagatcttccaacatttcccactaattggcaagcaaattaagatagaaatgcacatttcacatgcatgcccatctagtgtatgttcatataatcatgtatggttacggttctaagaaattatgataaaaatgcaaaaccaaagttgaagtgggtgtttgattctgccttgcatcttaatttcgtatgtgcgttttaggtacgataccaaacatacacgaaatgagaacatgaatttaatattgtaaaacatttttaccatttaaacaatatcaatagatgatatatccatgtcatttgccgtaggacatagatgtatctatttttaaataacaataaagtcaaaggaggtgtattaatagttaaatacctcttttcctcatttaaggtttttatttttcttggcattatttttctgttcatgttagagagtttactctgatatattcataattttttaaagttactaatacttattgaaattaataaatttatcttttactaaattcattttctttaatataatattaaaataaaaataaatttaacaatgttttttttctttagaactggatgcgtatttaggttaaaagtttccttttaatagtgacttaatgcacattttatctaatttttaagagaaatatgttttcttataattttaaataataatttgagtgtgtgcttagttgatttttttaataaaaaaatcaatttgtaacatgatttttttttatactaaaaattaaatatttctttaaagaaacgtgagatatgcactaaaaaaattatacttaaaataattagcttaatcaaaattattctttttttaccaaatctttattattaattgttttgaaaaaggacatcacaccctcctttactttgcaaatgaaggtcaaaacccaaacaacctgcattaaacctaaccccttgggagatacccaattcacattataataacaataaaaatatataaacactcttttattttatacatcctctcaataactctcatctatatttttattatatcataattctaataaaagattttttctcattttcttctcttttgccatgtatatcatgggatgttaaacaaacatttttctttcatattatacccactaggccctatttcacaacaaactctgaccactcctcagtctcagggccatgtcttatcaagaaccccaaaactatactgcagaatctaattttcaatttccaaccaaaccctgcttatttttcagactaaaagtaaaaaaaaaaaaaaaaaaaacccgaacccttcaggcttcatcctggtgtccctatgatcgtcatcttccttcttcttttacaagttacagcaaagttaaacaattaaaagaaacaaataattaaatgggccataataatctgaatacaaaatatactccataatcatccgtcaaactaataaggaaggtcattttctggacggctgcattgaatggaatttcctagatagagaaaatgagggaaaaaaatttaattatttatcacccgaaaacaaaagtctttggaaattcagtccctctgttcccaccttttctcattcgtacgcggttcggccgaaattattagcataacttaatccaatcctaacttcatctcttcttgttttcttcacttgctaattttatacccttcaaattttccacagccaaactgtttcatagtatgccaccaccgtttccacacccatatctctcggccttcgaaatttcgctcctttccttcggggaactgctcagttcctgaaaccatcatctgggtaacacaagttttttgaaaacaaaaaagaataatctcagatggcttcggcggctatattctcgtcgctgcggcggcgccggtcgccgtcgctggaggcgtttctggtgccggtcgacttctccgacgtggcgctgctggagactcttatctccatcgccggcgacgtagcgtcctgcttctccggccaccggttccccttccagcgccggaactcgcgtgccctcatcggaaaagttgagattttccggtcaatgttggagtgtctgaaagactccgccggccccggagatcttcccccgacggcggtgctgtgcttaaaggagttctatctgcttctataccgctcaaagattcttcttgattactgtgcccaatcgagcaagttgtggctgctgcttcagaaccattgtgtttctggtcacttccatgatttgagccaagaattttcgacccttttggatgtttttccttttggggaagttggcatcagtgatgatgttagggaacagattgacttgttgcagagacagtccaaaagggctaagttgttcatagataagaaagatgatgttcttaggataaggttcttttggtttcttgaagagtttgagagtgggagggttcccgattctaaggacttgaggtgtttctttgtggataaactgaggattcttgatgctaagagttgtagggtggagattgaagccttggaggagcagattgtgaaccatgagggtgatgttgagcctacggttcctgtgcttaatgggatggtggctatcacaaggtattgcaggtttttgttgtttgggtttgaggaagagttggaagttgagattcaaaagaaggggaggaagaggttgattgctcaggaaattgctgaaacgtttttgactgttcctaaggacttttgttgtccgatatcattggatttgatgtgtgatcctgtgataatttccactggtcaaacttatgataggtggtctatacggaggtggatggaggaagggcattgtacttgtccaaaaacggggcaattgctttcgcataataggcttgttcctaatcgcgctcttaggaatttgattatgcagtggtgcagtgcacatggagtaccctatgatccacctgagggggttgatgcatctgttgagatgtttgtatcagcttgtccctccaaagcttccctcgaagctaaccgagggacgaccacgcttctcattcagcagcttgcggatgggtcacaagctgcacagactgtggctgctagggagataagattgttggccaaaactggaaaggaaaaccgtgccttcattgcgcaagccggggcaattcctcatcttaggaacttgctttcctcacctaatgctgttgcacaggagaattctgtgacggcactgctcaacctatccatttttgaaagaaataaaagcatgatcatggaggaggaagggtgtttaggatcaatagttgaggtgttgcgatttgggcatacaactgaggcaagggagaatgctgctgcaacattgttcagcctctctgctgtccatgattataagaaaagaattgcggataatgtgggagctgttgaagcactggcttggttgttgcaagaggggactcaaagaggaaagaaggatgctgtcacagcattgtttaatctctccactcacactgagaattgtttgagaatgatagaggcaggggcggtgaaagctatggttgtggctttgaggaatgaaggagttgctgaggaagcagctggtgccttggccttgattgttcggcagcctgttggcgccatggcggtggtgagggaggaagcagcagtagccggattgataggaatgatgcgttgtggaacgcctagaggtaaagagaatgcagttgcagcattgttggagctctgcaggagtggaggtgcagctgcaactgaaagagtggttagggcaccggctttggccggattgcttcaaaccttgctctttacaggtacaaagagggcaagaagaaaggcagcttcacttgctagagtgtttcagagatgcgaaaatgcatctctacattatggtggattaggtgtaggttatgtatttgctagcgattcagcttcaaccaggaatactacaacctttgtgagtgatgtttcacttccaatgtccatttctgttcctgttttatagttgtttgttgtgttcccgatttttgttgtaactctatcgattctttcattgaaatttaaagtcatcaagtataggaataccagatatgtattctaaggacttagagaatgatgcgttgttgaacagttagcttcaacccatttgtaatcagttattgcgagaaagaatataaagtgttctaaattggaattattagaccacctcaggcgttttatttcttctgtgctttactcctcccgttggcaatttattggatttttaagagtaatgctacttttttatatgtatgattcatgctccatttatgtttaactcatacaatttaaacttgttttgttaaatttacatggagtcaaaatgtgtgctattgtgctcaatttgttccttgaataaacagcatttttcttttctattttattagagtaacgatacattttggatataaaaacttgcattttcccaatgagggctactggttggttttttttaatttgtaggtcattgatatgtcaactttcttgttaataaagttttttatttgagcatggaaaaggtgtcacaaaatttaaactgatttaaaccgcgggaaagtgtttaaacgttaagatagtttagtttgttataactttatttatctagttgtgaggtgtaatctttgcataaagcggggtagaataaattctctttgttctcatgttttcagtcatcaaatttgtagttttcacttcagataccgtttgttgtgtctaagatttcaatgtgagttagcctcaagcgtgttgcatgcacgattattccgtgttaacattttcagctaattaattctggcccgtgaagtatatgaatgttctattctattatttggacgctatgatgtcactaacttttctgcctaacgtgttagaacgaatgtggatcacacaatagatgctctttcatcttgactcttcctttctttgttccattcctatgtgctaggaaaaaaaacagacatcaatatgtctcgtcataatgggtaggtatcttaaaatattcttaagcatatgatatgaagatagtgagaaaaaagctaaggcaattcaaagatgagtgctatttttggagattaaagtaattgcttgcttccattgagcggtggaggatgatgggcctaacatattattctttggcatagtggcacgtatgaaatgacatgaggggtcgccaaaggaggcgcaatttgatttgttttgattagattattagattattgtcattggttgatggcagcataataatagcaatctaatgtttctttattatatatatgacaataaaaagaatatgaagataaattgaaatattgaatgttccattgaaaaaagaaaatagatggaggttgaaagttttacaagggtgtaaattacccggggattcaataacaatctaaaatgtatgaaaaaaattattaatttttaaaataattttttaaaaataatttaaatagtaatttgtgattagatgataatataatataattttatattattagtgtattaatgttaaactcttaaagtccatcaagtatgataaatttaataattattttaaaataattcaaacgacaattcataattagatgagataacacaattttatactttcttatactttctatatatttagattaaactcttagaagataaattaagtaacaagatgttatttagtatggaatatagaaacatgaaattcataagaatcaaaaatataatgccagaggatagtctcaccattggagggaatagttgggaaaaaaaatctaatatcaatagaacatgtgtttgtacacttttgcatacataaatttcatccgttacatcattagtctcatcatgtgtagtatttaatattaaattttatccgttacttcattattctcatcatgtgtagtatttaatatttagtccaatttattttaggcttttcttaaaaaaagaagaaattgggttaaacaacatataaaagcttttctagaaattagctttatgagttttttacttctattcaaatttcaagatttaatgataatataatatactaaagaaattttatgttaaaaaattatggagtaattaaataattataatttttatctttaatttaaatttaaaataagttttaatctctaaaaaggttagaccaaacaatatttggtttcttttagttttactttctattcccacaccttcgaattccttctaagttcacttaattttgacaacaaaagaaggaaaaaaaaaaacaattttgtgatttttgataattatacgtttctttcttcagttgaagggatccaatcctcgaattatgtttcaaaatggtccaaaaagcccaaaaaataatgattgttatgataagttgtttctatcattcttaatgcaatgatcaaagccactcttgaccgcactattccaagctgttttcattaacctctcttgagaaaggaaaattgcaagtactacacgcacattcatgcttcgttgcttgggtcaattccattacatgaatattcttcatagtggaggcacacagagtgcacacatttaaaaaaataattaattggaggttttgtgagacacttttgttttgagacatggtggtagtcgagcttatcttgtttgatatgatgcgattgaattgttaacgatgacaataacactatatgattctcaattgcttcgttccaatccatccaccatatattttcagcccaagaagtggcacaagttattgtcttgggttctcattgttttctccatttgattgttgtgtaagatttttttatttttacagtgaattgtcactaatattgccccttattgacttgatgtattaagcttaagacctaatggacagagtgttgtgtcgttaggtttctagttaatagaccgtgacaagagagtttgttaagacttagaactaggtgtctatataagctacggttttatttattcattgaaaaacgcaccacaactagaggaacataggacaagacttaataaaagatttgtctggtcattagaaacgttttttcccctcatgtaataatgataaaagtgtcgtgttattttattgtaactcctattttcataaactaattttatgggtaaaaaattgaacctttatgcctaatttgatacactgatccatttgtatctttaattttttcaattttcctatacattaaaccctttcgcatttttaaaactaaaataatttatcggtccttgaaatttctacaataaaattaatttccatacattaacagtcccgttcaattcaaaaaacaagagagaaataaaattcccaaccaatcaacaatttcaaacaatcaattgaacaagttaacaagattgagagaagaaaaaaaaaaatacttttgagtgaacaacaaggacgaatgtcaatgcctaagtagaccagatccaacgatcccctccctcaacctcaagaagcttcggtgattccacctaactcaagttgggccaatgggtgtccagcacaaacctaggaaaacgaaaaaaaaaatctgacccataggcctacaggatgagaagtcagcccattaggaaaacacaaaggaaattatttctcacaccttccatttgcttcctgcacttattccggaatgtaatttttacactcctaaaagatctttctcgaatgtaattttacaatcgagattaggagttccaaaatcttaaaataggtgcaggaagaaacattggaggtataggaagcagccaaaacaaaacctgagcaaagattggtgttcaattactattgatcttgttttcaattagttagatgctcaagagaataaaaatttcaaatggaagcataactgtaatatgtcccctacatgcatattgattgggtttcggtaattcgaattacaatgtataatatcacaactacaaatgtgaaattaaggtgaaactaagtttgagtgtttttttgtttttataaaaaaaatagaaaataagagtgaaaatatatttgtttaaaatttaggaaacattttctctgaaaatattttcaaaaataaacttaaaattgaaaacaataaatcaatattttcaatcttttttgaaaaagttaaaatgcagtggcatcttagagtattttttttctctatacatgttttctaaatcttgaaaatttgaaaatgaagatgaaaaataaaaacagaaaataaacacacaaaccaagcatcacataaactgacttgactagcaaagacgtagcttaaaatagcaatggttttaaaaaaattattgctaaatcaagaggaatatattcacatggaagtgacaataaatagatcctttgctaggagatataagatagattgaatagttaaaaaagagaagaaaagaaaaaagatcatgaattatatcccttttacttaataatttacaactaatatttaccgataaaaaaatagacccctttactatgtttaatcatataattgggaaggggtgcaaagagaggcttcccttcttaagcaacaaaaccggtagaggtaattggacttataagtcttcctattcaaatgattagttgaaacataattattgagaaattcagttaaacaaagaaaaaggagttgcaattttcttcctttataatattgtaataatacccctttttctcttgcagtatcaaatgcatacatggcatttcatgcaataatatggaaatgatgaaaggattctttttcaattcaagttaataaaaaatgcctagatcacgtcagaatgaaaaagaagaatggaatttattgtcgagttgaaggatttattgtgtaagcgtgaaaacgaaataacttgaaaaaaaattgtgtccaaaattattttatgtacgtagttcgtggtttgggccatctatcaaaatcggcaaccgaagaatcaatttgatgacctcttttgttgacaaaatagaacacaaccaatttagaatttcataactaaccgattatttatctaccctatggcttttttggtcttataccttgcttggaaatgaaggttcccctgttgaccctaagaaccttatttcttgtgttggaccttaatagctcatacatcataatttggaggagacaatcagaatcacatgatataataactgctatgacaagggaccattttctaaaatggtagatattgtgtcaagtttcttttgcataatcacatcaatttttcttctaaaatagttcatatgtaatgctggcacagaagctcacagaggatcaacattatcctttgataattgttgaagagggagcccacgccctttgaattgtcattgtttatctacttttgatatgcgtgatttgagtagaacaatatgatcaaaactgtgtatttttcattagaaaattagaagtaaataaagtaaagataaaaagtgtaaatttaaatacaagtaaaaaaaaagtcgctacaaggcatatttttgtgcaactcaatcaataacacttagttacattatgactttttttaatacaaagaatgataaaatacgaagacactcaattactagcagaagttcactcaaaatattattgcagaaagataaatagcaagaagttttacccaatgtttatgatcaatgttatataaatcaaactaaaagttaaaaagaaaattgctttttagtacggcattttcataagaatgctcacggatgacttcataaagtactgcagagtctgcaaattgccttttattttctctctcatgtatggttaacgcattcaaatgattggcaaatttttaaaatattaaaataaggaagtgtgtatttttcttcaaaatataaaattttgatacaggtatatatgactttagtaaaatgagaggatgcatttatccacctttaattacataggtttataggtctatgttcctattaatattgtaattgtgtaacttatttctttataggtcagtcaaatagattgtactttcatggatgataacatggaatttgacatgagcataataggtttgttgacatgatttaatattacttttgattcatgtatcatgagtgtgataccaaagagattaaaagtgtaattaactcacgtcatgtgttaagtaatatatcatcgatcagggtcggttctgggcccattcaaggggctcaaccgcacaggacttcaaaaaataaagggtctcaaatattaattattgtaatatatgttcaatactgaaaactagaggaaatagtaatgtccctgtcatcgatataatattatctaaagtcatgtcaaaataatttattaaatatttaaccataaattaacaagaaagccaaaataccattataatagctagaagatctaatttgcacgattaagatttaggggattaaaatcacaatgagacccgactaataatatgaaggaggtgattgaggaacaagtatcgaaaacacaatatttatgattgagtaaggtgcaaaatttgacaaaaatatcacattttggtcgcctatgaaaggatcattttacacgcctacacagacaggactaaatttggagcaccccaaccgtcaaacattctgcttaatcgtagtagtagtagtgtatgctactaacatgtgtgccagtatgtcacaatagtaatgtccaatgagtctttgaccgagaagaaaaagtggagaaaactgcaaataaataaagccaggaaagaaaaagatgagacaaggattttgctagccagaatcataagaggaaacactcccagtccatcacaatccaaaaagaaactgttttattctttagtcttccaccttttactaatagtgaaaaacaaagttaatattcaaatgaactgcaacatttacattcagctaagtaggaagtaactgctgtacaaaatgacatttactggtctataattctagttcttattgttacaataaagttacagacaacatcttgtataatgttaagtgtccttcaaataaaagctcatacaatgacaatgtacccggttcataataacctataagcaacctaatttctggttaactgcttctattacggtgtatgtgtgggcctaaaaaggtggtccaccccttggcgcaaatctttttttgtgtacaaaccaaaaagcatgaaaagtggcaaaagtggtcacaggaattggggcgggtatctcttttgaaaacatagcagaaaaaaaccagtaagaaacccacgttcctatttaacagcctaaccgtcccactaactgctagaactctctcaactctcactatgcacttcacttctgctctttatcttctctgaagattaataaacccttcaccaccaaatcaagagagtttcaaacaccaaaacaacaagagcagattatgaagtggggtggaaaaaagccttctccttcttcttcttcttctaggccttcttctttcatatctcatgtatctcctttttcatggctttccaagttcaagcagatgagaatcaactcagagccaaaacctggcacactgaagcagaattctactccatctgattatacttcaaccaattatgctaatataaatagaggcaggttttatggaggggatgatgatgaagctttctggagactctcatttggagaagagggtggtaacgagcataggaaaagtgaagatattctgaaaccagtaaagtacaatttggatgctgaacatgccattccatcctcaagtttccccactggattaaataatgctaaaaggcaaggtagtagaaaagaaggcactcagaagatgaagcagaaggacactactggactgagagaagaaacaaaattgttgaatgaagcatcaaagagtataaaggaagttgaatccttaaggagaagatatgagaggaaagcacaaagagttttgcaagagcagctcttgaaattggaaaaggcagaagatgaagctgagtttgcatcaagtccattcttaggaaatgatctgctgcaatttgagtcaccaagaacaattcgcacaccaagaaagcatttttttgtagattcaaagagttctggccttggaagtctcggagaatctcgtgtgtgtagtcctcaattgggttctgagtggcaaagtttgaaacaaactgaggggttgaaattgaaaccaaagggtaaccaacaaaggcaatctcttcatgtgagcagagaaaaccagaggaggaaaccaaagcacaactccaaggttagagtatattctccaaggatgggttccaaggtcgaagtccgcaaaataaaggtcatggaagagaagaagaaagcaaaacagaagatgaagaaagaagaggaaattgtggaggaaacagaagaagggttagatagctttgctgtggtgaaatgttctttggatccacagaaagatttcagagattcaatgattgagatgatcacagagaaacagatcagcgagccagaagaaatggaagatctgttagcgtgctatctgactttgaattctaaggagtaccatgatctcatcatccaagtgttcaagcaagtatggttgtgtatgagccaagccagttcgggtattcaatcagacaagcaatgttgctgttgtgattaacaacataaatgtttggcttgtaggaaaacattggcagaaattgtaaatagttaatcttgttctagttgtgctttattagctttgcttgaatttctttattctcttcacatcttttgtataaaattcaagagaagttgcatcaagatcccaacgaaattcatactttataataataataattataactactagtaagagttctttgtgcatgtatacctatataataccaagttgtttacactcaaaacatgattatcttgttggggttaggattcttgtaagcttgtagcattatgttcattctttagcaatatttttaatataggctctagggaaagaagtctgaagcactgatgagaggtgaaacttgttgaggaaataaggaatctaaaattccaaatggtaaaaatttccaaaaatagagaatgcacctataatacacataagacattgctgctttgcatatcagcatggtcctagacattcacatcagtataatacccataagacattgcccatgccggtggaagaaccggggttaaatgaatgaaagggaaaggaaactattcttcaatccttgtgatcagtatttgacaccaacagatacctttagcatgcatcttattctggcaatacaaataaaataccctaagaatgtgacaaatactaatattctgttatgctcagtgatttgtctgcatccttaaaaatacatggctttaagattagttaggcttaaatttataacttaaaaattaaattctgatatggtaatagattaaaatgttgtgctttttagttaatgagttgaatatgttaaaaggtaaatctggggttctttaacaaatgaacttgaacttttgattcatttagtttttatttattatttattcataaactaaacaagtttgatgagcaggtttcactcattgtaagccctacacaacaaacggcctacttaaataaattagcgtgcctccctttgaagacacccgacacacttcattgaagcctctatgacatttcaaaaaacatatcttagtgactgacccattcttcataaagttgataagctcttgtagcattgatgaaaatgtcatctaagagaaaaatgttagttttactaataaagcttcttataaattctccaactttcataagtgtcagcaggcatgttgggaggcacattaggtgaggccatcaaatggagtcatcgagtgagtgaaaatatttaagagtttgtgagatatatttatcacaaaggtaccctttctgatcatctatgttagggataaataaattatacaacctagctacaatgcaaatactatatatttctattattataatctacatctacagtatggggaaattattaggagaccgaagtgtatatcccaataccttaatttgatgactattatttctattgtgtaaagacccattacctaattactttcaagtggggcatttatgccacatctacacaataccaaattagttaataacatcacaataagtcccaagtttgtatataagatcaaagcaattcttaaagtcaactcggtggttacttgggatacctataaaaaagcacaagcaataaagttaacctacctgctaggggctcataaattggtcattcgactttaatcatgctgctgcaggtaggctttacatgatcaaattaattttttcatttattatttcggcatcgatcattctatatatgcatgtccatattaataactgaacataaataaaactatctagatgtagaattcaatagattttaaactaatcaactaataaagcattaaagttttatcttctaacatctatttcatgaatattggtcactcagagcgttgactagccatccgaaaacacggaaatttttctttgaataaaggcataaaactcatctagaactatagttagactgcggaaaaaggatggaatcaaatcgtactaagttcaattatttggattgttaaaaaagaagataaaatacatccttcctccaattcagatatcgatgatactggaatcatctatttcaatatagaatattcaaataataaaatagtaaagttattttatttcatattattgcactgcatttttcttctataccctattccattctattttaaatttatcattgtatacccaaacttataaactatatttttattgtccatcgtgttttgaagagagtaaaggaagttgtgtctatacttcaattttagtaggctagccttaaacgattacagtcttatcaatcaattcatttaaaaataaattaaatagccctaaagtgaatttgtttttaaagcaagcaaataaaggtttatttattctaaatttttaatatgttgaaatcacaatttattttaattaaatcagttatacatacatttttattaattgactttacagataaaagttttccaaaaaaaatcccttctctagctaggggaatatatatgttcgacacacaattgacatgcttttccacacaacatctgcatacaaacaaatcattaaccagcagttataagtcagagaaaactagtttcaaagtatagtattatatttccaaacattacattcttagaaatattatgtatataaaatattgaaaaaatagaagtagaagaatgaaatgaagacatgtggttactgtattagttgttagtttttttaatactcacaacttctctctttcctcttcttaattgtgtataaaataactttcattctcataaaaatacaatatacatatctttttaccataaaaataagaagacaaatatgaatatttatatttttgataatcaacaatacctaaacatattatttttcaaaacttgtaccatgagaatataataattccaagtcccctcattggaaatatttcttttgcaccactccttttccctttcattcaaacttctttctccctctttctttcatatctctcgattagaaaaatgaaagttttatacattatggaaattaaattacttagctaaacaagaaatttgatacacgagattatgagaatatagaattgcttttttaaaatgaaatattttgaaaataaaataaattgaattgaactaattaaaatgtaatgtcatatatcttaaattcattaaaatttcaaaaatcctttgttctaagactactttaaatatttaggtgaaatataacaaatatgatattattaaaatataacgtctttcaacttgaaaaataaaattattttgagacaaattaaaatatttaaaagaatatatgatataactgaactggttgcttctttgtaaatgtcccacgtagcaaacaaaataattatcgtttagagtcaggtgaagtgttttaaatgtacttgttttattttattttattttattgagacaatgtcattcacaatagaccggctagaccaagtgggtcgcatgctacaatccacaagcattccctatagtctccatataagatcagtgtgctttcattttagtggttcaccatgtacatatggaagaaagagtaactgataattacatgaaattgtgaggaacaaataaatcattattaacattatgtacaaaaagaatatttaaactgtaccaaaaaaaagatcatgattaacatttagaaaaaaaaaattatcttagacatttacattacagcacactgtatacaaacgcaagtatacaagagaagaagtgaagtgatcttggttttttaaaattctatccaaaatagctaaggttgttttccttctcatgataagaaaatcttttctgcgccgccatttgcccactgctcacaggatgaataatttttaatttaacctttgatgatatgaacctaagaaaacaaaaaggaaagaaagaaatcaccattgcaaacagctctcctgagtcatttgaatgattttcattatgacataaatgacaaaaatatatttcattttctatttttatttttaattacaaaaatatcactttatctcttgttttttaaatatttatataagaaacaataaaaaaaagtaaattataatagcatcccctcaagtttacttgaaattaaacataatatccctccttttttatgcttacactaaatttaatttgttttaaacattatattaacacctcttacgcattacattaatttttttaattatttgaaaaatactgcaccttatacttctataatgggttgttataatggtaaaaaaggggtgtgtgtaatttaaaaaaactccaagatgtaatttcaagaaatctcagtaagtcttgctataatttactctaaatataataaaaaattattttcattgttttttatatgaatttcaaaaaatggaaaacaaagtaacattttataactaagaataaaataaaaaaaatattttcttccaaagtcataggttcttatatactttttcttatggccgctaccgctagctattgctacttgtagccgctaaaaggtacttgcagaataacaagtggcagaaagaaatttattaacaagtagacaaaaattaaatgcaaattttaaagagatataaattgtgattgcaaagaaaatgtttaaaaaatcttaaatgttttcaaaagaaaaataaaacttactgcatagaaaaacatttgtaagttaccaacttagatcatgttttagaagatattttaggtagtttttgatttttcttttattaactaaaaaatttgtttgattatttgataaataagttattttagtagtttttatcattttttgaaacactactttaaataatatttttaaaacgctaacttttgatatttttttcatttttattctcaacacatttattcaatttttttattatcttttttaaataaatcatgattttattatttttatgttattttatattttcagctatttcaacaattaattttattaaacaattataatttaataagttaattttcagctattagctcccagcaagtttttcaactaattttatcgaatataaccttaatttcttttatcattgatacaagtccaaattatatttatgtatttcctttcaaaagtaattacatgcaatggaatcccttaagaataaggtttttggaattggaaagaatcattctccatgagattcttagttacattatttataacttttttgttcatagacaaaattaattcaaaattattttccattccaaaacataacttatttccaaacacttcatatttaactagaatttgctcccaaaaatataacccttccccttcatgaaatcccacaagcctcttatccattctcaatcattattcaatcataacatacatacaaataaaactttttagattagatttaaggatgatcagactacaacttataacttccaccacgtcatgttcattcataatttaaaagggaccaccccctaatttgaaagggcaaataaaagatagttccatggcatgtaataggcaaaaacatatcaaatcagtccgtggcatttcatgtgcctcttgctcgttaattatatgttgaacatgaagcagtccaatcaaatgaagagttacatagtatattaaacagcaatacaaattatggatttaatttgaatgagccatcaaagtaatataataaattttgtcacaacatttaattagtttgacctatcatgtatgcatttaattcatgaggtgacaacacaacatcaaataaaatataaaactttattaaacaaagagtacaccaaaatttaaaaacacaaaccaaataaaattattgtaatatacaatttttaaaacaattgtttttatttatgtagttattttcttaaaattacaaaaaattataattattactcaaatatttttcttcaaaaaaaattgaataacaattattttagtttttatatttaactaataatatacattaaatttacatgacaaaattatcacaagacaatgtgttgaatacaaattttatatgttagtacagatgttatatttatcatatatgtatattgttattatatatatatatatattatgatattcaacatatattataataatacaaagagacaaaagaaaaactatcttaccatattttctaactcagctcactctcaagataaaaacaaatactagacacaacaaataactaattgcaacaagggaaatacgaaatataacgttggttgggttgtaaaaggagaacgaaggaaaggagggagaaccaacagatccttaacaaatgtttaatttaaactccttacctgaaagtaccaatgcaaaccataattttgatattaaacgaaggatgaataactaaatccagcagccagtggtaaaattaaaggtatttaacagttcatccgcattacaccagagaatcaaagccccgtggcttacaagttacaacataccatttcaccagatattgcatggacaaattaaagtcaaaaagcacctttatcttagctggtttctgctaggatttccacttgattagtaagtcaaacttggtggttctccccctccccccgagaaaagcaagaaaagctttgccaagttaggatcaattagaaaatttgctttctaacaaatggcatagcaagttagcaaccaaatataatgtggtatgcatcgactttctattctttgcttcagcattagatattatatataatgtggcctaattgcatcgacaagacgcatctcataatgttcgctactcagtaacaacagaaagatgaaatccataaactctaacgcaatcaatatttatcgaaaaggactatttgtgtaacttttccactcaactgaaaacatcaaactgaaccctgatagactgtcactgataggcaccttgtcctcaataaattgcttaccattcaagaatatatgccatatacgagtgacaacttatgatcctgctggtttgatcaaatatttagttttcatttcttatttttataaacaattacaaaaatactactttgttttcacttcatttcctactatcaaagatttgtataagaaatggtgaaaacaattgttttcaacaccatttttgtcaaatctatgaaaacaagaaacaaaatgacaaggcataatttttatatttttttttaaacaaataaaaacaacaaataaaaggttttctcaatccaaacaaatcctaaataaaagctaatttctaactcataatcttagttagccaaatcaaactcaaaatgaccacaagtaactggactggcataattgtttgttgggacttgggagtggttttattaattatactagaactcagcttaaacttaacataatagttgattgtagtatatctgccagagaaacccccctttttgacattaaaagtatgataggttgacaaaaatgaacagctctggccaaacaggaaaggatatatttttcaatatcacaatacatcctcccaccaccctacccagctccctaccttttagccttcgaacactagttcaacacccaagtatatactagaagttcattttccatcataggttctgttcaatccaaggtattttcccttcatcagtttgatgattgtacactagtttaacattacccttctagaatttcttcccatgaaccttgtagtcctctgcttaggctcacacactttgtgcagtttctggctactacaatattatagttgaattgacaagatgtaaatccctacaaaaaattattcagtgaacaaaattgaagtagaagtactatattgcatttcccaaatgggaaatcctagtttccacttcaaatgcaatgtatcaataaattcaagaaaacaacagtctattccattccaggtcagtaagacatactattggtgttcttagtttcaaattatggacgacattattgtggttgcggtaatgtccacaacagcaacagaaccaccctgcaactacaggacaatttccattcacaaaaaatggaggcaaaccaacaaccaaaagatggaaacagagggtatcagttggcagcttctgccatatggtacaagtaacatccagaagggaccaaaggaaaacagaacaaatgtcgactggagataaccataccaaggttctaaattgaggttatgatcacagtcacggttgcggttgtagtgcagtacagaagctgcatgatatggtccataatttaaaagcttgaaccaaacgacagttctgtacaaggcataatagaactctagaagagacaaaagagcggcatacttaactaatgaatcaatgagggatgcaacattcattccacccaaaatatggaatatgtatctattgtagagaaaaatcagaaaactgtgcatacatatatttattacatgtgattgtagaacagtacaagcaagaagaataatcaattgctactatgttttctctgcttgaccaacatgccccatctgttctgaaagattatttgcattccgtttgttccaccaaaatttgttaaggtcgctgggttttccttcattctttctgccatcatattcctttctttctgactccacttcctgtgtttctgatgcaccaggatcctctgtcaagaactgctcccagaatacatcattaacaccagttactgcaacagtggttcccgcaggttgttcttttgatgcaacaggctcagaaacagcagctgtagttggctcagaattcatgtcaattccaggtgacttaggctgaacttcaacatctaattgcgcacaagatatagatggactatcagcacaacttgtagattcatcaaaatccatgtttgactgaatttggacgaaggtgccaccaatatcatgtacaatagcctcccaaaacgccatggatgattcaagctgatccagtcgctccacgtttaatgtcaagacagtgatattgtctgcattttctcttggtaacatttgggaagcttccatagcatcttcaacactagcttcatcataaaagtggccacttctcggcaaccttcgttttctatccatgatttctgtcagaggcaagatatttacagaaatcacaggtttctgcaatacatgagaaacagaagaaaccatcctttgttgattctgttccaacttttccaactgatcttttgagcaatgtatttgtatctcatatgcctgccactcatgctgatatttctgtaattccacgaggagttgctctttatcgtgtttaagtttctctatttcatcagtaaaactctgcctttctgcctcccctagtgggccttgtgcttggagattctgcaaagaatggctatgaaccggcttccgtctatggatgttcttcataagatgaggttgccctctaacaaaatcatcattggcaaattcccattgttctgggtcaacttttctaaatccctgctcaagtaaagatgctaccactaagtttaagaaactaaaagcagaatggggcaacacatacaacaacacaaaacaagtagtattcacatcaacaagaccaagatcaaatttgcttacatatgtgttcagctgcctgatgaaacttgagaagttgttgtgcttaaagaatctaggcagcaaatccctggcaaattcagggggattccatacaatgaaactcttgctagagacactccacgaaacaaccgaatccgtggaaggatcatccaccatctcataagtctttgcaaggaaagggggcagggaacttgaactaccctgtgtatcatccatcactcgaaccaaacctcaatcaaacctactccaaaatctcaacctccccaattcaaaactcaaacaccaatcaatttccaaactttcaaaagaagtcaacccttaattcccaccacgatattcggcagaacatcccacaaaaaaaagaaactttttttctttccaaatctgacctagacaaaaccccaaaacaaaaatttcccacttacagcaaaattaataatagaacaatcatttcaaaaccccatttgcctaaggagagcaaccctaaacccatgaaatcaacaaaatcacaaggcagaaaaagttttcagctttctctcctctcttacctcaaatacctaaacaagcaacgtttacgctgaaacaaatctcacagaatcatgggttgaatttccccaaaaatgttaacgtaggattcttctttccctggacgggaaaaattggagaagcttgcacgtaaagcaacaataattattaattaaaaataaaaatggcagttacgttattgaagctttgcacctgaaaaaggaaagcgaagagtgaaagctgagaaatcgcagagagggaaaaagagtttttttcttcagtttctgggtgattccatatttccaattgttggaatcctttcttcaattttccagttttgttattggggtcaacgcgtggttgatttggaaaggaggggggtggtaccataggaataggattttggaatgaaaataaaagtaaagaattgctattggtgatgtatataaaaattaaaagcaaatttaatactatgagaattagaatgaacgacgatataaaaaaaaaaaaaaaannnnnnnnnnnnnnnnnnntgagctttaaataagtgagatattaactaaatggaaaaagaaacttaaagatacttttaatattattatttaattaaaataaaagttttagttcaataactaatattgatgattctcttttatttactatatattattgaagtaaaaatttaattctaacaatgaagtgcatcaaaagatgtttttatctaaattttattctattaaactttataattattatatgtagggataaatataaaattttcaaacatgagaatggtcattccttaggggaccttgaaaatgatctacaattaaaattgacatttattctaacaacaataatatttggatgccttttaaataagaattaagaattgtcgaaatttaataaagacttaatttttataacatgcaattaaaatttaataatatagaaattaaaattttattatatacaaaaaataatcattggacaaacgtttactgataaaaaaaaaaaaaaacnnnnnnnnnnnnnnnnnnnnnnnnnnnnnnnnnnnnnnnnnnnnnnnnnnnnnnnnnnnnnnnnnnnnnnnagggctttaattatctataacaatttataaataatcactaaaagcaataaaaaaagaaacataatcaattacaaacaacagcttccatgaatgcttttagtaactcaatggtctctgcctatctggttcaccaaatgctgctcccttccattgtgccattaatccattatgatatcgttcacataaatgagcaaacgaagctttatggaaaggttcgcttcaatcgatacaatccaagtgcgagtctcaggaagcaaaatattgatacagcacatgtgaatatagtttttttgtcttttttgggtagcatgttaatatagtatgaaaacgtgtagataccaacaaaatacaaaataaaggggaattttccttccctctagtccctagatggaagaagatacatataatcatattttagttttgaatataataagataaaaagaagcattctgaaccattcaaaagaaaatataggttatctggaccacaaaaaggaaataaagaaaatggtgtgtgaaatgggcttgcttaaaaactacactccagataagaacattgattattagcaaacagtttcccatacccgtctctatcttgtcgttaattggttattttatttattaatcgattgttactttgcttgagatggttatttcgggagatgatgatgtaagaattaactagatctatagtctatattaacctaatggaggggtccattctaacaaaacagtagcacggactgaagccacatccatgaagcaatcgatcaccaatatataagtgagataacgtattcaagcacgcaaaaggtggaagagtaatggttaactgttcattttagacttttggtgatagttgattgtaactaactgaccaaataatgtttgtttgttattgaggataaaaacgttcagtctagaaaaacttccactgaagagctaaaactatatgctcaaagagtaggacttgatatacaagcataaatgaaatcttcactttacttatcagatcgtgtggaggttcacaataatgattaatgacatgttgatctcagtcataccaccaacaccaagaacttgacttctatcttaaatcataaatgattccctttgagccaagtcgccattccagttctttctagtcaaacccattggctaaatgacccttgcaatagaatcctcaacaaagtaactagatccttttagacgttttgcttggtcacatacatagacatatggattgttatatgtggcacaggtatgcaggacaaaacttttcctaatatgtggtaaacttagtcggttcattatttgggatcaaaatttgcttaggaatcgatttctatgcatagactccaataattgaagaggctcattttagaaaactagtcatggcctataattatgtttaagtatattttctgatgctagagtatcccgtatggccaactttttccttctccaagacattgattacatcccatatcactcattcaccctcaggaaaatagccaccgtttgagtgaaaaccttttgcccacactgcactatcgccttccaacataggtacaagtgtagaactgaaactggtatcatccatacttcagtatcttcatacagtggagaatcattatggaaatactttccaagctttccaagagaacttaaatgttccatctcatctttagttactctagatttagtaacatgatccctttctatcaccacccacgccatcaatcagtcaatggcatcaaagcaccacatatcagtaaatgaaaattcaagatgtttgaagtcacaaaaacaccatccactaaaaacacatcatcaaaatcgtgagagaaaaaaatccagtttaccaaacacaaacaaatgtatgtatatctaccaaaggagggttcgaacggagatatataatgttggtgggtggtagctgttgagtcatttacaaacataccaagtcattaagtagtatttaataaataagagttatcgtttctacgaagacttgcacaatacttagtaaatatcaaaagtttttactatttaaactaacaaataaactatgttgatttgaacataatatttaacaataaagataaaacagaacaaaactacaaattatgatatttttgggattttcgacaaacacatattaaaacgatatgaatttcagatcacaaaggttatcagggttagatatcaccgaaccaaactctctttacgctaaaacatgatattcaacttgtaatccaacgttaatatcgaccacaatttaaaaacagtattctaatccctaatttcttaggtgaaaaaacttaagtttctctcttaaatgtcaatcatttgaacaattaacaaaagaacttgctttaagctcgatgacctaaagataaccattatccctcatcatattcctagctttgaggtttaatggccattttatcacagttcaaaataaagaaagtattttctaatagtaatctcatccaagaatcaagctatgagtgaccaaaaacaagaaaaaatggaggaacaatggaagaaaagagttggggaagaataaatttttaaatgaagtgtttttacaaaatgatgaagcgtgccctaaaataaacgagataatctatttatacatttccaaaaaatctacacttaaatgagtgtttaaacagttaatgtagttatacaattctacacatctgtctaaatttagcttaaaccaaaagttatttttatgaagttaattttttttaactttcttttttatcttctacaaaaaaagaattttgatttatctcctcgaatccaaacttaagtacatttgagctaaaattttcactttcagctttcattaaatcttgctccaaaaaattgtaatttgatccaattcaaaatcctacaaaatgatctattaataaagcatgtgaaatctaacaaaataacaaattaaaaagaacaaactataacttaacaatttatatataaaaaacataaataaagtcctaaaaataagaaaaagatgaaataattatctaaatttatatgtctcaagttaaatatttttggcaattattatagtcataagagaaactagaaaaccctttaggataaattttctgctacttggacgtgttccttaaaatctgaattgttaccatccattaaaacaaacaagcaccaaattttaccatttaaattttaagctgtatccaagtgtctctctgtacacagtatcaacataaagatcagccaaaacagtcagaaaaatcacctttgcaaatagctaactaactttctgataaaattcaaattaatgtcagaagaacaaaactttcataatcaaaacggaaagggtctctatttaggtgccttcatgtcaagcagcgaatcttcaactttccaccctggccacatattatccggtttctgtactatataattattgttatatagtcatcataccttgataagacgggtaaactaatgtttggagtagaattacaaaccaaatattatgcaaaattaaattataaaattttacaaattaaatttctgaagaatcttactataatggagtatatttcaaaataactttttctgctattaaaatattaagtgaattttagaaattagtaatctgcactaaattttataaatataataaattaaagcaatccaaacctgaccaaactccatgtaattttaatattctaagatccccacatgacctgacccagtcacgttgcagccaccccccgagtttcaatcattcaaacaaatattgtctttccaacatccttttcctacatctgaaggtccactttccaatatcagctttggttctgttgtaagtaagaaactgaggtggtttagcattaacaaccactttgaaagctgaaatcttttttgaggtttgcatcatccaaaaatggtgttgaagtccaaggcagagttccttgtcctcttggtccttgttgtgtgccaaccctcttgtgggttgggggaggattggtctactaggagactcagtaggcataataataagatgatttctccaagctgtggagagttggtgttgaagtcacagtgctcagagaactcaaaatgcaggtggtgcaccagtgaggaccttgatgacatgtgcttctctaaatctgaggcattgagattgcctcaccaggttttctcttgtgccttcatcccctgagatctattctctcttggatctcaggatctgtgttgcctaccctacactaaccaattttcaaggactacttttattttttgttgtgtttatgtcttgttttttgtgtttttaggtatgacttgatagagggtggcgttgttgttgtatattcagtttatgatttacttcaaatttgagacatggttagggtatatagttgaagatagagaggaaatcgccacattctatccttttgcttcattatctgttgcgaaagcctcattcaaatagctgaatagttcatctcagttcatttacatgccttttgggggcagctcagctaacaatgtaaaagcttcaataaaaacagccaaaaaaattatcatatgtttcatttttcatcttaaattggatgataacatgaacactttagtcccctcccccattgctttgtttttctagctactagaagattacttagccgattttcattattataagaaatacttggtgccattagaaaacctgtttacaaaacaaactccctgataatgttgttctttttggccagaaaagaattttttttttaatgctaatttaacgttttggcttggcttatcaatattgaaggaaactgctgtctcctctgttaataatgctgatggtgcttggtagaattgaaaataggagttctggttttaatgctattttaactcttagatatctaataagataacatcaagatataatgcacaaatgacaagcgcaggaaattccaggtttctggtttcataatagtttaatttgactttgattatcttaacttttatccaggttcatggtgataaacaaagttaagatctcttaaaatgttaatttgttcaaagtcaaacaaagagatcttaattgtcttcctggtagcacaaggaagacaattaacatatcttaaaatgttaagtcttccctgnnnnnnnnnnnnnnnnnnnnnnnnnnnnnnnnnnnnnnnnnnnnnnnnnnnnnnnnnnnnnnnnnnnnnnnnnnnnnngtgatttaaatgtttaaattcattagtcaataagtaagtttagctttgatagctgttaacttatttaattatttgaagccattcatgaaaattcccatgttatttgaaactgcaaactttatcaaatgtttgagctgaaacaattactgacatgtttacactaaacttatttaatgttcaattcaactcatttgttttaataaatattcaaatttaactttgactttgatctttataatctaaatgagtcacgccgcccaatttatagccttgaaattaaaagtctataaataactcgcatgtgcatatatagaatgttacaaaaaaattgtaatttcatatagatatgtttagttaattgtagttttatcttaaatttttatcattttttaatctttatgtctaaatatttttctattctctttctccttttatctttatgaaaatgtttattaaatacttatttaagaaagggattttttatgtacatatatagacgggaaaattgaaactaaaatcttatataaactacctaaatctttctaccgctaatctgaacctggtgataaagggattgttaattgtgtgtttatgaatccccaatagaaaatctaattaataaacttaacaaaaaaaacactctaagaagtaagaatatagttaatatataaaaatagtcatattctaaaaggattgagtaaattaaacgtaaactttgtatattcttaacaaataaattttatattttaaatttcactcgttttaaatgtataaatcaaacttaattatcattttttttcaatcaaactaactagtgtcagctttttttagttgtcttcttataaaaaaactaagaaaagatatccatatcaataagaaacgggccaaaaaagggcccagagaacaatttaaggagtggcccagcagcatacaatcgcttagcgatattttcttcctccagccagcatatttctcttactgtgggtgtatgaagaaatatgatgaatgcagaaagaaaatccctccttagaataggatcataagcactttaatcatttgggccttagattcttataagagcttatagcctcaacagatcatacgcactacatcccaatttacgcaaacacgtaaactttagaaaaaccttaagaaaaagtgaaataagaagactttctagcagaggaaacaaataccatgataagcaacacaaattacactacaagttaattattattttcaaatcagtgtaacttacttttgtgggctccacaaagataatttaaggacgttaatcgaaaaccttgacctgaaatgaatggagttacacttattgaaaccaccccaaacaatcatttaatcaaaagtgacatataagaagctattggaattgaattaatagtgaaaattttaaacagtttatactaaatcaaacttcattgtcgttattaaaaaagcatgacgtgtataagtcattgtctgccacccaaatattaaatttattaaaagttatccacatgtttcaagtttcaacttataaaagatcatctctttacgaatccattgagaaactctttccaaaatgatactgttcagattagtgacgcgttattcctgtcatgttgtaaaggaattggtggggtcaacccttttttttcagtcaatttaattttaactttaaatttagtgcatttagtgtaaaaacaattatattacggcgtatcatctaacgatatgtataacattaattaatacattacagttggcatattattaaatttattgagtaatgtaaaaatgtactattaaagcagtaaaaaaatgttctattaaaagtgtaatttttgtaattcattaaaattaaacactttaacttgttgttcttgcaaacattttttttttcatttcatgatagaaccatagaagaagacttcaacatgaccataatgagatccccgatggtagttacgtgtaaaaactctcacactctagttagtgagagaacgagggaatgtaaaaaatgagattagattcatatttgatgggttagaaacccttatagaacaattgtttaagtagaaagttagtgaatcaacttgataaggttaacgccaataaattaatctaatttctaaaatatcataaatgagtttcttaatatatatatataatttcataaaagcataaaaaacttaaagatgaaaataaaattaactcgatacaaatgtgtacttcaatcactttttcagaagtcttattgatgataaaatttttgagagttcttgtataaaaatggttctctaggctactagacatttcatttctcttcaacggggagaactaaacaaaaataaattcttgtttataagaactcgataaaaactttgtttttggagatggactcaatagccaatgacatcaaacattttaggcatttttgtcatttgcttacattttttttcaggttgtgttcttttttttattattattaaatttagctagatgtttaattaatagtgtcaagatggtagatcttgggctttagcttcacgtgttaaccaaaaagaatttaattgaaaaaagaataattaacaagtgtatttaacatactagttaaaaaaatgtcaataaaaacatctaatatttattttaagtgattaaaatattaaatttaatttaataattagatgtttgttaatcacttgataagacccatgttttaaaagcaatggagtatttaacatgaacagtttggcaaataagggaaatggtgaaaacaaaatcaatatatataacataaaatcggacaaggtcaaaatatgcttggtgttgaccatgtgctcagtagtgggaggttggaaattttttgcatgcgcattcaattaattccttttgcgtcaatgcttggactcgttgctaatttgctattgatgaactggttagaaaagaaaagaagcaggatttaatttttactatagcattcttgtatacttattaaatggaaaagtattgaatatttttttatatacttaagacattaatgcgcatttatttaatttctatcaaattctttgtttagaaaatattgagggaattgataaaaatatatagcagtattaatttttcatctcatacttctgcttcttttttttttttttactgaattacatacttctgctatttatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttttttttactgaattacatacttctgctatttatttttatataactaaagtataaatattaatgaactgcataatgatggcttgacaaagtacttaaatattctccagcttagggatctttttttttcatttttgtctttttgagaagatcaatatgcaaattctcgcgaatattattatatatatcatcatttatgcaagaggacgtatatatatttacatatgttttttcaattattaaaatgttcagttttggaaaaccttgctactatgatctcttttcttttctcatagccttggacagttggactactatcatccacctcgggtaaactaactggttgacatttgaatttctagtttgcctcgtttggtaaaaatattggttctcatttttgttattcaataatttcgtaaaatataatgccttactcatttgcgtggtgtgataatatctaccaaacttataaagttatttttaactattttttttatttaaatgagagaataaaaaaaaattcacaattataattttaataaattatattatatataaagacataatatttggttattttgttgtaccttctttaagagtttggtgatatattgttttcgaaagcaacagattttggggtaattatatagtttttttgtgtgtgatatttttacttcttaaaaataatatattataatttaattaaatnnnnnnnnnnaatttctagtttgcctcgtttggtaaaaatattggttctcatttttgttattcaataatttcataatatataatgccttactcatttgcataagatatttacttcatgcattaattaaaatgatttattttgtattcatgtttttttacaggaattttgctttcatgttaaaatatacatgtttgtttgtttatgtgtggtgtgataatatctaccaaacttataaacttatttttaactatttttttatttaaatgcgagaatagaaataaattcacaattataattttaataatttatattatatataaagacataatatttggttattttgttgaaccttctttaagagtttagtgatatattgttttcgaaagcaacagattttgtggtaattatttagtttttttgtgtgtgatatttttacttcttaaaaataatatattataatttaattaaataaacatatatttttaaaatttgaaattatttacttttcatttttaattaatttttaaataacattgttttgaaaaaataattaatcattttataattttaaacatttaactgaaaaatattagaatttcattataaaattaaaaataaaaagtaaataataataatagtaaaggaagaattctaatgaaataatgacgattaaatgagaaaaaaaaataagttaggaatagacatattttatattatactttctataaattttattattgatattgtacacacacaaaatttatctattccagaccatagaagacggtttttcataaattatttgatttaattcacaaaaaaatatgagtaatttttttattatatcaatttaaagttaaaaaataaattcagataacattattaaaaattaaaagtaaaggtaaatcataacaaaaacatagaaagtacaatcaacctagtaatcttttatagcagatatcgatcctcatagtggataaatcgaattacaaatagccaagtacgttgctatgacagaaatgtgagatcagcctaatgctaattcctaggggtaatgtgaacggagtttatttttttgggtgcatgatgtgaactgaatcctttgacaaacctaagcgtcttcgttggtttttaaaatataagttttatcaagaatttattttcctgaaacaatgtgtaaagcttttgataaatttgtttctcaaaaaatttaaattttagtttccaaataaaaaaagtataataaattcttctatcaattaacttttattcacta

(The sequence listing continues in the following parts.)

That which is claimed:

1. A method of producing a soybean plant having increased resistance to Asian soybean rust (ASR), the method comprising the steps of:

a) providing a first soybean plant comprising in its genome a chromosomal interval comprising SEQ ID NO: 2, wherein said first soybean plant has resistance to ASR;

b) crossing the first soybean plant with a second soybean plant not comprising said chromosomal interval to produce a progeny soybean plant;

c) selecting the progeny soybean plant by isolating a nucleic acid from said progeny plant and detecting within said nucleic acid the presence of an allele that associates with ASR resistance, wherein said allele is an A at a position corresponding to position 1535471 of SEQ ID NO: 2, a G at position 1525812 of SEQ ID NO: 2, a G at position 1538522 of SEQ ID NO: 2, or a favorable allele positioned between the G at position 1525812 and the G at position 1538522 of SEQ ID NO: 2, thereby producing a soybean plant having resistance to ASR.

2. A method of producing a soybean plant having increased resistance to Asian soybean rust (ASR), the method comprising the steps of:

a) wide crossing a *Glycine max* plant with an ASR resistant *Glycine tomentella* plant having in its genome a chromosomal interval comprising SEQ ID NO: 2, or a portion thereof;

b) generating soybean pods from the cross of a);

c) isolating embryos from the pods of step b) and placing said embryos onto embryo rescue medium, wherein there is no callus induction;

d) analyzing genomic nucleic acid isolated from the embryo of step c) for the presence of an allele that associates with ASR resistance and is located within the chromosomal interval comprising SEQ ID NO: 2, wherein the allele is an A at a position corresponding to position 1535471 of SEQ ID NO: 2, a G at position 1525812 of SEQ ID NO: 2, a G at position 151538522 of SEQ ID NO: 2, or a favorable allele positioned between the G at position 1525812 and the G at position 1538522 of SEQ ID NO: 2;

e) transferring the embryos of step d) onto germination medium or elongation medium and collecting shoots from said embryos;

f) growing the collected shoots of step e) on germination or elongation medium; and g) transferring established shoots of step f) to soil, thereby producing a soybean plant having resistance to ASR.

3. The method of claim 2, wherein the embryos or shoots are treated with a chromosome doubling agent in any one of steps e)-g) to create amphidiploid plants, wherein the chromosome doubling agent is either colchicine or trifluralin.

4. A method of selecting a soybean plant having ASR resistance, the method comprising the steps of:

a. isolating a nucleic acid from a soybean plant;

b. detecting in the nucleic acid the presence of an allele that associates with ASR resistance, wherein the allele is an A at a position corresponding to position 1535471 of SEQ ID NO: 2, a G at position 1525812 of SEQ ID NO: 2, a G at position 1538522 of SEQ ID NO: 2, or a favorable allele positioned between the G at position 1525812 and the G at position 1538522 of SEQ ID NO: 2;

c. selecting a soybean plant having ASR resistance on the basis of the allele detected in step b); and d. crossing the selected soybean plant with another soybean plant lacking an ASR resistance allele.

* * * * *